United States Patent 8,781,750 (CELL-TYPE-SPECIFIC PATTERNS OF GENE EXPRESSION) - sequence listing, part 14

SEQ ID NO: 36345 - DNA, 210748 bp, Homo sapiens
ggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggtgagtagccaggcgcggctccccggtccccccgacccccggcgccagcttttgctttcccagccagggcgcggtggggtttgtccgggcagtgcctcgagcaactgggaaggccaaggcggagggaaacttggcttcggggagaagtgcgatcgcagccgggaggcttccccagccccgcgggccgggtgagaacaggtggcgccggcccgaccaggcgctttgtgtcggggcgcgaggatctggagcgaactgctgcgcctcggtgggccgctcccttccctcccttgctcccccgggcggccgcacgccgggtcggccgggtaacggagagggagtcgccaggaatgtggctctggggactgcctcgctcggggaaggggagagggtggccacggtgttaggagaggcgcgggagccgagaggtggcgcgggggtgccaccgttgccgcaggctggagagagattgctcccagtgaggcgcgtaccgtctgggcgagggcttcattcttccgcggcgtccctggaggtgggaaagctgggtgggcatgtgtgcagagaaaggggaggcggggaggccagtcacttccggagccggttctgatcccaacagaccgcccagcgtttggggacgccgacctcggggtgccgtggtgcccggccccacgcgcgcgcggggctgaggggtcgggggcgtccctggccgcccagctttaacaaagggtgctcctctccaccccgcgaggaggggcagctccggagacccggtcttcagcgagcggggtcttagcgccggggaggtctacttccttttggggttgccattttactattattattgccttttttttttcttcaaaaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcaggtaaagggggtaccagaagcgtaccctcctggattgtggaaatgcataacgatggggccattgggtggtaaacaaatgcagtttgaatcaggcgtctccctcgccctttctggagatgcgcaaatcatagagaaaagagttactaacccagcggtaaaccgcctgatccaagggcctgggggtggaggagaggcagcagttcagggctagattatgatgcacagtatattgatccagtcccctggacaaaatcagatttaattgtccgtgctaactcttgtcagcccttgcccttctgtgacaacaggacaaacactaagattataattgcaattggagttagcttttatgtgtgatttaaacggagggtacaaactaattaataggttttaaaaatcttagtactttaccctctatctaaattttcagtgtaatttgagcaagtattggtaggtggtaaatggagacttgccagatgttgacattgggcttggattttgaaacttcttccaaccaggaatttaattacctggttggtgttggtggttgctttggtttcatttacaatgttaaatttttaacaaatcaatgagagtctaatatggctatctggattcagagcatacctccattgctgtagcagctgtgattctcagtgtaaaatctttcagtttctaggtaaacaaagaatagtttctttcggggcatctaagggctgattgctgtttcctttgactgtgtattagacagagtgttttgggctctggtcaactttagtagaaaacctagttttcatacatacatttaaaactgaatttatggaatttgactgtggtgtatttacattgtgagtggagtaggcaaaaggatctttaaacaaacaaaatatgtatttacttatatgtgcattgaaatatgtattttcccatatacatctgatgtcctgatacaaagcttcctttttctccatgaaaaggaaattaaaaaacacccacatcctggattgcctaatgagaattatggaaactaagcttaactaaatttttttaaaaattcaaatgatagtgtagaatttttttaaaagttactgtaacagagtatttctctaaatatttagtatcgactgaaaacatagatgggggcctgtgcttaggaagagctctctgtatattgatgatctggtgagtaaataaggaaagctcttcaaacatcacatttcatggatatgtttaagattaaagtttaagagtgtgtgggtgaaatatttggtttaactggaattaaataactttactgtggttttcagcaagatgagtggtatttggagttttcctttgggactggaagaaaaaagcaaaaaaataaattttaatttgatttgcatagtgtggcctgatcgtttaagtgttgttagaaagagagatgactaaaattagttgagattattatattatggattaagtatattgaccttattttcattatgattttttggtaccattatgtgttatgagaaagaaatagaaaaagaggcctccctgtggttggcgaagggagtttttgatctttatttcgtgggcgtgatgatgaggggagggaggtggcttacttatttgtcactagcactttgatttgctcagtgtacatttttgtgtataacgttctccccactgtgcaaggcaaattgacaaattgtttattaaataatttgtgtgacctaggaattttaaagaaatgctctgaaaaactggaagtctgaagtttttaaaaatgaaatgtacagactcatctatcttgtataactgctattgtttttgccaaaaaatgagtgaatgattgttttttggaaaatttttcaagtcctgattttatgtctgccttggatgtagccacttcctgaaaacaagtcctaatgtaaaatggacatgtaggaagatgctgcttatatgacatcacgtgtcactgagggaagattgggagtggaggcaggagtttggtggcaggaaaatggaaatgggcagatatgtggcacaaatgcaaggtcattctaagcagtgaattactagtagaccagtatctaagatttaagactttacttggccaggcgaggtggctcacacctgtaatcccagcacttttgggaggctgaggtaggcaaatcacgaggtcaggagttcaagaccagcctggctaacatagtgaaaccctgtctctactaaaaatacaaaaaaaattatctaagatttaagactttaattggccaggcgcagtggcgcgcgcctgtagtcccagctatttgggaggctgaggcatgagaatcgcctgaacctgggaggcggaggttgcagtgaatggagatcgcgccactgccctccagcctgggtgatacagcgagactctgtctcaaaaaaaaaagaaagaaaaaaaagactttacttatatatctttagcagtcatctaaataataacgattcacttaccttataaatgtagtgagacaaagtacatagccaggaggaaagatgggtttttgaagaagtagagtacaagtattattgttaatgttattttacttttaggaaaattgaaaatgttcgtatttgtgtgtactgcctaagacttctgtaaaagctctctgtcaacggtcaggaactttatagagtattgcaactattgcagcagtccatctgcagcagtaatagagcagatgggccactggacagataccctggtccaaaacctggctctgcaacttgccagttttcttgaacaggccatttacccactctgacactcaggattttcctctatgagaggtttagtgcttttttcattgctgttgtaaaaataatctaacttgtaaaagtagttgatcagcagtagagagttaaacaaatatagatattatctgtagactggctgagacatctgggtgccccaggcaagctaataacttggccggcaagtcaatattctttaagtttctgtttaccagctttgggaggggatgccttataggaaaagggtcatggggagaagggttgctgacagcattcagcctccactatgattctgaataatgcagccctggccttgagctggcacaccctccaagcagaagcaagtccctgcagcagatgcacttgttatctttagaagggtgcttggtggccttcagttttggctcctggaggccctttagggtctcaccctctgtcccaggaggcggaacaaagaactgcctccatgatgtgtaatagtctctgggaggagttcttataaatctgctattataccgaggtgttttaatgccccaggatgccctagcatctcttatcagttggcacctcgggcagctgcaggctgacttgccccattgtcgggctctagttacacccttggccgtcgttcagcctaacctgtgagcctcctgggcacctctctgtgtacactgctttcctgagggactggccttctttcctattgcaccatctgaccttatatgatcttaagacctaagtcctacttccttaatgaatccttccacaatgagtttccccttttaaagtcaagtgacttctctgagactctctttgtccatgaccatagactgcccagtgacatgtttatcctgtttcatgtttattagtcttgtattactctttgcagccagcttgtgagtttctttggggtgtgccctgtggtttggagttgttgtggtcctttctccccatggtgtgcagggtttcatagacttcctgcaaattggtatctatgatcaatattgggattaatgcatgcctcaatgagctaatgcagtttggcaagtgtaattttgagaccagaatggggatgtaagatgcaaacgatgatgctgatgctgatactgttagagaggcagtgtgcagtgtggaaaaacctgagaatgctcatttggaaagtggggagacacctaccctggtagagtgttgttagaattacagacgtggctttaaacatctgacatgcagtctgtctttctagtctacaggtagatatgcatttactgaacacctactaagtgtgatgtgtctaaaatatatatatatgtatatgttttttatatatatgtgtgtgtgtatatgtatatatatatatattttagagacagggtcttactctgtttcccaggctggagtgcagtggcacagtcatagctcactgtaaccttgaactcctgggctcaagcagtcctcccaccttggccttccaaagctctgagattatagggcagagacactgtgcctggcctctaatatatcatttttattatttttaataacctgttttctccatcacagcatttaccacattgcatagtaactgcttatttgatgatctgctttctccatggggccattaccttggacttgctcctcactttttatttctaatgcccaggttgatgcatggcacttagaaggcgctcagtaaatgcatgctgttagactagactgagtggatcaatatatgtaaagcaacttgaaagaatatgtatgtattagggcctcaacaaatgatggcttgtggtgaagatgaacacttaggatataatggctgccgctcatcaaaataaaaactgctcttgtttttgcattctttgtggctgaacagtaatgagcacagcagccaaaattttcaagcacaagatcagttttaaacaaaacaaatgaagtggagcattaaatattttacattggtttggatggtcattggaagctaataattcaagtttaaaacattcccctttcggcataaaatccataggcattttaattgaagtaagaaattgtcataagccctggcagtccaagtgcttctctagaccggtttactgtggattgcaggagtcagtcctatgaataatggcaaccctgtgtggctcatagaaggggagagactttctggcatgttttttcttcagaaatgggaaccgcaggccaccggtgggtttctgcatccttataggactgtgctgaatgtgacatttttcctcttagcatttttgactcagaatgctctcagatgtttcctctgataggaaagggtccaaagttttaagagagataaagttcagctacatagattaaaggcaacggttagtgattttaaaagtgtgtacattttaggaaggtctaataataattttccaggatgtgaagggaaagcatgatggtgttagtaagtggcagtttggttgaatgcttgcttgctggcactgggagtgtgttgctggattactagggcaggcatcaaatttaggttcaagggggccaggaacagagtaggtggaggtgcttattggtcgggaagccagggaacatggaagctcacttcttggtcccccatgctcttttaccctcagcttgtgtctccccggccaatgaggaaactgaaggccccatatcattggtatatgcctctgcaaagccatgaaaaactcataagaaacctacagagatggatgtccagataaattccagtgcactcatccctcggtatccatggcggattagttccaggacctctggggacaccagaatccacaaatgctgaagtcccttatataaaatggcatagtatttgcatataactgatgtaatcttcccatatatcttaaatcatctctagattacttacaatacttagtacaatgtaaatgctaactaaatagtagcattataatgtttagggaataataaccagaaaaaaaagtctgtatatgttcagtacagatgcagttttttcctgaatatttttggtacaaggttggttgaatccatggatgcagaacccacagatccagagggctgactgtagttgtatacaggtgttatatcaggagaggcaacattggctcttccaccttgttctcttccctcctagcagagttgtaatccagaccacttctttccagatgattaggggtgaggggctgagctgctggatatctgatatctgggagtggcatggtcaaggtcacattgcctgactcagcagggaaatgtgttaggaactttcatccttcattctagccaactgccatgagtacctaacattttgtataaattaagtgaatattattttagtagaaatttatttctgattatgagacaaaggaagccactcttctgacaagaggggagtggtttccattggggaagagtaccccagagagctcagggactttgtttgtttgtgtctttttgtttgtttgattttgttttgtttttttgagacggagtctcactctgttgcccaggctagagtgtagtggcgtgatctcggctcactgcaacctccgccctctgggttcaagtgattctcctgcctcagcctcccaagtagctgggattacaggcgcctgccaccgtgcctggcttattttttgtatttttagtagagacggggtttcaccatcttggccaggctggtcttgaactcctgacctcgtgagtcaccctcctcggcctcccgaagtgctgggattacaggcatgaatcactgtgcctggccttttgcatttttggagacgaagtcttgctctgttgcccaggctagagtgcagtggggcgatcttggctcactgcaacctctgcctccccagttcaagtgattctctgtctcagcctccaaatagctggaattataggcatgcatcaccatacctggctaatttttttatttttagtagaggtggggtttcgccatgttggctaggctggtcttgaactcctgacctcaagtgatccgcccgtctcggcctcccaaagtgctgggattataagcgtcagcctctcgctgtgcctggccgggactttgacctggaagaaggctgagtgaccagcattgcctcccttcacattttatccacctgtgtttagacaggtcaagtggctttctccaggcagctgattaaaaggtggcaagacatggacccagaacccagggccaggcctatttcattatctgtgctatttaggatttggcagttttccatctttgaaagccagatgaagttgatatttaagagaggtgaagtaggcagccatttggcgccaatttatttcagcatctgcatggagaaaatggttagggataaatagtagacccttcatggaaggttttcatttgaagcccagccaaaggcaacagggtctgccctttgagctcagaactttcgcaggccttaacgacacactgggaccttctttccttttccaaatggcttcagccttgcagtttggaatgatgtcaacatgtggcgtagttttattcaagtcccaagttaatggtttacctttttagaaaactccaaaaacactttcattgttatttaacttttgagttatgtaatgtctaagagtcttgtctctgacccgtgcacctacctgccactgaccaacagtttctcatttccttacgcaacaactagtctggctagcttagagttggtgtgtgattgtttgagactttatgtggaagataatatttaattgttttgttctggtttgttggggtaaattatacaaatggaatgcatcctttctcggccttgaaagaggttatatgacagtacaattataataaattcagtgtatgactttgggtacattctattataaacgaatttttttaaaggtgcagttagaagaaggtggaagaaaaaagaagttgacactccgattttccacatcatctaactaaaatggatttaaactaactttctctaactattaaatctttcttaggtaagtacagttgtatcccagctctagagttaatgtgctgggtgggtttttacaaataaaaaatctaaaacctaaaatagttgtgttttatcttctgtcccaatccaaaacaaaacaaaacaatcatgtgatagtaactaatctctggagatacctgacaagcgtggtccaatagtgacgcgggtttgtcactttggtctttaggtgacattgacagctggtgtggcatatggatcacactgtggtcattgaagtataatgttgcttacttctgagaagtgatcatggggccttttttttgagacggaatttcgctcttgttgccctggctggaatgcaatggcgctatctcggctcactgcaacctccgcctcctgggttcaagcgattctcctgcctcagcctcccaagtagctgggattacaggcatgcaccaccacgcctggctaattttgtatttttagaggatttctccatgttagtctggctggtcttgaactcctgacctcaggtgatctgctcgcctcagcctcccaaagtgttgggattacaggcatgagccaccgcatctggtgttcacggggcttttaccttatgtactacctttcgatgtttcagttgtgagcttgaaaaattttattcagtaacctaacatataattagagatgccagagtggtggggaggggagggaaggaggttgggagaatgttgttgattttttttttccctttataaacacatacaactttggacgaagaacataatgtttgagcaaatgaatgcttgtaaactgccgatctctgaagtgtgaaaagtttatattgatggcacttatattcataagcctgatgggttttggctgggaaatttggctcgaggtacggacttcttttgggacacattttatttttctgtcaaaactgcctgattattcttatttaggaaatatgtgatgaatgaggctggctggcaaatattttaagtgcagttgatattataaattttcacctacaaaaatgaactacttttcattgttgaatagttatgtcttagttcattgcttttacttttgaaactgtataaacttttccctttttttggagacggagtgtcgctctgtcacccagactagagtgcagtggcatgctcttggctcgctgcaacctctgcctcctgagtcaagtgattctcctgcctcagcctcctgagtagctgggactacaggcacccgccacgacgcccggctaatttttgtgtttttagtagagacggggtttcaccatgatggccaggctgatctggaactcctgacctcaggtgatctgccctcctcggtctcccaaagtactgggattacaggtgtgagtcgccgcactggtccaacttttccttttcaccttagaaagattgtcaggatttttttttttttttaaacggagtcttgctttgtcgcccaggctggagtgcagtggcgcgatttcggctcactgcaacctccacctcccgggttcacgccattctcctgcctcagcctcccgagtagctgggactacaggtgcccgccaccacacctggctaatttttggtatttttagtagagtcagggtttcaccgtgttagccaggatggtctctatctcctgacctcgtgatccgcccacctcggcctcccaaagtgctgggattacaggcgtgagccaccgtgcccggccacgattgtcaggatttttgagaccttactacaacccctgacacctgacccacagtatagaattttccaggtgaaaaagacatgtagagaaagtcatcaatgccattcttttttttccccattcatgaaaatgattagattttcctttgagctgcctgtctgtctgcctagcacctcatatgtctatccaggactgggctgcctcagagaggataggtacacctaaagcaatgcaagaaaaaaagtggcggaaggataccatgggacaggcagagagaagaggtcagaatttagtgttgattcagttccgatatttccaccctcctttgagaagtttttcgaaattgttttgcctcctctgtgtaaagctcaatttttgaggccatctgtggtttatgggtaagcagcagaaatgtgtgtctctgggaaagtgatgaaaggctgcaacctttggagtgtaatatttaatagactaggaattacaagctgtttggctttataaaaacaaagctacaggcgctgcaggtatacgtatcctgtagagaacagacttttaatgggtgctgctcatgttggagatgctgaatggtatataatacacagaagagctgtccttaggaatttggtaaggcaaaaagcgctaaaaagttatttattaccttaaaataatatttcattggcctataaatcagtataattgaaagcacagcctgccagcattttcttttctttttttttgaaatggagttttcctcttgttgctcaggctggagtgcaatggcgcaatctcagctcaccacaacctctgcctccgggttcaagcgattctcctgcctcagccccccgagtagctgggattacaggcatgcaccaccacgccccgctaattttatatttttagtagagatggggtttctccatgttggtcaggctggtcttgaactcctgaccttaggtgatccgcccgcctcggccccccacaatgctgggattacaggcgtgagccaccgcgcccggccatcctgccagcgttttcttctgtgcacttgggatgggaatatagaaaattgtcttcctagatattggctttgccattcaaagtctctacagtcagtgtgtgaactgctgggagtgatgccagaatctttcacagatttcattcctgggagctcttctggcgtcagatgatcgcggtttcttttccttctgcaccacagcacatggaggaggcctctttctcacttgctccgttcctttgccattcatggaggcagtggcaccagtgagctcacggccaggccgcttttgccctttttctgactaagtcactatagatggactaaacagaatatatttacagttcgcccatttagaatcgataagggtgtgccccaggctccatcgtatattccattacatacagcctcaggcatccgtttcaattgtttgggagaggaagtgaattagcacaagtggaatatctacaggatgaaacgttgtcagtctgtgcgttcctccccaccccttcgttggctggaagagataacgcttgacacgtatggagcagacagggtaatgtcagcctcgtggccatggagaagcaggaagtcccttggttttgttcagtgtgatttgggcattgaatgagtagatcctgttttaagaatattactcattaatatgaaccatcattttgtaggtcttttagaagcaacattctctttagtgcagataatgcttatctgcattgagagaagttataataacctggagaatgagaaggaaatacacatgcgaaatggcccagccggtttctcctggcaacctctccagagcatgtcctaggctactcctccaggaaggctcctgctctgatttcctgtattccttcacgatttggagtagataactggccacttggcattcttattacaggggacttatgcgtgggattattggcttcccctgtggactgtgagttttctgagggtagagaacatggccttttgtctctggtgttggttggaattcagctaagtgcacggtaagccatgtttatttcgttgccttataaaggtacatatgcagaaattagaacagtgtttcagggctttggacccaaatccctgtctccacaaaacacattagctgttactttgggaaagtcacttgacttctgtgagatttagtttttctcatctgtaaaatggggatagtcatcacggctaattcataaggtggttgtgaggatgtctgtgatatgtataaagtgcttggcacagtactaggcacacagtaagtgcttgagaggtggacgctatttaacaagacagagcaggaacgggagagagagggagagcgacagtataacatgcttctgaatctgtgttcccgggtcctacctcttcattcattcctgccctggcctcccacaggcagagtgcgggtgagggctcacttctcctcagtttcatccttcctccctctcttctcctctgcctgtctctcctttggctcagcttgcctggtgggctcattctgccaagtttgcctttgcttgtctgttccatttttctaggtatccttgcctccttccgactggactcagtttatgtgccgagctctcttggtgagtccaccttattatgtgctcattagatgatgcttagggttcctaagaaacatattgactaggaatttagctgtgcatctgaaagttggctgctgaacgcagagcttcaagggatacccttttcaaagtccacaagacaccatgggaaagggagggaaaagcttcatgttaaggaggatctgttaagatgggaagagatgcatttaaggaagcagagacaactaaaagccgctctgtagccaggaggagttagctgctcagcaagaaggctgcttggaaatgctttgagggatatcatcctggtgttacagggaacctgagactatgtgagcacataaattcgtgtttttaatgcagtgtgcttcagttcctgaaaggtagattttctttttcttttgtgtgtgtgtgtgtgtgtgtgtgtgtgtgtgtgtgtctgtggtttgtttttttttctcccagatggagtctcactctgtcacccggcctggagtgcagtggcgcgatctcggctcactgcaacctccgcctcctggtttcaagcgattctcctgcctcaacctcccaagtagctgggattacaggagcctgccactacacccagctaattttttgtatttttagtagagatggggtttcaccatgctggccaggctggtctcaaactcctgaccttaggtgatccacccacctcggcctcccaaagtgctgggattgcaggtgtgagccaccacgcccggcctgattttatttttctagcttgctttttcaagagaaaccatcttttatttatttgtttgtttatttttttagagacaaggtcttgctatgttacccaggcacagtggtgtgatcatagctcactgcagccccaaattcctgggctcaagtgatcctctcacctcagcctcctgcatagctgggactataggcatgtgccaacacacctggcttaaaagccatcttaagtggccaaataagacactgggaatttgattagggatacaaataattgatttttttttttcatggatctttatggagaaaggagtctgagatgagtgtggacacctgagtccctgaccaagagaagccttgtgcagcatgtcagacagacagcagatcctgaagctccattcagttgtgacatgtaccaatttaagatgtgaaaatgagtgttttgccaagccagaactgtccgtgccaagaaaagcccattaggttggtggctgaaaggctggattgttaggatgtactgaatggtgaggccctgccagctgctgcgggtaaatgcccacttacatgtctaagtactcattctgttcccctggagtggggtccagtttgttcaagaaacatggctgctgtgtgagaggctgctttcttttttttgagacggagtcttgccctgtcgcccaggctggagtacagtggtgtaatctcggctcactgcaacctccgccttccaggttcaagagattctcctgcctcagagtaagtagctgggattacaggtgtgtgccaccatgcccagctaatttttgtatttttagtagacacagggtttcaccatgttgaccaggctggtctcgaactcctgacctcagaggctggtgatccacccacctcagcctcccaaagtgctgggattacagacatgagccaccatgcctggccgagaggctgctttcttttaaagaattatttcttgttctttgggcttgttgggtgggtatctttagtttgtaaaagtaacataacactgacaaaatctgaaaaggaaaatacttggaaattgggtctataaggtgaatttaggtaaaacatcaagagaactaacaaatagacaacaaataagctataaacaggtaccataaataggctgttaaacgaaactgtcatttgaaccgtaatatttgcccatcatttattcattcctcaagggctaattgaatatctgaatgatcttgctgcagtgttgggcagggccctctatctcagcaagcttctagtcatgtaggatagacagacttttgcacaaccaacagtattggaaagcctaaataggaagtgagatgaagcatggaaaaatgttttttggagttcagccaaggagagcgttttgacttggaggtttcattccttcattcagattcttgtggacgacgtaaaaatgtaagcaggtgggtgcaagtgtgggtatgtatgtatgtctctacccttgccttccttggagaaaactggaaataagacatgaaagaaatggggacaaggaaactaagatttgctaggaactctagaccagcagctggaggtaggtattgtaattcacatttgaaaaccgaggttcagaaagatgattggccttgaatagtgttttaaaatgctggaagcagtagttggactcccaagctgctaagccatgtctggaaattgggtggtgggtggtgcagctcattttgtgtcctgttctactgtcactgtcttggaagggaagtttaaagaagttttaaatgtctagcacagtgctggctcatacgatgtgttcaatgcctgtttttcgccttgcttcctctaaaccaggtgttctcaacctcggcattagtgacagcctgttctggatagttttctgttgtgggggctgtcttgtgcattgtattttaggataggatatttataataggatgtttagcagcatccatggactctacccactggatgccagtaacagccacctcctcacactctttatgacagccaaaaatgtctccagacattgctaaatgtgtgagggggcgcaaaattcccccaccctctgtagagaaccacaggactacaagatcaagagagatcagtcttgactgatgtgcttaggaggctagagctggtgtagggaaggaggagcctgcacctagtgggcaaagaaaacacccctgtggaatgagatgagagaagatattgaccttgggtgtccagagctggtgaggggagagaaaaggctgccagatggtctgagcgtgaggtctagggcagttgctgttgtactttgatttgtatggactgtcccaggagtgcgtagtttcctgtgtcccagaggtctgggctgagacagacaatgggtatgacctggagaacctgctggtgaggcttgtgggtgtcagagccctgttgaatcacttttccctctccattcaaatagccactgcaattccatacctatttgtataattactttcaaatgtcattctcttccttaagactggaagctcccatgatctaggtctgtgacttgttttctggttattgaattgagcacaagaaccagccccaaattgaacatttaagtgagtgacatgaatgaatgatggaaggagggttcgcattaattgttggattgaacaaagcccgacacgattaaatgtaacagatacaaagatgaagccagacaattaagttggagagaaaaagcaattgctcaaattcagcagcagggagacttgtcatgacagtgtccttttggagaagagtctgagagctttgataattacaaatgtctatggaacccatatcctcgtgactgcattaagaagaaaatacagcttttgtctataccatagaaattgaatgtctgcaatgggagttgctggtttctctgttttctctgtttttgctgaggtcattctgcatctgggacatgagagtgttctgttctgggagagacactgacaaacttgggggagtccaaagaaggcaaaagctggagaacccgagtatctcatgaataatgtattttacttagctatggagtcaagcaccatgtgcatctttttgtaaatattactgcatgtaattcctcaaactagcctcttatggggatcctctatttcagagcttggcagacattttatgtaaagatagtaaatatggtaagcttcgtgggccacatggtttctgttgcaacaactcaactctgttttaactcaaaagcagccacagacattatgtgtccaaaagggtgtggctgtgttctaataaaaacaggcaatggtctggatttaccctgtgggccatgatttgctaagccctgctctgttttattgatgaataaacaaaggcttaaagagattaaataatttaatatgctgaaatgagtaagtggcagaactgaaattgagctctgagcctctctggctctgaagcccatgaaaacacacatagatggtcttttggatggggataggcttgttttgggggcactgggggtcagtggtgggagccatgaggaggcagaggttggcttagtaggaagaactcagctgtccaatagcagagcagactgcaagtgaggtcacaagtggtggacactgcagtgtttgcactaaatacccacctggtggggatattgaggaaaagattgccgatttggggaggaaattgagctgatagcctctgaggatcccttccaactctgtggatctgtggtcatcaacaaaggggaccacgtgggtaacagcttccaccagggtgctcttgagcaggagctgcggggcaagtagctgccgttttcttcccattctcagagtccatcctgctgacctctcctgcccactcctaatgaccctttcctgcaggtcggtcttaccagcctccccccatttccctgcagtggtcagcgggtgcccttgcccccctttccctagctcccagctctcaccgcacactcagctgaatccccagggagaacacaaagcagagagttgtacagttatgggcttgtatcccagtcagcgcatccctgcctctgaagggatgcagatgaatgtggcctcttgctgttttatgccaacttggagttcactctctggctgtacttgccgccccccagcttctgcccttctccttggtgtggaagctgggattctgtctccagcattactccaatttttcccttgtgtctctactggattccagatcctcttgcacactgccagcgttgcagcatccatactgttggggctcaagagccagccaggtcatagctgtggtctaggccatatcgggttctcccagcgggcccgttctccctggggttaagtccagccgtggcaaacacggagtttctgccttgcctttcctactgagcaggcctcatgagtcatgagtcatggccccgcaacttcccattgctatctgaccttgcttccccctgctctgtcccaagggtgatatcctgcttgctgtcttggtgattgtttctaaactgcctaatagctgtgattttttttttcaggctgatttctaatttttcttcaatgtcaggtaactccttgtttcttattctcttaggcctctggtttctgcctttccagcaggctggatggtttagcatgctgcgtgtgtggccaggggcagcccacatggcttaattagctcttcagccccctggcaggaggtgtgaagaatgcttcctacagtatgtaggcaccctgcgattggggcattttcccatgtgctaggttcggtggattggagaagcttgaaggggtggatttggaggatattgtgcaaaaggaaggtgtggcagtcagggtgctggcagggaactgggcccttctgatggtccggatgtaggttatgggatggtcaggtacgtactatctggcagcagaaggggagcctgtaccatgcctagggctgcactggagtcatagaggggggtcaccagtacatgccacttcagggaagaaacatcacaacctctctcttcctgcccccatagtcccaccagtgcctctcattagccaaacctaacaggaaccacctgcagggagccacccagggtggtgcagtgtgtaggagagtgaagaatgcgattgggggcaggggaggacagacagatgggacagatggagaataaccaggaaggggcatccacttagtgggcaccgatagcaggcttgctacattactgctttcctccgggggtgcaggtggtcagtatctgcagaacccatctgctgggcctctcttcttctcggtggactgggtttataatccattttccctctgaaggcattcctgagactcaagcagtgtcctccttttgcaaactcctggggtaattcctcattgacacattcatccagcactgagactccccactgttctctcccccacctctctctctgtgtgcccatctttcctagattgtgagcccgtaaagtgtaatcattcttttgttccccacatcttgcaagacccttcagaaacacctattgtctgatgatcatttcattaactggtcagaattacaaaatcctgaactgaaggattgtagccatggttcctgtgagttttaaaggtaaactgaggaattgccgaaaagttccttaagatgcatagtgtgttgtgcacgttttcatccttggcataaccctgtgaggtgacagccccataaaagtgcaaagtgggtcccagatcactctctgctagctggggtagagtaagcttcagataaaatggctgtttcctttccatcccattgatgattttccccaaatctattggtacttattaccatgttagcttgtcccagtgtcatatttttagatttgaaagcagaatgggaaggtgagtctagtgggaataaaatgtggttgaccgcatttctactacacaagaggaaatgggcaccagtgatcatgggtgcctgggtcccaatctgccccatagcacgggtagtgggtttctgaaagaaagcagcacgcatctgtcgctgaacctgcgtttttacagcacagttgtttgccctggaatatttgccgtttatgttgttgttttttttttttttttttttttctgagatggagtctggctctatcacccaggctgaagtgcagtggcacaatcttggctcactgcaacctccacctcccgggttcaagcgattttcctgcctcagtctcccatgtagctgggattacaggcgtgccccaccacacccagctaatttttttttttttttttttttgtatttttagtagagatggagtttcgccatgttggccagggtagtcttgaactcctgacctctggtgatccacccacctcagcctcccaaagtgctgggattataggcgtgagccactgcacccagccatatttgccctttaaaagggaaaacctaaggaaactgatgttaaccctttgccatcgtcaatctcattgatgtcggccagtcaatcctgtcaaatcttgctctttttttaatgatgcttgaaaattggagcctcacaactgtttactaggtgggtctaggatggtaatttctggaaatgactgtagactatgccaaatgtctttttagcctgttatctgaccatgcccagatggcttaacttttctctagcagtgtcactttttccttatttctctgtatctgtggagtagcgtagaaccgtatgtacaaaggtttctgctgacatatcagtgtctacacagctatgtgggtatccatgttggtgcctgaagagtctggcccgcgcccagtatttggcagctgtaaaatgttagatgaacttccaccctcagtaaaatcagccaccccttcaaaagagtcacaggcatccatccagtaatatctttccaggaaaaaaaaaaaaaagatttacgtgtagtcaagaaaaagtagagatcgcaggaagcactgctctgagcagattagaacagaggatttcgcaagaggtgctccttggccaagtcgagtaagtaacatcggactgataggaggaagagcagcttagcttggggccctgtgcccagtcctgcttgtttaggcctttgtccctgtctgctttcctggggctggggctctgggcccggccgatgcccctggtcccaaccccagctttatcactgggttcagcaaggggccctggagagcaggcagcaatggcaggcacctcccgcatgcaccattaccttcattcctcttctcaggtttccacagttgcccctataaaaagactgctgttggcccatgccaagtactctggaatagacaggagtggtatttccgccctcttggagggttggtgtttaccagtgtcccccttcgctgcaacccaatggcaattgtattgccccggtgctccaggaatctgaggatgattggttgatttcctatgatttctgggagagtagtttacccaaaccttttatgaaccaaagccatactccctgggagtgtctggctgatcatgtcagagacatctgcctggtggattggggctgtcacgtgaccagtggcccgctctgtctgctgcccagtactgccaattggggagtgtccttctgcctttttctctgccctatgtctgggacacagggatggcagccaggcccaggagcacccagcatcctccaagcaatgaggtagcactgcttctgacttttcctcaggatctggtctttttccatgacaatgaggtggggcccaaccttctcgaaagtggcattgtttctgcacagttgtaactgctctcaggggtgtcagtgaagtaggggtgggagggaagccatgggatgctgagagaatagggccgagaggacatacctgctctccagcttggcctttgatccagacactagggacgaggctgtcactgtgggtgcctttgttagtgtttgtgtgtttgagtagtctgaaatgctgtgacttttttttgttgttgttaataaagataaggaaacaaacagaaaaaaggaaattggagcttccaaaaggaagaaggaagtcttaatatagaattgacttcttcccaggtaagttttaattgcttctcatgcttgtagaaaggtgtatcatgtgttctaataggttaggatttaattatggcttaaaattagttctataggaagagcttggagttgcacctagggagaagaagcagagggttccagaattgtgtaaacggattgatggaaaaataggcttctggtgctgagggttcaggagccttgccagcatcacaacaaggtgtgaattagcctcctcgcactctgggaggaagtggaggaactgctggggtgtgaggctgtgaaaggaccttggagagccaagtcctccctgttcagacagggacaggcacagctggagacagcagttttcagctctgtggaactcttgttctctgggttgcacttcttcctgtgataataaagaggttgaagacaggaagacaggtgcttgaaagccggaagacaaggggaaagttgtttgaagcaggtgtttaaaaatccgccactttggggggatgaattaggatatcggtaacaattttatagcctatatggtttctttttgaccctcgaagataggtgggaagtggttttctatacttcttttaaaaactgggaaaccagagcttaaagaagttaagcttgaggcagcagagttcaatgcactggtgaattgaaatgtttgtgtgtgtatacatacatacctgtgtgcgtacatacataggtatatatacatactcagtataaatatacatgcacatatatctatacatgtactgatacaaagggtatataatacaatttacaactaataacaaactatgtgcactctttattataaattccattcagccaatgtaggctcacagaatgcttttattgatttttactgtggccaacctatgactgacaatggtttgacagagttgcattccaattcactagttttttacctagtaaatttattaccattaaatctaatatgtgatctactgttagactatttctcaccttgtacaaattatgttccttaagctgagcttcattttggcttcagcactgctgattgcaatagtgctagctatgttttaagcttttggtgttgttgcaggggttgaagcattgttggattctgtatcacctaagggtgtctgtgtttagcaaccaggtcatgaaattcctgaaaaatgaacagttgtctcttgtgagccagcacaggcaggctggagcacatcactagctccattgtcaaggtctggaaaggcaggtgcttgtctgtcttattcagtctttagccccagacccagggaggtgctgaatgtatgattagagattcagtgaatattggtgagatggatgaatgaggtttcaaagctgggaccaggagccagtccatgggactccagttcttatcccatgaggacaaggtccagggtgggcattgaagaatcacaggaaaggaggggcaccagagaccgtctccactgtcagaactcagctgccatgtcctgccttccgctaggatgtcagcactggggcactgtggtacaaagaagaggagaaggatgacatctcatttagtgtactttttttccagctttatccaatcttttggcaattttattccccatcatttaggaaagagaagaccttcttatctagcagtttgatgacttatggtagttgctttggtttgaatatttatcccctcaaaactcatgttcaaacttaatctccagtatggcagtgttgagaggtgaggcttttaagaggtgattgggaaggcagagccttcatgaatggattaattcatacgtgggttagtggatgaaagggctaatggattaatgcgttatcgtgggagtgccactggtggctttataagaggaagagaggcccaagcatatttagtgagcattttcttgccctcttgccatgcgatgccctctgccacgttttgatgcagcaagaagatgctcaccaggtgccagcgccatgctcttagacttcccagcctccaggaccacgagctgaataaattgcttttatttataaattgcccattctgcaacagaaaatggactaagacagtagtcaccaacaatacttaactagaatggccagttatggagaacaagagttatattttttttctcagacaggtccctttacatcttttaaaatgaaatatgtaatacattcacacagttcgaaagtcaaagacagtatcttgccctccagtgactagttccttctagtgagtcttgagatcattccatatatattctatgtgtatttaagacaataaacataaattttttcatgtttttactgaaatcgtagcatgttatacacattgttctgcctttggcttttttgttttttcacctcatagcataacttgaaaatcattccattactacataggaagacatgcctttttcttctctatgatttactgtcatttatttaaccctttctgtctgtgaacttctaggattcttttctaatttttctattataagcaattctgcaatgattgctgatgtacaaaatgttgaagctatctgtaggtaaattcctagaagtggaattgctggatgaaagagaacatgcatctgtcattcttgtatgtgttaccaagttactcttcatagaccgtaagtcagttttcagcccaactacaagagaaagctggctggcttctttcgctgtctcacagctgcttgattcttgctactttgataagtgtagtttcatcaatttttaagtatgaataagtgtaagcatgttttcaagtatgtttaagaactatttgtctctgctttgaactttctattcatactctttgcccatttttctctacgtttgtagacttttattaatttgtaggagctctttatctattaaatagctttatgttcatgttatgatttgcacatcttttctctaggttgtcatttgtcttttggcattgtttctggtacttttctccccatgatttttttttgtgttgtgataaaatgtgaaacttgtcattttaactatttttaagtgcacattcagtggcgttaagtccattcacattggttgtgcagccatcaccactatccatctccagaagtctttcaccgtcccagacagctgtattttttaaaatagtcggatttatcaaattcgtttaatcttttatgggttttgtatcacagttagaaaggcccttaccgctctgagtttatttgttttgagacagggtctcattctgttgcccaggctggagtgcagtggcacaatcatggctcactgcagcctcgacctcctgggcttaaaagatctttccacctcagcctcctgagtagctgggaccatagacacgagccacaacacccaactgattttttaaaaatttattgtagagaagaggttttgccatgttgctgaggctggtctcaaactcttgggctccagcgatctgcctaccttgacctcccaaagtgttgggattacagatgtgagccaccgtgcccagcccactttaaattcatttttaaaatattctctcataatttcttctagtactttgatggcttattatgtatgtttaagtctgtgatttgcctggaatttattttcgtgtgaagtgtgaagtatggctccaggcgtagtttttccagagcccctcagttaccatttgctcatcaaaacatggtttgagggctggctggattcaaccagggagatttcctgcactgttggtagctgtagggaatcagcaaagctgctgtttccaggagctcttgtgagctggggagtgaagagcttcagaaatgaagcttgagctagactgatgaaatcccactctaggaaaatacaagccttacggtgtttatgtttgctatattcagaatcacaggcatgctagtgagtgcactgtctaaacatgttgaaagatggtctgcagtatctctactcagcgaggtggatgaaacaggtacagcccatgagaggcaagttagtgtcttggataaggcgttcctggtggatgagccatttgtgccccgatagaggttcttacagaggaggggctggagtccactgatgctctgggcctctccctgggggaaggggtgcctgtttctcttggcccaaaggccctgcacattccagcatgccctgaccttggaactgttcctcaggtctctgggcccactgcatctctcctcccacagctggacctgagagtcagggagcacctcttgtatgccagccatgctgggtctgggaccccctcaccctcagggccctcaggtggttccctcaggctgcagcggacatagagatcagttctgtgtgttccctaagctgacgtggaaagttgggaagcacacgcttgagcccttgaacttcctctttctcagagcctaacagtagagccggggtgggtttcttgccagaaccacctcctcgcagaatcccaggagacaccagccaggtcctttcacaccccaaacagtgtgaatgcgcatgtttacagcagcacaattcgcaattgcaaaaatgtggaaccaatccaaatgcccatcaatcaaaaagtggataaagaaactatggtatatatacatgatagaatactactcggccctaaaaaggaatgaattaatggcaattgcagtaaaccgatgagattggagacaatgattctaagtgaagtaactcaagaatggaaaactaaatattgtatgttctcactcataagagggagctaagctatgaggatgcaaaggcataagaatgacacaatagactttggggacttagagggaaagggtgggaagggggtgagaaataaaagactacaaatggggtgcattgtttactgctcgggtgatggatgcaccaaaatttcacagatccccactaaagaacttgctcatgtaactgaacaccacctgttccccaataacctatggagataaaaagattaaaaacagaaacaaaaaccgaacagtgtgaacagtgcaccctgaggtctccctggggtcccttgtacccctcaggagcctgtggatgaccctgtgcaaacagttgggtggaagactgtgtcttcctgtgtgtttggatgagtaccagaactttctgcgtctgtttttcaccctacccaatgcagtgcttacctaaaaaatgcgttgaatagagcttcttgcttttacctcgttgcactcctgagagcaagatgggtcaccagcagctgtactggagccacccgcgaaaattcggccagggttctcgctcttgttgcgtgtgttcaaacaaccggcacggtctgatccggaaatatggcctcaatatgtgccgccagtgtttccgtcagtacgcgaaggatatcggtttcattaagttggactaaatgatcttccttcaaaggattatccaaggcatatactcaatgaaaaaccatgatagttctttgtacataaaataaacatttgaaaaaacaacaacaaaaaatgcgttgaataaacgaaggccaaaatgtcagtttccaaaaagaacctgaggcggttctttggtcagagcagccctgttagggctgagggcctcggttccacctcctccatgttttcctctctcttcccactgtgagctctctcagacctggcactgtggccgctcccagctcctcgcacccagcatggggcaggtgctgaatgtctgaggagcttaatttcccctccctcttgccttctgcctggggtgagggctcagttgctctgaagctcatgaccaggcttaatagtcagttgagctataggcctgcagatcgagtatccctttaagtttgtttttaaaatattaaatttaccaagaaacagtaaatatttaaaatttttgttgggttttgctcttttactgatttctactagattttttggctccttttaaaggtataatttatatgctaggagtggtgtctcatgcctgtaatcctagcactttgggagactgaggcaagaggatcgcttacagccaggaattcagccccagcctgggcaatgtagcaagaccctgtctctacaattaaaaaaaaaaaaacagaaggaaaaaaggtatagtttgtgttcagtaacattcacaccttttaatatgcaattctgagttttaacaaatgcatagtcatggaactactactgcaatcaggacgtataatagttcataatcccctaaatttccatgtgtgtattagagttaatgctccccacctcccttcatctggcaaccactgtcagttttctgttcttgcagtgtctccttttcaagacagacacagaaatagaatcatggcatatataccttttaagtttggctagcatcacacatttgtaattcatccacattgctgtctacgttaatagttcatctcttttttattgctgagttttctgttgtatgaatatgctacagtctgttcactcaccaactgaatgacatttggatttttccaatgccttcctggtatctatttccctccattagtctatgggaagctttctagagaatcattgtgattctaaccaggtatatttggtattttttttgagggcaaaggtttttgggcagcgtcccccaagtcatcctgtataattgtgtactgagtggtcctttatggtgatgagatggtagtggtggtgtcgccgtgcccaagtctgattgacagctaaccattcagccatccttggttattctctcctctctctggtgaacaacataccttctttgatgttgatgccaattagacatgttataaggacttctctgaaaactcagaacccaaacataaccatccccatatgctgtttctacttcaaaaacagttggaggattgtaagacagaatttcttcccattagcagtgggggccaagaaggaaggggaagaaagaaccagttgcccagggcctttgactgtgaaagaggacacctgaaggtgaaggacccatgacattgttaattgtgattatttagctgatggaaacaaaattccataaacattctgtaagagcaaagcctggtgtagagattcattctgtctctttaggtgttggtctcccagtgactgtaaaaccacccaagggtggcattgaagacacttgcttttgcccttgacttatgtgctcttgagcattgtacgtccttgggctaatcgcttgccttcagatcttctgcgctaggttgaggggcttggaggagatgggcctcttggctctctgacactgaatccttcctctcaggcccagtagtctttgcggcctgttgggtctgcaagtctagaaacagcaactccatgccacgggaacgtttctgcttccattgttactcaccggccttacacggatgaccatgcgctgtacagggaatgccagggctggccaagctggctccagcagagcacaaaatagagcttgctcctgctgaggtgaggtccgttcctggaattagatgctctctgcatctaggtctatcaggaaggtgagctggcaaaagatccctaaagcctttaaacatcacttaaataggtgtgtgtgcaaaattgtcttccattaacaaatatgtcaaaacacaagcctaatgttttctttggacagtttccaaacactgagcttctttctgaactgttactggccggattattgggactattcccaggtgtttatttcacatcctcctctttttgcaagtgacatttaaaatacttcttcgaagcacacacattaagccaggagaaaaatcctaggatgggaagcaatcttatggctgagaccttgtctgcgaacaattgtttgctgaccaaaatgccgaagtcattaatcctcctttctactgactttgaaatggaaaattaaatttcagaaaccttttgattgcacacatgcatcccacaatgtttcatacaccaatacatatataggtagtttgaattctgtgcaccaagccacttgcactgacactgatactaatgtactgtgagagagcagcatactttaaacacttgccgatgtgaatcagacttgagagaacttgagcgtgcgtaagcaccttgatgtcttatccatttggaagcttattgttacagtgcgttttcttttctttctttctttttttttttttttgagacaaaatttctctcttgttgcccaggctggagtgcaatggtgatgtctcagctcactgcaacctccacctcctgggttcaagcgattctcctgcctcagccttccgagtagctgggattacaggtgtgcatcaccactcccagctaattgttgtatttttagtagagatggggtttcgccacgttggccaggctggtctcgagctcctgacctcaggtgatccacccgcctcggcctcccaaagtgctgggattacaggcgtgagccaccacgcccggcctaccatgcaccttttctaatccctcttcctggaatgctcttgctccagagagccacaaagctaactttcatctcctgcagcgtttgttcagatgtcactttctcagtgaagccaaactgaccttcctataaaaatcacctccgactcctgagctcaggcctgggcaacatggtggaaccccatgtctactaaaaatacaaaaaaactagccgggtgtggcggtgtgcacctgtactcccagctactcgggaggctgaggcaggagaatttcttgaacccaggaggcggaggttgcagtgaaccgagatcgcgccactgcactccagcctgggtgacagagcaagactccatctcaaaaaaaaaaaaaaaaaaaatcacctccaacctcacaccataccccattttctgccgcactatataccctggtatatgaccttccagggacattcaactggtaagggaagaatgcttcaagggagccatgtgtatgactccagtaaacacactgtgtgtgctcacctcccaggtgctggcaggctactaagcatgcagacagccaccccatgggaagaatcaggggagaaggggcacaagaccccagaagtctgacaacatgtaaaaccccaagtcaaaatgttaaaccgcgtacttgatctctcaagtcgcctcctgggccctcttccaagtgtactttacttcctttcatttctgctctagcgcttttcaataagctttcactcctgctctaaaacttgcctcagtctcttctgccttaggcccccttggtcgaattctttcttttgaggagaaaagaattgaggttgctgcagacccatacagattcgcttccagtaacactagtacctagtagtttctaaggtatttctaacgtgatcttactaatttatcttttaaattaaaaattaagggtatcatttattctgtgactctttgaggagatttggtgtctgttttatcctgagcatctacaacagtgcctgacacatagtagatgctcagtaaaaagttatggagtgtataccacatgctctgggggatatatggcacagtctttggattatcagtttgtgtttatttcttggctgcaaaggtggagggaaggcccaggttgcacaggaggggacagagctttaacagtacgtggaatgcagtggacgtgcctttatctgcaaggacccttgactgcattgaggctgcctggagcaaagaagccaccagacccaaggggctcaggctaggctgggagaatgccaggaggcgagtccctgtcacctgcccctagaacaggtcagacctgttctgttgttctgtggtcatctgctctaaatttcctcctactcacctctgggcctttaaatttgggattcataagaatgcttggtgcagaggaggagctgatgcctccctaacttccctaatgccgcccgcccaagcttctcagaacccctgcttcctcattaagataatgagaacttccttagatatctgtgcagacgaaatgagagaatgtgcctaagtcctcaacgcagtcctgtttttattatttaggctttccccctctgggatttggaatggaaaaagcacagcctaatcttgcccctctcttttccccagtgagaacttatatggttcccattatgttctattgttattattccactattttccagaatgtgaggaataagctgaccctgagcctgccactttgatttggtcgtcagaagtcctggggaagcagttgagagatcttgtaacttttagtattaatctcaaagacactgcctaaccaacacaggctgtattaccagttcctacatctagccctctgtagggtagcttgattttaaatgtgcaagttaatttcaagtctgttttgtaaggggaatttatattaagcacattaacaacctcagtgtctccaagggtcaaatcttatgtctactttccttaacccgttttgaaattggaagaggaagttaatatgcagtcccatgcactcccttttagatttaataatggatgaaaagttcttttatccactgtacttcttcagaaatttcagaataatttctttctgtttgaagaatatgaagttagttctttaaaaagagagacatgctatttaatttttaaaccccaccatctagggaattctgacattatgggacagactgagccgatttccctttgtgacattggggtttcatgtgctggagccacatgagggatgcacagaggggagccttcttgtcgcaggtgggaacaaacatccaaagaaacccccaagggcccctttgaaggtcatcctcactggaacaaaggtagtcactggggccagaccagtgacctctccatattcatgcaggtctcttcttcaaagattttaagtaacttcctttcccagggggatggagcagctgtgagccgagcattagcgccaggccttttaaaaacagaccagtgaattcaggaaatgcttaccctttggatagtcaagtggaagcatggatatattttaaagtatctatctaattccttctctggagtgagaaggggttagggggagagatctaggtcaaaaatattatttaaggataaaatgctctgatcattgcattgttgcacgcagtgggctcagcaagcttttcgtttccactgcagtgtgggtcatagcttgtgcgtgagtcccctctgactagagggctggtctatccatacccgatgttcactgccagtagctggctggagttcattactggtgccaccagcctcaggcctggtcgttcaaagaagaaacaatatttgaaaatggacgtgatttttcccttggggctttcctgtgttttcttcatagagtatactttgtaatttggggaaccagaataaatagaaagaagaatagttaggacagtgagtccatctgaagcctttgtaggtggtgaagggagaagttgggggtaagagggcattcactgcacagcaaagactggcgtgtctcagactggtgcaaacctgtgctgcaatattgacctgaggatgagtagaaaaaggcagaggagctgtcacttcagtgtaatgttgagaaaaaacagtcctctccccagtgtagggcattgaactgtcacaaccagaattatgcccaggatttcatacaggtgctgtctattgtacatagcttaaaaagctggttgcctgaaagttcaattattgtgtcttattgtttcctgtgaacataaaggaatgtccacagaatattagagaatattggaatgcaggaagagaggcaagtctgagaggtggggatgagttcagagaaatccccaggggcctccttattgtgcagtagttttccctccatgtgccccctgggctgatattaatgtgttctaggaaatgcttaatgcttatgggcctgactcttggttttgccttttaagaggcatcatcattactaacaaacacgttcctgaacaggccttagtgctaagctaggctcgatctcttctttctggccaaattgggattaatgccactctttgatttcctcatgttggcaatcacacagtgccatgattaactggtgccacacattgccaaggccctatggtttacttcaagggtcagtaaactgtaactccaaggccaaatctggcccactgtgtttttatagagtccttctgctaagaattgtttttacatttttaaatgattggaaaagatttttaaaaagaacagtattttgtgccacatgaaaatgatatgagattcagattttagtattcataaataaagttttactggaacacacccatgcccatttgtttggtctctggttgcttttgcacagcaatggcagagttgagtcatggtgacagagaccatgtggccctcaaacctgagaatatttatcctctaaccttttgcagaaagtttgctgacccctggtttatatcattagggtaggcatgttgtgcctttatcctatgttttttaagaaaattctaaaatctaaaatgtattcatttcatgtatattataatgtgaaattcttattttgatagcatttttataccccctatgcaaaactgaaaatgctagacaatgaaagaaatgtgtaaactgttgaatacaaggagccaggcattcataatagagccagctgatgctttgagagaagaaaaaacctcatgtctcctcttctcacctctccctcttttcttccaacattttattacgaaaatttttaaatatacagagaagttggtagaactgtacagggaacgccaatttgccctccacccagagtctgtaattactaacattttgccacatttcctttatcgcctctctgtacaatcatctgtccatctcagtttttatgtatttcagaataagttacagatgttagtacatttcaacaataggttacttttatttccactgttaattaggcttagtctgaagggtgtggaatattttcatttcctgaatggaataaaaggtgggagttaaaagcagatgggaacaagcagaatgatataatgtaattaaggcctggcttaaaaaaatatgtgtgcctgtgtatgcacacacacacattgtaaattttgtgtacatgcacataaaatatatatacacatgcgtgtgtgtggatatgtatgcatatctatatgtaaaaataaaagaatgaaattgtccataaagtaatgcaggctttgagaaactgttgggagaactacatttaccagtgcttaggcaccagaccagtattgtgaaagtaaagatgctgaagtctttgacacctttaacttttgcaacacatttatgttctctcagaccgcatccaggggcaggagaaggagtgttcatgtgttcacaggcagcatcagccaggtgcacaggtccaagacctcaggccaactcaggctggaaggcacctgctcctgtggggtgctagccaccactggggagcagagatgagcagagaaggctcctggagctttgaaagacgtaggcaacctgctacctgaaggaccagtgaggaaccttttgacagtcaaagaaattttttatgataggaacaatttctaattggtccatgtgtgcactccttttcttttcctgctctgccctgccctttttgagatggagtctcactctgtcacccaggctggagtgcagtggcgtgatctgggctcactgcaacctccgcctctctggcttaagcgattctcctgcctcagccttccgaatatctgggattacaggcatatgcctccatgcccggctaatttttgtattttgagttgagacggggtttcgccatgttggccaggctggtctcaaacccctgacctcaggtgatccgcccaccatggcctcccagagtgctaggattacaggtgtgagccactgcacctggccgagtccactcattttctaacagcagttctcaggttcctgtcctttaggcccatttagttatacatttgcataatgctttgcaattttaaaaacacttttcttagactgtgatcctgtgggaattattattccaatttcttgcgatttttttttttttaattttgcaagctgccatgaattcttaggaaaaaatgcatggtaaacattaggcatacttttcaatatatgtgcaatgtgcgatatgccacacatatggccaaaatgcagttggctcattttgacagtttttttttttgtttttttttttaacgctgccatgctgttccaattggtttggcttgacagttttgaaattgacaatttctgcctctcccaatcattgctctcaagggcaggggtaccacactggacatttcattggatcttcgaaggccctacatacaatgctgattcccaggcagatacttcatagatgtttactttccattgagtttattttgagttattagtaggatgccttagttgggattccatttccaacctgaggatcagcaaaaatcattttatgcatctgcagtgttcttgttaggtaagcactgttgggacaggtagagtgaatggtttaaatgctttcctgttagatacccttatttttaaagtgtgaggtgtcctttcttgatttcttttcttttttttttttgatacggagtctcgctctgtcacccagactggagtgtagtggcgcgatctgggctcactgcaacctccgcctcccaggttcaagcaattctcctgcctcagcctcccaagtagctgtgattataggcacgtgccaccacgcctggctaacttttgtatttttagtagagatggggttttgccatgttggccaggctggtctcgaactcctgacctcaggtgatctgcctgcctcggcctcctaaagtgctgggattacagggatgagccaccccgtccgattcttgatttattttctgtaattgatttgatgtgtgcaaatgtgtttatcaataggaagagcactttctggaaggcattattcagaagattaaaggagaaatcctcaccatcagttcttagtttcttgaagcccgtggtggaaatggatacacagatgacacagagaccatccatttttctgttttctgtgtgtttctagccccaggcaaatcctgccaagctctgtctattttaatggcccctgtttctggtgtcacctctggcttgagaactgcatttccattagcccccctttcgttctctttaaggatggggggattactgttctccaggcatcatcaagcagaaaatcagcacagagatgcttatgagcatgctctatcacactagtgttttttagatttattttagtgtttaattctagtattttatgggaaactagtctgtcttttgatattgaattacataaaaattataagccctgctaagctttgagtgtgattaaaaaacagctgaacatttgaaacttggtctgtatgggatcctaatttggggttctcatgtgtgaaggtctcctttgatatcaaatatataatgttcctttaatgtaatactgtctataaatgtgatttttttttctccaagaaagtttagtctctgccctacttaacctaaatatatagcccaccagtattttatttctctttatcataggaacataattcaagatctcttagattatggtgattcataaactttctaaataaattctttgcaaaatcattagataaatatatattattttaaataaagtaggcaacggtatagtaatatccttcccccaagacacagagttaaggcaacttaatatgtttgtatgtaagaggggaaaaaaaggtgacacagatgtaaaccggaaggcccaaggttcttatctttgggcagaggattacatctgggtgctttttattttccatttgctcatcggttttctgaaatttccacagcagactgttaccttggtagtgagaaacaaaatgatacttgatttttcaaagagggtcatttatacctgtccccagcctcttccgcctcccaagtgaaatggggcttgccagctgattcatttatgttctttcttgttttctaagttagtatattgctcaaaacagcccttgcgagctctaggagctcaggagcagtttggtgtcctcaaagcagccccttccctaaagctacagcctctgggttaaggacatgtagcagaggtactagtgtgagatgtctgggttttctggtttgttcttggacccacaaagcgcagagagctcccaaacatgttctcaggatgggcgagggtagaaggtgtaagtcttggtgcctatctgcaagtgaaggtgtttttaagacaccatgtgcgtgagcatgtgacccatgtggtttatgatgctgactttttcctctggggaaatgcgaaatacttaaagctcttatctgtctgtactgattttgaaagccaagagcctaagattttgacaattagttaaaaaaaaaaatctgcaagtcatgtgggaattgtaaaaatcttatggggaataataattttaacttaaccaataaataacacaataaaaattaaagcacttaaaatactgatttaagtgctttatttgttattgcataaataaataaatcagggagctgatttaccccaccacccctacccatgtcagactcaaattttactaggattatcttgtttcttttgcgtatttatagctacttttcctatgttatttgcctttagggcaaattatattctctttgagaatattttattcttatttaaattctttattgtcttgaataggcacagtaacaataaatttattcaaaattcaacaatggggaagaactttaattaacctgattattttatatttttctagtggagtagtggtgttagttctaccatcagagcagtaatagttgttttagattaaattttaccttgaaaaagttgatattggagacatgaagttttcttttttttttttttcttgagatggagtctcacacagtcacccagtctggagtgcgatggcccaatcttggctcactgcagctctgcctcctgggttcaagcgattctccttcctcagcctcccaagtagctgggattacaggcgcctgccaccacgcctggctaattttttgtatttttagtagagccagggtttcactatgttggccaggcttgtctcgaactcctgccctcgttatcctcctgccttggcctcccaaagtgctgggattacaggcgtgagccaccgcatccagcccctatgaggttttcatgtgttttggaggccctctgtagtgcatcagtatcccccatcacatagtgtgtacgcagtcagccagctctgcttgatgggctgggtgtatggggagatgtttctgggtatggtgtggggttttgtgtgtggtgtgttgtgaatgtggtatgtgtatgtatacttgtgtattttgtatgtgtagtttggatgagatgtgcatgtgtgtagtatgtgacatacatggtgtatgtgtgtgtatgtggaatatggtgtgcatgtctggagtatctggcatgtgtgtagatgtgtagtgtgtgcggcatacatggtaagtagatatatgtatgtggcatatatgatatgatctgtgtgtgcgcgttagtgtgtctgcaggagcattcgagaatgccagcgaggatgcatttcctatcatctgttcttaatggagaaggatttctggaagcagcagatggtgtgaagtgtgcagctgtgaagttagaagaaaatcttggtaaggaccagattggttctgggcaggaaggagtatcctcataaaatcaagcccctaaagctataaacatcagatagcagggcccgaggcaagcgggggtttgagaggagtcacaatgtgctctcatttacaaaagtagtggctgccagctttttatccaaaatcccttaggaattacagttgttttacgggcccaaaatgctttgtaactcagcagatggcttgaagacttcagtatcttcccatttttactttaaggtcaaaaggattctaattaaagttaaagctacaatctcaatgtcattgtttaaatgaattcaccaagacaatagttgtggaatcttttcagaggaaatttaagatgttaatttcccactgaagtatagtctaataattgagctaaataatggcactaaagaatgacttgggggtttgccctcttggagtccatttattcttaaagaaagatttttccctttaattatcaaactaataatggccattggaggtggggaactgggaagaaaaaaaatcaccaaaaattccactcccaaagaaaatcattgtaaatattcagtcatttcccaagcatatctgtagatgtccgagtgtgtgtagatgtctattttggtttattttgcagatctgtgctcatgttatatacataaaagctatatccttccattcgccttaagattctattattttctcactttgaaaggcctttaactgaagtccactgaaatcttcaacaacacggttcatttgtctttgagacgggttgttagaacaaaaatttgaacagttcttttaaaatactgaaataagtgagacccagtattgatgggaatgactttctgcccagctgttttcttgttggctgattccataggaattgcccgcatatgaaaaagaaaattgtaacagattaaaaaacaaaacctcatctgcttgacattaaatgttacttgtaacttaaaaaattaaattacaaaaccataatgaattattaagctttataaactattggcttttaaaaaatttattgagttttaaaaattaagtgtttttgtgtcattggctgtgatgaatctttgtgtttgttagacagtaagtttatttggatgctaagagatctgctaaacagccccactggattttatatatttaaaatatatcttaaaatattttatttatatttaaacatatatagtttaaaatataaaattaaattaaaactaatttaagattaattttattgctaacatacaaagagttttcataaaagcctacatatataaaaatatatgtactacatatattatgtataaacatatggatgctacatatatcttatatacgtagactttatgaaaactctttgtatgttagcttaaattaagtcttctgaaagtgataagaattgtattatattaaagcaattactgaagtttaatatgtacggatgtgtagtttaagacatgggttttatgtgattgtgaaagctaagtacggtagtcctctcttatccttggtgtcgctttctgagcttaaagttacccacatttaacctcgatatgaaaatgttaaatggaaaatttcagaaatacacaatttataagttttaaatttctcactttttttttttttttttgagacagagtctcgctctgtcacccaggctggagtacagtggtatgatctcggctcactgcaacctctgccttccgagttcaagtgattctcctgcctcagctgggattacgggtgcctgccaccacatctggctaatttttgtgtttttagtagagacggggtttaaccgtgttggccaggctggtcttgaactcctgacctcaggtgatctgcccacctcggtctcccaaagtgctgagattacaggcataagccactgggcccagccaaatttcacacctttctgaggagagcaatgaaatctcctgttgtctcataccatccgagagtagaagcatcctttgtccagctattcacgatgtctgtctacattcgctgactgtctgcactccctgcctgttagccactcaggagccctctgcgtatcaataattgtcgtagtctagtagtgcttgtgttcaaggagcccttattttacttcttaatgaccccaaagcccgagagtagtgatgccggcaattcggatgtgccaaaaagaagccgtcaagtgcttcctttaagtgagaaggtggaagttctcgacttaaggaaagaaaaaaaattatttactaaggttgcgaagatatgtggtagaagatattttgagagagagagagagaccacattcacatgacttttattacagtatattgttataattgttgtatttattgctaattattgttgttaatctcttttttttttttttttttttttttgagacagagtctcgttctgtcatccaggctggaatacagtggcaccatctcagttcactgcagcctctgcctcccgcgcccaagtgattctcctgcctcagccccctgagtagctgggattacgggcctgtgccaccatgcctggctaatttttgttatttttagtagagatgccgttttgccatgttggccaggctggtctcgaactcccaacctcaggtaatcctctcgcctcagcctcccaaagtgctgaggttaccggcatgagccgccgtgcctggcctgttgttaatctcttaccatgtctaatttataaattaaacttcatcacaggtctgtatatataggaagaaacgtagtagatacagtgttcagtactttccatggtttgacgcatccactaggggttttggaatggatcccctgtgagtaaaggggaactacgaggtaaccttttcctgaaagctgtgaaatcagtctgccaagataaataattataactgataataggcttatcagtgtgaccacagtaaataattccattattatatacatcataccacagcgtagttgctcacttacctgtctcttaagggaacctgcatctaattatcttttaacttttagggctgacatatacttgacctataattgttgaattagccaactcacaccaaactgttttctctttccccgagttcatctggactgtgacataccacagaaatgtgttctgagtttttcttaccaatctaagcctcacacaggaatgaaagtaatttgaaataattatcaggaacattattgtactttatcacatttttatgaaaatacttcagattcctcaaacagtaatattattgattctgtacacattatcaaaaccattcttagaaaatacaaaattgcaacattcaatagaacatctttttagtaaacattggatattggttcctacttttattccactggtgggaaaggcttatgtgttcctatgtagtttatgtccaaaccgactgtaagtggttcttctgtcagcactttaaagaatgatggagggcctggcatggcggctcacacctgtaacaccagcactttgggaggccaaggcgggcagatcccttgagaccaggagtttgagaccagcctcgccaacatgatgaaaccctgtctctactgaaaatacaaaaaattagctggatgtggtggtgtgtgcctgtaatcccagttgttcggtaggctgaggcatgagaattgcttgaaccagggaggcaaagattgcggtgagtggagatggtgccattccactccagcttgggcaacagagcaagactctgtctggaaaaaaaaaaaaaaaaaagatggagaaagactttataggctgttgtagtttagactctgtccaactagaagcatcatgtggctttcagagaaaaacactctagtcaaccaatggagaaatgcagaggaggaaatgtgagacttattttcaaactgaagacaacaattaagaagaggtagaacttctcaaagatacgttttcatgaaccactatttatgtattatatagcaacagatattatggtgacttgtacagccattaccattacccaatgtgatgcatgttttcctgttctgtgtctatcacatgtctatataggccatgcctatttatgtttttcctgtttgtttgggtctcagatcagtgagtgcctttgttcatcttgaaaatggtattgatagcaacacagaatcaaaatacagttttcaagaaatagaaatcctcagattgttttagaccctgaatttaatgacagcagcaggaattataaaccctcggttctgatgagaaaaagtcagggacttatttagataaaaatagcttacagggtttttcctaagggtcagcaaagtttcctactcatctgtacctttaggacttcataatgatttagctcaatttaatcccagattagcagtgaaagattaatactgagttttctaaggtgggaaattccgtatgaacaataataggtaacatttcctgagtactgaagacaggtcagacagtgtcagtgtttagcactgcttcttatagatcatctctgaatcatcacaacatccctaagaggctgatgccatcatgcccattttacagatgaggaaattgagggatttgctgacagtgacacagagtaaggaataaagtcatgctgtgagccaggcatccctgaccctgtggtcagcatttcagtgtgacactgtaaccagcatgcacatcattccttaccttaccagagctgtcctgtgccatagggattctggctcgcttttcctatgtatggtctctgctttgtaagagaaatcagtatttaccaagtacctatggtactggttggcttacactcagtgacttccggaaggctcaccaaaccctctgaggtaggaaagatcattcccattttaaggatgaagaagctgtggctgagtggctcagttacctaaagacaaacggccagtgagaaggggaaactcaagtctgtctgagtccgagattaatgcctttgccattgcccagagatctgtctggctttggagtcaatatggaacccctcactgggccttcagcaatgggatgcccacatgcatgcctcacactccccaggacagagttcatggacatgcatgaaatggcatcacgatcataaatagatgttctggtaacttggctcataggtagcatgtctttttaccattaattagcgtactatagactgcatgggtgacattagaaaacaaatttttattgcttttgcaatgaagtttggggacattttataagaattattttaataagtagggatttaaaatatgggacatgttgtatagagcaagttagagaatgttaaaataaaagaacatataaaaatgctacttaaagtttcacatttatgtgcaaaacaacatgtaattcttggtcggggctgtgatagttctgcttaagaatgtctaaaacagatgatctgataagaaaattgctcttaccacagtagaggagaaaaggcaagaaggagaccttcacacaaaaacaaaattataatagcctccttaatgggcctatgtctgagtttcagtgcttatcacttacaaatgaacacttttcatagacataatttccattgcctaataatagttgaatatgactatgaatcattttgagtgcagtttctttaaaatacattgttaataaatgttctctgaagaggtagataggtggattcttatgtagttagtaaaaacaacacaatcagccaaaatgactcaggattattttttcatttcatggaaccttctgcaaattaatatttgtccttatctgaggtttttctaaatagttgctttattaagcattgcattgtttggcagtacagtttgtgagctggataaggtaataaaaacttgggaaaaatgtaaaagactcactttttaaatatctacattaaatgcattatctttgctatgtttgagtgatctcttatggttctgtaagatggaccattttgttgcatcctcaaaaagtgtaagagaagagggttttgttttttcttttttgtttttgtagtcttgtgtgtttggattttgtttattatagtattatgctatagttttaaggattgaggactcagaagatttcatgtggccttaattagcagtctgtcatatttaaaaacaaacatgttgaaataataaaggtagaaattgtaaatatataatcctctggaaggcagggattcaatctatgaaattatttcagttaacgtttcagaagaggaacacacatgaataagtatataaatatgttagcttaactttaacaaattatacaagcaacataattcattatctaaattttagaaaaatgagaaatcacccatcactgcactaactcaaatctctgtcatgagttttagttaataagtgttttctgacaatgacaaattttcatacatgaataagtatataaatatgttagcttaacttttacaaattgtacaagcaacataattcattatctaaattttagaaacatgagaaaaatcacccataactccactcactcaaatctctgtcatgagtttcagttaataaatgctttttgacaatgacaaattttcatttttagatattgcatggatgaacagggaaaaatgttatagatatggtgaagaatatatagtacatgagaatatatgtgagtgtgtatgtgtgtatgcatgcatacatacacacttgtgtacattaatgtatgtacacgtaaatatgcatataagtatacacatacaccagaaaatttttctaatgttccttgcaaacacaatatgcagctttctgaaaattattatttttgtgatatttttagtggctgtaacatttatttttggtagctggctttgggtggtccctacagtcctttttctcgggctcttactggtgagatggattatgcatgtaagacttcaaactgggaacaagggacagctggaaaacgatcattttaaaaggcatgtttaagacggacataaagctaattttcctacgagtacccaaaatgcaggaagaaagacattttgctagaggatgaaattgaacagtgaagattttaatttggtcccattccctaccccagcaaggtgaggtagggacacagctctgcttccatgcacctttgcagcccagtccccaccctctcacagacaaggccactctggacctgaggacaggcccatcttcagtactgttggtggttgtccccacacaatctaggttactttcggaatttgatggatggcttttcaaatttgccttcctatctggaagattatcatcagctatccctgcactttgcagcaagtacaaaactcctgaagagcagaggctgtcagaccagctgccaaagtgcttaacaccttttattcagaaaatctgaggcctccacttgactgatctccccaattctccttgcaaaccaggctcccgggtgcagggttaggaagtgcgtaatgagctttagaaagggttcctgaaccaacagctaaactgttgttaatctcagctctggcagttacttgggatgaagagatcgtaatggctgctttaattaaaatacacataatactagaggatcagtagaccacaagcaagaactctaagtaattcattagtttcaattttaggcgaacatggaaggtactagaagaaaataggcaaactagacagacatcagtcagaatgcttaggcttgcctcggctggtgagcctcggtgaggcatttcagctttaaaaaaaatttttttttgagatggagttttgctcttgtcacccaggctggagtgcaatagcgggatcttggctcactgcaacctctgcctcccgggttccagcgattctcctgtccagcctcccaagtagctgggattacaggcatgcaccaccacacctggctaattttgtatttttagtagagaaggggtttcaccatgttggtcaggctggtctcgaactcctgacctcaggtgatccacccgcctcagcctcccaaagtgctgggattacaggtgtgagccaccacacctggccacatttcagccttaaaataaaggggttcatctgattgtctcatcagttccataagatgctatatttcagtgattgctcatgattctgtaagaccattttgttgcatcctcagaaagtgtaaaagaagagggtttgttttttgtttttgtttttgcagtacagattctcagtacttcccatagcatagagggttgagtcatagagtccagccagctccttggctgggaagttgattttcagttaaataaacttgagctttcctgtggtgagattgggtggtggtggagcaaaaccattttaaaatgtaggttttattcagatatggtgaagcttacagatctgggagatgaccgtcaatgaaaagatctcacagttcccaagaggaggagcatcccatgtgatgcaaggccccaagaagcagcagggtccgtcaggaggcagtgggagtgaggggaaaacgagagcaagagcctctactgtggtttctgcagaaaggaatggacaggatttagggctggctagtttggggaatttcagcaggctctgggaggtagatactgtccctggttgcctggcatctgacccttggttggttaaggcagaattgtggcccataggaggtaggggtgggtggtctgagctctgaattggttgggtctgcataggaaagatgggcaggtgagtttacagtttctaggaatccactagttctgggaggggcagtgcctccagggtcaacaaggcctcaatgctaaagcatcaaacatgcagaaaacagagatgtgggatcaatccagagacagcatgttggctttgggtgacaagacgaatgagcctttctctgtctttccccatcctctctctacccagctctcttttctctcttgtattccgttctccctcctttccatctcatctctttgttttccctacctgttcttttaacagaggactccgatgacgttagaagaggctgcactgcctagagcaatctgcattccatattagctttataaagaaaaaaaaaatcagcctggtacagtgactcatgcctgtagtcccagcactttgggaggctgaggtgggtggatctcttgagttcaggagttcaaaatctgcctgggccatatggcaaaaccccgtctctacaaaatacacaaaaattagccgggtgtgttggcatgcgcctatagtcccagctgctcaggaggctgaggtgggaggatgctttaagcctgggaggcggaggttgcagtgagccaagagcagaccactgcaccccagcctgggtgacagagccagaccctgtcccaaaaaacaaaaaaattgtagaaggctttgaaaacccaacatagtagtaataataataatttgatataaaaataatcaataaaatcctgatgttgtattaatgatgatgatgatgatgatgccaagaactccactgttgtcttcacaaacctgttactggcttccagagaaaagatgcatttccttctctagatcaacacggttcaaaagacctttgcacagtggtggacatgttctgtatctgtgctgaacagtacagtagcccctacctacatgtagctactgagcactcagatagtaagactgaggaactgcatttttaatttttgtggactttagttaatttaagactaatttaaatagctacatgtattaggattctccggagaaacagaaccataagtgtgtgtggagagagagagagtgtgtgtgtgtgtgtgtgtgtgtgtgcgtgtgtgtagaggaggggattgattttaaggaattggcttctgtgattgtggagggtggcaagtccagaatttgctggggtagtcggggcaggggtgggggtgcagggtggagatcggggaggagttgaggcctcatctggactctgaaggccatctgctggcagaattccctctgcaggccttccactgataggatgatcccacccacccctattagggagagtggttggctttactcagagtctgctgatttagatgttaatctcctggtaaatgcaccttcacggaaacatctagaataatgtttggccacatatctgtgtccagggcccagtcaggttgacacataaagtgagtcacctacctcacccagctggtggcggaagtgctgagaagcacaggtctggattcattcggcatgtacagggccgggcattattctaagcacttcactggggcttctgtcagatgaacactgttatgctaacttctctaggcagcaataatgcagcacaaagagtaaggcttgcctgaggtcacacagccagcaaatcaggattcactctccagcttggtggcagaggctgtgtgcttcaccattacctttcgcaaggcccccttggcttggaggggcaaagctgtttcctaaacatcaatctttttttctcaccaggaccaaagtcagaaggcctgcgttagacccctggttttccccctaaatagctatgtgacgtggaacactgaacctcagtatcaccatctgtaaaatgggaatgatgattctctcctatattttctctctctctttttcaccactttgtggactacatttctcctgttcctgggtctgttctcttgcaacatataagtttggtaaggtagtcaatagaaaacatttggttactgaaaagtggaattgattgatactcttttctttgagctaatgctgaaacactggattccccaacaacaactaaattttgtgttcagagtttcttccctcactcaaagaggaaagcatggcactgttattattttgtatcttttctttgggataaccatttctgaaccagtgttgcatggatttggctgctgtcttgggaacacagtactgatgttgctcctggtgagcgtgcactgaagatttgcgctgcactgtacctgaggttctcagccgagtcttcctgtgtatgtttgaagatctggttctgttttgtggggctatggacaaaatccaccctccacagtaggttgtaaagaatgcatccttttggtaattcaccacccactgagtggatttcattcctttttttttttttttttttttttttttggcttttaacttttaagttcaggggtacatttgcaggatgtacaggtttgttacataggtaaatgtgtgccatggtggtttgctgcacagatcatccaatcacctagatattaacccagtacccattagctattcttcctgatgctctccctccctgcatcccccacaggcttcagtgtgtgttgtttccctccctgtgtccgtgtgttctcatcactcagctcccacttacaagtgagaacatgcagtgtttggttttctgttcctgtgttagtttgctgaggataatggcctctagctccatccatgtccctgcagaggacatgatctcattcctttttatggctgcatagtattccatgttgtatatgtaccacattttctttatccaatctatcattgatgggcatttgggttgattccatgtctttgctattgtgaatagtgctgcagtgaacatacccatacgtgtatctttataatagaacaatttgtatgggggggttatatagtaatgagattgctggggatttcattctaatgtagtttgttggtatgggttatcctcactatctctgaaatgacgaaaaaattcttagtatcacccaaaccttattctgttttaattaggcatttcacacaatttaaattagttttacaaagaatgtagaatgaagaacacttctcatcacaaagagtacacatctcagcacaaaataatgtcccctcgcccctccttttacattgcttttatgacgtgccttctagagcctcagcaatgcacttgtacaactcgtagcagagcaccaaaagaaaccatgatcagtgttaatgtttttccacattttgttatgaaaaatttcaaatatatggaaaagtgggggaaaaaagtatcatgaatacccatctgtctgttacccagatccacaatgaacattttttttatctttccctctgtcacgccatcttcattactttatgcatttcaaagtaagttgcaggtgtctgtatacctcatccttttaaggcttcgtcatgcgtgtcatttcctagagctcggtgcttgttgctggttttttctgtgtcgggtaaagtttatatgtagtgaaatgcagaagtcctaagcacgtcctttgatgaggtttgacaattgcattccctgggtaacatgaacccctgtcaggataatcacaaaacattaaccgtcaccctagagagttctctcttgccccttctcaatcattcccacccccatccctccaaaggaaaccagtgttctgattttttcaccataggttcgtttaacctgttcaagaacttcatgtggatgagatcctagaatgtgtttattattttgtgcaagacttctgttgccagccacattagtgtgctagggctgttataacaaaataccacagactgtgtagttcaaacaagagaaatttattgcctcacagtttgggaagctggaagtccaagatcaaggtgtcatttagaatgtgttccaggcttctctgctagctcctggaagttctttgccttgtggcagcataattccagtctgcacatggcattctgcttttctatgtccaaatttccccctaaggacctatggtcctcctaaggacacccatcatattgaattgggagtgcaacctactgcaggatgaacccttcttaactaatgacatctacaatgaccatatttccaaataaagctaccttacaaataaggtactgggggttaggacatcagtatacaaatttgagggggtcataattcaacccatgacagcagcacctgggttgttttatgtaccagtggtttgctgttactgccgagtagtgctccattctagaaatggactacagctaagccaagctgtaccaagccatgcttgttgatgggtgccgtttttggctgtcgtgaataaagctgctaggaacatttttgcacaagtgtttctgtggacgtgtgcttttatttttcttggatacataccctgaccccggggagggggctaacctggggacacatgtggaaggatggtcctctgaaggcagaaggccaagctgttgggtccccccaccttggccagcagccgggatggctcttccccagtgctgcttcagtctggtggagacagtagctacaaaccacagatcctgcttcttaaaactgggcaacatcatcacatctattaatttgaattttttttttttttgaggcggagtctcgctctgtcgcccaggctggagtgcagtggtgcgatctcggctcactgcaacctctgcctcctgggttcaagtgattctcctgcctcagcctcctgagtagctgggattacaggcgcccaccaccacgcctggctaatttttgtatttttactagagacggggtttcaccatgttggccaggctggtctcgaactcctgaccttatgatccacccaccttggcctcccaaagtgctgggattacaggcgtgagtcaccgtgcgcagcctgttaatttagattttaagccaatctgttggtttccctttgaggttggtgatgaagtccttaaaggctgagatccggtcacctggaccagtaaggaagtggggagttggggagaaggtcctgttcccaggacagtagtgacagtggatgaaggacaggacagcagcttttgaggataagggcgagagaagggatccagggacccattatgggcccatggtgggagttggggtctggcccagggccacatcctccttcatcctcaagggaaggtgaggggcccatgaactctctcagggaagtgcaggtcctgatacagcaacatggagaagctgtaaccaagccggagagagtcaccgtagagcccaggaggagagacccgaagataagcatcaccctgtgctgtcatctctgaggggcgggcgctgctgatagacacgtgaaagtctagcctgcagcagatgtgagtctcagatgcctccgtgggcagccggaatctagatcaacaactacactctagaataatctcagctgccagtaagccagaggggcttggagggtgaggagtccctgtgataaccaagatcaagttctaaaccagccagcaggcctcgcgaggctggctcacctttcaggctgctggtgttggaaacatgagactgtgcctctcagcccaggcagggccctgcctggggtcccacagcttccaggagccagtagggagcccagagcctggcaaggccagcaagtagggaggggatactgcttggcaggaagtcctcaggagggagtgtgaggcttggtctgcctagatcattacagcccagggctttctgtacctaggacttcagtcccaaccccgctgaccccatcttaaagaggacaagggagggatatctgcagctggaaggagggatatctgcagctggaaggagtgtgccagcttgaacagtgacggggcaccactttctggaaaatatggaagaacctaatgtacattagagctgtgaaacttgtggcccacacactaattttctctagcacctgggcagacataggcagttgtggcatctctttttatcaagtacagacagaaaaaaaatcaattaaaataattttattgttgtataatgcacgtgctttaaaatgtacctctttttttttggagacaaggtcttgctctgtcacccaggctggtgtgcagtggtacaatcatagctcactgcaacctccagcttctgggcttaggtgatcctcctgcctcagcctcccaagtagctaggactatagacatgccccactgtaccccgttaatttttttttttttttaagatttctagtagagatggggtctctgcgttgctcaggctgttctagaactccaggcctcaagcgattctcccacacagcttcccgaagtgtcaggattacaggtgtgagccattgagcctggctatatttaccatttgaaccatttttaagtgcacagttcagtggcagtaagaacattcacgttgtgttgcagccctcactaacgtttatctccagaactttttcgtcatcccaagctgaaactgtgtatccattaaatactaactacatttccttctcctcctagcccctggcaattacctttctactttctgtctctgaatttaaatctacttttgagaagacacattgttctggtcctgatattgttgatatttaagttccagctggccagctaggcagtaaaccaagcaaaatctcactcatcagacctgagtatttttttccttgacttgtgtctgtcatgtggggggggttgggtgattggaaatatttggtatctacacagcagtctttctgcctttgccatcatcctgtgcatatgcttcttgataattaatatgtgcattcagttaaccattcatgggatcttttcttttatccgattctccgctccttaaggacatgggctgtgtcttgtttgtccctgtatcccaagccctgagcactatgtctggtgcttagggtgctcaatatttattttctttttcttttcttttctttttttttttttttttgagatggagtctcggtctgttgcccaggcgggtgtgcagtggtgcgatctcggctcactgcaacctccacctcccaggtttaagtgattctcctgcctcagcctcccgagtagctgggatcacaggtgtgtgccaccatgcccggctaatttttgtatttttaatagagacggggttttgccctgttagccaggctggtctcgacctcctgacatcaagtgatccgcccgcctgggcctcccaaagtgctgggattacaggcgtgagccaccatgcccggcctcaatatttattttcaatattccacagatgagggcaataaggagaggaagcggaagaaaaaggatgagacatgtggcttgtgggcagaaagggaggcaggagaacattcccagtctgcctttcactgagtttttacctgttcactagaacaacaaaagggaacccgatcgggaaactctgctgtcaactaagcaaactctaaatttaacatttgggggacccccttggagagtagttgagagctatgtgctccccttttcagaaaaatgctctcaaatactcagtgcataagcccacagccttagcaggttcccagaccttaggtcagcaatcctgttctaaggcatacatcacgagcagcattttgattttcatctggggaacttatagttcataaagacctactgatccattaaaatttccacttgattttgccattagtaatctcttaaacaagtccaaggaagccagaggaagttatttcttgaatgcttttatactagtgctttcaagagttcgtgttgctgactccagtttttaaaattattattctcatcttctgcaatgcctcgaggcatgtttttagctgaatagcaataattatgggattgtgcaatactggaagaagcagtaaaaataaaatgtaatactaaaaaaaaaaaaagtctttacttcatctaggaaattcagtttaaagaatttttacctccggacataacagtgactatgctggaactctgtctttgactcaagccagaagatggatgggaccacccttaggagccttccacaggaaggccctctccacagtaggacttagggcgctcatgtagatccctcggcagtaatgcgctagttgctcctatagtcaggaggcatctagggagatcgctgatctccatggcaacctggacccaaatgagcaaagtgccatcagctggcctcggcctgactgctctggcgggagggaggaagctgatgctgtctcccacccaggccgtgtagccatttcccccacccccaccggaggtctgagagtgtcagggcttctgcccttggcttcagccagttctcctggaggtcattaaagggaagcccttctggtggcaagttctctgccacaatctacagtgagaatctaatgatggtatcagttgtagaggccccttgatctctggagagggttcttagtgccaaggaactttctagaaccatggaggaaccctgcagggacctctgaagagtcctgagcaaagaagtggggaaagctgtgtgggtgtgcaccagggtctcatcaccctgccctcaagggcagcctcagtattatgacttaaggacttgggggtttacataacatccctttttgtcagcaaaggaagttccttatttctaaacctcatggtcccagaaaacccagttcctgatctagctgtcccgttagggcatttccataatacagcacgttcttaagcagacattaagtcagacaattaggtcccagctaagccttgtcttgacctcttaagcaacatatctgccctcccttttgccttctctcttttccttctctgtcacagacacaaggactagatgagaatgacaccctggggctatctgatatacttcctcaagaagtattagtaacacaaacaacaacagaaaaaacaaagtgaaatttatttatcatgaagcactttattttatttagttattttttttttttttgagatggagtttcgctcttgttacccaggctggagtgcaatggtgtgatctcggctcactgcaacctctgcctcccgggttcaagcaattttcctgcctcagcctcccgagtagctgggattacaggcatgcgccaccacgcccagctaattttgtatttttagtagagacagggtttctccatgttggtcaggctggtctcgaactcccgacctcaggtgatctgcctgccttggcctcccaaagtgctgggattacaggcgtaagccactgcagccagaagcactttaaagcttatcgttaagaacaaatatgcagtcatgcaagagcacactgttaacaaattaccggctaactaaaagctaggcgagttccatatcaatatgattaaacaattgcatgggaaaattattatttagaggaatggaagtagtcactagtacgtgttgtcagtagcttctgttttattcctaaaaagacgaatgagaaaatgaggtattatgaaggaagaagcaagagtaaatgccaccatggtaattactgcccggggcatatgaagaactgtttttttgtattctaatctccgtcaccgaaactcatcagtgatgcaggacccaaaaatagaaggacattttgggtggacatgtagttaataatgacttatgcagcccagcacctgtgtgggctggcattgttctaagtgctttttcctgtgttacctcatttaatcttcacaacagcgctgtgaggttggtacaagtattatgttgattttatggaggaggaaacaggtgcagagaggcaaggtactttgcccaagcttcctttgtcaaagctcacagagctggggagggtgcccacgtgtgtgtacctgtacccactgtgcatgctgcccgtcacgggcaaaggggcttccttttgctgtctttgaatcatggatttattcagtgtcatgggaagccatgcatgggttagtattctggccacatcagtgaatgctacagcctggccccatcatgctaatgtcaggaggagtgcgggggattggcagagcatggggaggatggcggtctcctgctgaaactctgtggagtagcctcagctaccctttcacagagcagggtttggtctctgaaaggtgaggtctttcacttgtgatcatggtacaaggctgtggtacttctcgctccaggagctcgctggagaacatatcgaggcctgtgtggctcctcagcccataccctcaggagaaggaatgctctcctcaggtttggaattgcttttcttggtccttgtttctagtagggagtgagaatagacatgagttgtgcctgctgggcagagcctttgcaggccaggcctcctgggctgccttgggcgtgttccttgaagagccagtcctgcagttgtgggtgggagaggagcttctctgagatgtgttatcaggaaccttggcggaggtgggcagttgaccttcggctttccccttggcctctagggattcatatctcataaagaacagaaaagaggaaggcagcctggcccttcccctcacccttccctcttggcggtgttgcgggaagggaggagcaactcttcctcaacatcctcgaagctcagtgtctggcattgtaaggccagtggttttcaaacctctgggctcagaacctttgttcaaagcaagtgttacctggcagccacacatccatccaggcagccccatgaggaatgctcagatccatctgagaagagtctggaaacccacatcttcatttcccaccatggccctgtcaggggagaccctttgtcctgtaccttcctgtcgtgttctttctacgtttcacccactgccttcctcgtccttccaaattagattattaatctcatgaagaaaatacagctttcttcctgtgattcaaaacatcttttgtgagctctaaaaccatgccgattaaggaattatgaatttaaaataatattaaatggtcagtagcttttattgacaaatgatcttgggacaaagccattagattttttttctatctcttacagaacccccctcctgttaaaacattactcattgagaagtgatccattaaaagaaaaatgtgttggattttaaaaaatacctaatccttggcagggcgcggtagcttatgcttataatcacagcactttgggaggccaaggtgggtggatcacttgaggtcaggagttcgagaacagcctggccaacatggtgaaacctcgtctttactaaaattacataaattagctcggtgtggtggcatgcacctgtagtcccagctacttgagaggctgaggcttgagaatcacctgaacctgggaggcggaggttgcagtgagctgagatgatgacattgcactccagcctgggtgacagagtgagactccgtctgaagacaaacaaacaaaaaacaaaaaccgaatcctttagccaggcgtgtctcttgttggataagtcagtttggaatcttttggatgttttccttcttttacttgctcagccataataaatctttcattttaattttgatcagcagcattgtgaggtcctgcccagtgtggtaatgggcagttagcttgtcacagtcctgtcatcttgccagccccttgagagctgccagaagcttgtggtctgtctggtttcacatggtggtcatggactctcttagggactcacatgttactgcacagtgggtatgcatcttggcctgtcagcacctctccctgaagcatcccaggagctatttaccaaaatggatcatgctcttttgtcaagagcaggccactggactgcattgcacccctgaggatatacccacagatcaacgggacagaataaataaagcaagatgaaaaagaatgaagggatctagtcgaataagctttgcaactaaaaatcttccatgaatacaggatctcagaatcacttgataatatgctccacatacataagtacacatatgcacacacacacagccgtgtgagtacagatacacaagctgtaaggtggtcattgcacaccaacgtccctttcgacgaaaacgaacaattcctcgatactagctggtctcttggtttctgctgtttgtgacttgtcattgcagggaagggctgtgatggagggagtttttgttgacttggtagttcctgtctgcagaccccttcattgcttcattggattccttggacagcctgctatagccacatgggggctcagttagagcctgctctgtgagctgcatctacccatttgggctcccacgtgcagaaagcatgattcccatgctccatgtgggcggactcctgttaggcaggtgggaaaggagaaaccagactgcctggaacctgcccacagggcctctacccagtggggcatcagggaggtaccacccattccagtcacttgttgaaaactgttcccactctgggggaggggagggtaagtcatggtctctctctgtaagaaatcacaggtgcatgtgtgtgcacatgcatgcaccagctatctcctccttctccccaacaaaatgacagttggcattcgtagagcctgtactctgagacggggattttgtgcttgacgtgtattatctaatttaatctacttaaccctataagttagatgaaatattatccttgttttacaaatgaagaaattaaggtagaggtaatgtgtcatctctagtactctagagtttctaatgccccaggtatgcttctttttattacaggataggctagggtaggctagggtaggctaggctagggtagggtagggcagggcagggtagtgtagggtagggtagcatctacaccaatgctgtgcatagacctttctgcaattatgggaatgttctgtgccgcccagtgtggtaacatctagccacatgtgactgttgagcatgtgaaatgggactagtgtttccaaaaaggtaaatttttaatattctttaattttagttaaatttcactagcaccgtgactagtagctactgtggtggactttccctgcagctgagggccctcccaggacgctctcaaaagcaggatgtaggacgccttggacttgattagcactgtttgatcattgattgatttgaaagatctttgctgagcccctcctaggtactaagcagctcaggctgtgagaatgtctgaactccaagaattgctgcatggttctttttgaactgagaccagtgagcaggcgaatgtctacaatagtcccgggtgttggaaaggactctggtgtggacctttgatgcctgctgccccagtgagtgacccagtgtcaccagactcgtgtgcccactcctcagaaaggcccccattcttcatgccccctatcttgcccttcctctgcctccatccgcttcttttgtctccccaccttggtttatgaagtctcctctctcctcttccctcctctgcccttgaatctttttctttccttttttctttttttgtttttttttgagacggagtcttgctctgtcgcccaggctcgatcttggctcactgcaacctcctcctcccgggttcaagctattctcctgcctcagcctccctagtagctgagattacaggtgcatgccaccacgcctggctaatttttgtattttttttttagtagagacggggtttcgccatgttgaccagggtggtctagaattcctgacctcaagtgatctgcctgccttggcctcccaaagtactgagattacaggtgtgagtcaccatgcccagcctgcccttggaactttaaaatttatttgaaagtttattttaatatgtggttacaatcacataacattacatttaccatttaaacattttaaagcgtgcaactgagttgtgtcagctatatcacattgttgcgtgacacttccccagaactttctcatcttgcaaaactgaaatttcgtgcctactaaacacaaactcccccttcccctaccccttggcagatatgagtctactttctgtttctgtgatttggactactttagatacctcacatgagtagaatcacacaatatttgtgcttttgtgacctgcttatttcacttagcatgatgtccttgaggttcatccacgttgaggcatgtgtcagaacgtacttttttttttttttttttgagacagtcttgctctgtcacccaggctggagtgcagtggcatgatctccactcactgtaacctccaccttataggatcaagcaattctcctacctcagcctcccgagtagctaagattataggcacccaccaccacgcccggctaacttttgtatttttagtagagacggagtttcaccgtgttggccaggctggtcttgaactcctgacctcaggtgatccacccacctcggcctcacaaagtgttgggattaccagtgtgagccaccgcgcctggctaggatgtgcttcctttttaaaggctgcattctattccattatgtgtataaatctcatgtcatgtagtcattcatccatcagtggacatttgagtgcccttgtcttttacttttttgtcctttcccttcattttccccaaaataaaatatgaaattaaaatagcggaaccaataatatattagatgaggagccgtttgtgcttatttcctatcttttgggcagcaagagttgagcctttatgccctccccaatcattgctacaaaatacaccaaatatgtggccgggcgtagtggctcacgcttgtaatcccagcactttgggaggccaaggcgggcggatcacgaggtcaggagatcgagaccagcctggctaacacggtgaaacctcgtctctcctaaaaatacaaaaaattagccgggcgttgtggcgggcgcctgtggtcccagctactcgggaggctgaggcaggagaatggcgtgaacccgggaggcggagcttacagtgagccgagatggcaccactgcactccagcctgggcgacagagcgagactccgtctcaaaagaaaaaaaaaatacaccaaatatgttagccagagtgaatttctattctaatgaaacctttcattgattttttatttctctgggtcattaacttcccattgaataaagaaattccccagacctgccctgggggattcccctgctccatggaagtttgataggcattgcatttgggtgctagaaatggaagccccttagacagcagtttacttaagttaaaggttcattttcttctcatccagaagtggggctgtgtgtggacagtgcttatctggcagctcctcagtgccattggagacccaggctccctgggttctgcccccctccttagggtgtcaaccagagctgcatccaccatgcccagggttcaagcaaggagaagggaagggaagcaaaagggggtgcactccagctttactggccccctgaatgggcatccctgtgagctgcctgcaaggggctctgcacacttctcatcatccagactgggccacagggaccctcactccaccccagagcatggagaagagatgcatcgctgccctgagtaatgtggggattctcatggggagagggaagggggttgtgcagggcaggcctcctgcagttctgtatctacctggtggtcttcagtgtttaccttcttggggttcaggtgatggaacgaagacacagcagttgagctatatgttcatcatagttatactgagttaggatgggcaaagtcatgccactgtaacaaacaaccccaatagcgaacgtgagttagttggagccttgtcctcctgtgtcgtaactccaggactgaaggtaatgaagcctccactgtgtggaaagttgcaatcacattggtgaggaagaggctgtcacaaattaaggactgggtcttgaggctttcgtcgggaaccaacaggaggagttgagcccactttcattggccagaagtcacatggccacactcaatgtgaaagcatgggtgtgtcctcctacctcatgctgaaaggagaggaccctgaaatatttgatgactgtcactgccacagtagttatttaaatagagaattctataatatttttatagaaaagagtattaggaattgagtcatttgctatctcaaaggctctacattatttacacctgaaagaagttgagattgtccatgtaaccacctgacatactgttttgcttaatttaaagcacactgtccagaaggaaataaataaaccttgccaagtgtaattcatcaaataatagcatgtcaggtgcccaaatttggaagacagattgaagcaaaagtctgctgctattgcagagcaaagacaatttgctttatattaaacttaaggaatgatttaaagaggattcttcccaggcatgatgacttgctcagcttttttatagaacctcaaacaagtgctgacctcttaaacttttttactttcttcatgacaaatgatgtgatttggagtgaaggttggacaatggaaggagggtgatgatccgcctagagatttggtactggtgaatttcaggggcagatcttgggcccctctttgtgaaatgctcatgtttctattctgttgtctggaagcattttgtaagcaaaagagactttttgttctttattaactgtaccttccggcattctttcctggtaaactccaatttctaagtttataagtacatgcatttgtcagaatttagtcaaccaatccacacaaatttattaaacacatactgtatgaggaagaatatgggagtagcaattgagggcacaaagatgaatatgatttttaagctccttgaatgcttttgaatttaagtggttcacactcccatttgaaagatacagtgtgaacacctgcactaacactatttatttccactctgggatgggttgtagtgttcatggtctcagagaactgtgcctccctgttgcatcttggcttgactccccgtattccctgaattggggctggccttgtggcttgctctgcccagcagagtcttgcagagagacatgtgtgatgtccaaggttagaccttgctcttgtgggacactttgcttttatgtaaagatgctctgtcaagcctcctggaggataagaggccatgtgaagtgagaggcccagccatcagtcagcacacaccaccagatgttcaggtgaggctgtcagcccaccagccagcacctcccaccccaccgcctctcagactgcagacatgtggctgagcctagccagcaccaggaggaggagatgacctgcccagctgagcccagcccatgttgcaacccacagagttgtgagcatgtgaatgattgccatttgggcccctaaggttggagtggtgtgttcgtgcccaatggttgatcagtgtccactccctgctcatgccctctgtgacagccgcgtagaccttcttgccacaatggcatagtttttggcgccattttggatatgttctttatttagtttaggatgcccgtctccccttttcctccttggagcttctttttcctatattcaaaacccaggtgcttctccggattccctctggtgccctccatacacatctctgttactggcactttactttctacattgcactctgctgatttgtttacagtttagtctgatgctgacctctgtaggaaaagagtctattttctctctactggctcttgggccctgactcagatcctggcacacagtatgcttggtgggttattgggtgacaaggcatagagaataactactatgtgatgtcagggggtatggctgaccagtcctggctgtcccattcactgagacatgtgtgacaaatgactcaccacttaaggcccatttttgttaactgggaaatgagggtttctgtcttagtccactttttcctgctctaacagaatacgtgagaatgggtaatttatgaacaatggaagtttattttgcatatggtgctggaggctgggaggtccaagaccatgtcaccagcatctggttatggccttcctactgtgttatttcatggcagaaggcaagagggatggggagggagggagggggagagagagagagagaggaggaaggagcaagagggagggagggaggaagggagagagagagattgagaaaaagaaagagagagagagagatgaagcaaggtaaactcatcttcttaatctggaaccagctcccacaataactgcattaattcattcatgaggcagagccgtcatgatctaatcacctcttaacggtctcacctcttaacactgttgcattggggattaaatttctaacacatcaacttggggaacacattcaaaccacagccagtgccactggctattctgattccaactttcttatgtggtagaagcaataaagactcttggatttctgaagaggaagagctgatagccctgtggtttcatttcttcattggttttggctgaaggcaagtgggtttcactgtgtctgggaaaacacagtgaaaaccaggaagaccctatccacatttgctgaatgctggcaggcagtgtgctgtggaaattcccagaaagacttttcacacagaagctcaaagggcccgaggtcacgaatgctccagaaagcaccaccacagctccttggtgactcccaggatatgttgcagaggtcctggcagcctggagggcaaacagttgagagcatgaaaaacgagtgtcgaggctgtagagaaagaaaaacgtgagacagaactcagggagacaagtttgcctctgggagcttctctgaggggttgaagcaaaacgctgaagaatcacaaccccatcctctgtccagagcagaatctgacttgaggatgcagctctcaggatcaaaagcagaggagctcgagggatgatgtcttccaatgccccctattttatggttggggaaagtaaagccaggagaggtgaagtgcctcactacaggtcattgcagcaggctaataggagaatggctagtatggcactaactcaggttacagatggaagggaatttaccttctgaatttctggacctccaaagaaggctgaatgttgtgatgttctttctgcctagaagagaagtaaaatgatgaggaactcaaatccgacttcttgaaatctgaggtttgggcttgaacccagacctaccattttcaatttactgttcttttccccgtttttcactctttctttttatcatcctgtttccactgctactatcatttttattattgctactcgctactcctagttgtacacgaacatttatctttaccatatggcaggcactgtgctaagctctttacatgtattatctcatttcattcttccaagaaccctgagaggtaggcattattccctttattttgccagtgatgaaactgagacccagagaagttaagcatcttgcctgaggtcacacagcatttagtggcagtgctgagatttgaaccttttgtctctctgtctcagcattcttttttttttttttttttgagttggagtcttgctctgtggcccaggctggagtgcagtggcacgatcttggctcactgcaagctccgcctcccaggttcacgccattctcctgcctcagcctcccaagtagctgggactacagtcgcccgccaccatgcccggctaatttttttgtatttttagtagagatggggtttcaccatgttagccaggataatctcgatctcctgaccttgtgatccacccgcctcggcctcccaaagtgctgggattacaggtgtgagccactgtacccggccctcagcattctattaagagttcttggaactgcatctcagctatgtcattatagagttggtagtcaactattaagccattcttgttctttaggaaagtagaatctatatatctccaagatgatatgactcaacaaagtagggcctccaaaaattgaggctgtaagcaatgccccaaatgctccaatgaaagaggaaaagtggagggaggtaaatagttattggtaaggaaattttctaaataagtaagctcaggttatttaaaggatctaccaaaaataaggtgaggagaatcaattttgtaagtagtgatggctacagaactagcctagaccaaacctggctgattgtgacaaatactaaatataaaaacaaaatgaagcaaaattgtagactgactgatgttcggaatgagaagaacaaggatgggttggacacgttggttggactcttggaaggatgaaaggaaagcagcaaacactaacaagctggtcatctcaggccaaccgtgtttctttgtctgagcacatcattgcactgatgaaacagaaattttatcacagcatacagggggttttggcaggtccctccttgcaatcactatggaaagagcatgaactgataactatacattcgggtgcctggttgcaaagaaaaatagcaagaaagctcattaatgaagggttgctaatgcagagagaagctccccagaattcacgttggcagttaatctgaagatatagatggactgctcatgaaatctagagttccttccaaaacaaattattgtgagattaaaatattctctttctgttggcacagcaagtgaaggcaaagtcatgggaacctggtggactttagaaatgcttggcctctcctcccgtggtggctggtgccaagtcaatctgtagctgattattgtctcgaatatgtactcaaatgagctgtgtagtaggccatctgctgtctcctcgactcagctgataggccctggaaaagggaaatcctgccaaaatgcaaatatcctacttaactgataatatagggagaggagatacaggctgtgggggaatgggggtagggaagggaatggggcgtggggaagaaataagtgactgtcttcacccttcctcgatgtctttccatcctcctgtgtttcttcctgttagagaaagaccaggtgtggatcagtagaccccgctcacaattggagttgcggggtcagactggaagtagccagggaattaggctcggttgtgaggatgctttttgtagcctcttcatttgaattcaagaacctatagcctcttggtttccactggcacgcttgccatggtaggagcccttgttaggattaagcttttctcagtgctggagatggagttgttgcactcatagggctaccacctggattcctcagattgcctccgaatgagtctgtgagccccaccccaccggacctccctccatggcgtccctcccaagcatgactcaagggttctgagttgctgtgttgaatggattggctagcgatcgtttccatgggcatactgctccatcatttccaaatgctttcgtgttcactttcagtttcttttaatatttatagacaccccaaaaaggctgccactattcagttgaaatggtaatgctaaggaaactaaggctccaagaagacggtccaaggtctcatggctaaatgagtagaagaccaaaactgtgattacaaagctgtcaccagctctgcccctttagggtgagttactgatgaaagaagagttggctctgcagacagcagtgaggaggagtgaagccacccaggcataaggcaccggggagctgcgggcctgtgtccagctggagcgcacggggccatctgaaggggcagtcgctatgcattgggcgctgactgcctgcaggccgtgggccaacgctgccagctcttccaagtcttcatgcattgctgggaatcagagttttaaaatattgacagtggattcagttcttttcaaaacactgtgcccattgctctggatcaaacagacaccatcccacacaacactccagttgtgatcagtggattaaagcaacactccttggtgaataggcttcttttgatggtacttgcatttgaaaagagttttgttgaagcaatttagcttctaattaatgcattctgtgggggagatgttttttcatggagtcatcttcttgtgcctgctctgggtcccccagcttcaaggaatgttggctaaagagagtgggaaggtgggatgcagtgtgggtggcgtcaccttgcagcctgaccgtgcctcctccgtcctctctgcacaaggtgacaacccactaggatatggaaggggaaggctgtcacatgtaccttgtgtgatgcacccaagttattacaaatcattttctaaaaatccttgcagagtgggtaatgggtctctgagccatatagtgttggggctgttgcaaaactggtccacttccaaattgcaggccttgatcatttactccctgggtgggaaaggggagctctccacagtaaagaactcatttcttgtcctcagatgtgtggtggtctgatgtgatgagcagactttatactgagaaaggaattttagaggaatacagaatccagctaacttagtaggagtgattaaaaaatactggaggtgtggggcgaggcagattctcttgatagaggaaattctccaggtcacgtgtgtttttttaataagtagcatccctttgcattaacctcagtggttctcagccttggctggttggggaatccctctgaactttaaacactgcctgtacttgggctcagcctcagagattaggacttaattggtgtggagtctggtgagggcatctggactttcaacagctcccctcccccactgacgatggttgagaattactactccagtctgtgagttttagagttcactgtgcatcagaagcacccaggagctctttaaaatgcaggttgctgggctttgccccatggactgaatccagagttcacgggggagcccaggaacctgtatttttcaaagctctacctccagcgagactcaggtgatcattgacttatgtgcttcatcgcaggtgcccatatagaaatacgcagataggttatttcaatttgcaattaatacatataaatactttagtgtcctacttttgacaagcagttggatggaaaatcgatcttttgaaatggatgtcagtttaggctcaaaacgtgtgattacctaagttctcactgctggagaattcaagctgataggccatgtttttcaaaggaagtgggtgcagaactggatcctgtcagtgtcaatgcgggtgcatccgggtgtgtagcagtgccttttggttaaacccaggctttccctacgagaggtcttccagtccattaatcttgtgttaagtttcttggctggaagggtggtttatagaagtggtgccaaacagctgtaaatgcaaggctgagaactatttgtcctcttcctttatttttaagacttcagaaaacaactttcactaaattggtaaataaagttttaggtattattttctgattaatgaaatcaccataaactactacttctagacttccgaatgtcatgattttatttctggtcttattatatttgtgtttctgagtcttaatgagctagaaatgcttataagacaaaagcaatgtgtgttttttcctgcatcagattcttttacaccttatcttgaagtttgcataactgagtcactttctatttttttttaatcactttgataagagaaaaatttatgttagttgcagtccaggaaaaagaaggcacaaacactgctgatcaaatattactaaagcttttatggactcttgaacctcattttccctcccatatgtacacaagacacacttcattcttactctgtttatgcctctctgtctaatagaaacttcacttctgactccagctttgtctaattattaacacagagaggtactagaagttgtccattagcaaagaagagaaaaattatgtttagggaactaattttataacagcttaaaatggctttgatgtaaatctgccagatgcctctttttatatcatcaaatactttgctttaccttgaagaatattacccccaggttgggacaggagctttcccattcttttcattattttgtatgtaaaaaaaacccaaaaagccagttgtacctctcgtaaataatacatgttttcctctgcagaactgtagtctatgtgacacctacaaacaagggactgcttgaggagtgaaaacctggcttaacccaggcgtgcacttcttagggaattctttataggaaggagtcatcattcatagcagtgatttagaagatttcattccaaagattgaattgcctgttcagctgttcaaaatgcctgattccccagatttcaggaacagcagagaggggagagaaaccatttgcaaacacatagggtgtcgagtaagagtctcagagatttttttcttcccatctgaagtgtcatatgctcagtttgcttcccttgcttacatgtggaactgacccctaactgtgctgataagagaagaataagtaagtaaacacccccaggatttgaggctgatagaaaagtcacttggtttcagtgaactggactggaacacgagctttttgtttgctcttgaaagtttagcacttgaatttcaggttgggctgtttagttcattaaagaaaatgtggatgcctcatgccaacgcctgttttctttaggccttgagaatagaaggcattgtgtattcggtacacacacactaagggaacagtgacttaattgtaccctgggaacaaaagccattacctgaggacaagatgggagaccccaggcttctgctctctgtttctctctgcagagtcagcattgctgggaaccctggagcaagtatctgaactgttgctggtgtttgcctgtgaaattgtaatcatgggctggtttctcctggagcttaaacatgaggggaacttggctctgtggggaacctgacttcttgtgaagagacccagagcctaggccccatcccccaccccccaacacacacacacacacacacacacacacacacacacaccaacacacacacacacacaccccaacacacacacacacacacacacacacacaccagaagcgaagcaggcggagagggaaaagggaacagagagggtttggttctcccatttgatctgtctccttgcaaacgttccagtgacataaatggatggttgcatcctgcggctgcccatccgtctgccagcagtccaccttcagctgatgccatgtaaacagcgtttgcacactttccttaaacagtgatctgcgggcagtgcgtgcgtgccaatgagagagcttgggggcctttggagttttgggggatacccttgattattctctcacacaaaggtggtgcctctgtgtcccctgggatggggacatgggggttggaggcctctctccttctgaggggctaagtggttggccttgctgttggcttgagccagctctttggttgcagaccgtggagtcccagggatcttccttccagggctttgtgttttcttttgcctttgtggatcagccaaggccaccttttaagagttctttgttcactggggaggattctgtcatgccaagggctgggaataaaaaagtcacaaatagaaagacttgctcagcattggcaactcccatccctcagtggttctcttgagttttggtaaatctagactgatgaatatagcagctaatgatcatagtagtagcagcaaaaacaaagctggcattcattaacatatcacactgccccatgccttttatacattaacactttcaatcctcatagtaagaggtctctatttcttttaatgaagcaaatgaagagcaagtatttagaccgggttctatgacaatggctactaaatatattatattctccttgaagtcgtgccgttatagatgggagccagcttttctcaaatttcaatgtgcttatgagtcacctgaggatcaggcagattccaattcagtaggcgatattgtttggatatttgtccttacccagatctcatgttgaattgcaatcctccatgttggaggtggggcctggtgggaggtgtttgggtcatgagggtaggttactcctggcttgatgctgtcctggtgatagtgagtgagttttggtgagacctggttgctgaaaagtgtgtggttcctccccctcaccttgcttgtgctctccccatgtgaagtgcctgctcctacttcaccatccaccaagagtgaaggctccctgaggcctccccagaagctgagcagatgccagtgccatgcttatacggcctgcagaatcgtgagccaattaaacttcttttatttgtaatttacccattctcaggtatttctttcttgcattgcaagaacagcctaacactgtaggtctaggtggggactgagattctgcatttaaaacacacatccagatgaagcccatgctgcggcccacagaatgcattgggtggtgaggttctaagctagatattgccaagcctggctgagattctgaaacacacagctctcctcccaccttccagatgctgattctgaagacaggagtttcgcttatacaaaacactgagcaaactggggttctaagcgtatctgtgatctctgcaaggccacacggacagcacccagccttctggggttcagaacaccttccctcctcataatacctctgactgcatgttaaatggctctgactgcatgtcaaatggtatcatgtgctgaagggtgtgtacaagtttgtgtctttccttcttgctgacatctgccacagctgacaacccacctcagatgccaaggggaatgagcttcctttcctaccttgtaacctgagccaggtcttcctccaggcaagcccatcgtgcactgcacattcctcataggcactaaagctctgtctctcctggatggaaaccctgctccctggagagatggtgatactggctttctgttcattgcacacagtgatacagtaatacaacatccagagatgatgggagaaggagcagagagggagggaggggtgagtttgtaagagtggggatatgtagctctgaaggaggcttggtgtgtttgcagagaaggacagcacagctgagggctttcccaacatggctgtgctgtgccacctcttcctgaccaccaaggatcagacttctggaagaagaaagtggcttcaactccagtcagcactttatgtcagtgtcctgtcacctcaggactctgatcttgtctggttacttctttaaagctccaatactccaagtgtccaggaattgaccaagctgtgagaaatgctcttgcagggttgatttcatgccccttatctctataattctaatgagagctcatctttgattattttgagttttgaaggtttctttagagatgttttcattactgaatgcttaggattagtttgggctgcttgtgacagaaaacctcaaataataatgacttaaagaaataggagtttatttctatatcatatagaaggagtctaggctgatatggcagctctgtgatatcaaagactttggcttcttttattatgccactgtgctatcctaagcatgagactttgacttcatggccaagatgattcctcatgcattagccatcacatcttcattccacccagcaagaagaaagaagagagaaagaaagtcacgtcctttcccatgaaagacattccttggatattgcacaccataattctgcttacattctattggtcagaacataacaacatggccacagctagctagttatgtggccataaggaagactagcaaaagtagtctttataccaaatgccagattctcagctaaaaatgggtaattctaggacccaagacacagtgaagatcaaatattgggataaacaactaccgtctccacctcattggggtcttaaggtcattcaaacctaggtaatgtttggatttggcccaaaaatttccaacagatgcttcccagccattttatatatatcacaggaagtttgcagtcatgctggatctcttaatcgttcctccaagaggaggcagagctggcccttagaggtgatattaattaaccatggcttaataatttaattaattacagctggcatggagtgcaaatacaaggagaaaactgctggcagtcatctaaatttgaaggtagaaggtgaccaggcacggtggctcccgcctgtaatcccagcattttgggaggccaaggtgggcaaatacctgaagtcaggagtttgagaccagcctggccaacatggtgaaaccccgtctctactaaaaatacacaaaaaattagccgggcttggtgctgtgcacctgtagtcccagctactgggaggctgaggcaggagaatcgcttgaacctgggaggtggaggttgcagtgagctgagatcatgccacggcactccagcctgggcaacagagtgagactctgtctcaaaaaaataaaacaaggccgggcgtggtggctaacacctgtaatcccagcactttgggaggctgaggcaggtggatcacctgaggtcaggagttcaagaccagcctgaccaatatggtgaaaccccatctctactaaaaatacaaaaaaattagccaggcgtagtggtgtgcatctgtagtcctagctactcgggaggctgaggcaggagaatcacttgaccctgagaggtggaggttgcagtgagccaagattgcaccactgcactccagtctgggcaacagactccatctcaataaaataaaataaaataaaataaaataaaataaaataaaataaaataaaataaaataaaggtaaaaggcaagatgcatacattcatagccgttatctcgtgctggcctcagcttgctggggatgtgcacgtgtgtttggagcccagcaaagagcttcacaataacaatcacagcaggagtagaaaaatgggcctcgcctcagcaccagaaggagtgcatgggtctgtgtcagcattgggtgctttatggggtgttgtgagggcaagaaaccttaaggagcgtgtggtttctgagatcccgatttcgaaaaaacaaagccctgagctggaagtcccaggcatgtcactgtacctccatggaggttacaaaggagtaatttgaggagtggcatcaatattatttaaatgttgagaatcaaatagattttgagagctagtgcagggctgagtggaaattgtccaaatttctgtacagatgaagactcataagtgggctgaacgttatctctccctcccgacttttttttgacctaacagcaaacacaaagtattccctttagaaaagagtgtacgaagagtggtggaaaaataggaataatttccttcaacctaatcatcccaaactcaaacaaaacaaccctcgcattctcaggcactaaggtgctccctggcaagggaagtcaagggtggaacagaaggtacagatagaatttatacctcatggggcccacgacagacccagctatgcctgggaggaaggctgtgaatgcagcgaagtcctgaaacccaagaaaatgccttccgtggttcaatgttttgctttttctctaacaagctcaggttagcggtagtcagatgtctcagtgtgagcatctctttaatgttagcattcagcattccaaacttgggtggactttgatgagttcattcttcatacacgtacacacacgtgcacacacgcatgcacacacatgcgtacacacgtacacacacacgggtcagagttaatgaaaatgtgtttgagtttgtgctaaaggcaagctgagcagatgttttcctgtagtgagtgtgttacttcattatctgtgctaataattataagaataaaaagcaaagcgcagtggactcctatatttgctcttatgttttgtactgtcatctaaatcatgtctcttcaggcgcgtgtttgcttctggggatagttttatcttgtcaagtgtgtttgttcttggaggaaggaaagcaggcttgggtgactggtgagccttagttgcattttggcctctgcccctcatgagctgcctgttactgataaattactgtgtttctctggatcttgtttgttttgttttgttttgtttgagacggagtctctctctatttcccaggctggagtgcaatggcgctatctcggctcactgcaacctccgcttcccaggttcaagtgattctcctgcctcagcctcccaagtagctgggattacaggcacccgccactgcacccggccaatttttgtatttttagtagagacggggtttcaccatgttggccaggctggtaccaaattcctgacctcaagtgctctctgcccacctcggcctcccaaagtgctgagattacaggcgtgagccaccgcgcctggccctggatctcggttttaattgtcctacaatagaaatggcagtgccctccttatagcactgctgtgagcacgaggtgagctccagggtatggaaacacaggatccagcccagtgcccagcaacctgcagctgccccataaatgggcatttcctttctctgccttgattgtccttttgccttctttggatcaaaactttgctgctcagtgtttggggaagagataatattctggtttgtccctcaaatatatacgggaatctggtatggaactcaagatcaacgaggcaaacctaagaagctgtgtgtgtacaactgtggttctcaaagtgtggtttctggacctgcatcattttcatcatcgcctggaaactggttagaaatgcagattctcaggttccaccccagacataacggaattggaaactcggggtggggcccagcggtctgtgttttaactagacttcaggtgatttgaatgagtgctaacatctgagagctactagtctctacatctaagttatcagacctccttgaatcttagacttccctgaggaacattttaaaatacgaaagccagggtcccccccaagagatactgatttaatgagtctggggcagagcccaggcacgaggatgttttaaaagattccatcagtgagccaggcacagtggctcacgcttgtaatcccagcactttgggaggccaaggatggtggatcacttgaggtcaggagttccagaccgtcctggccaacatggtgaaaccccgtctctactaaaaatacaaaagttaactgggcgtggtgatgcagggctgtagtcccagcttctcaggaggctgaggcaggagaattgcttgaacccgggaggcggaggttgcagtgagctgagattgtgccactgcaccccagtgtggtgacagagcgagactctgtctcaggaaaaataaaaaataaaaaaagactccaccagtgattcctgtgtgtaaccaggatcgaaaaattctgctctaaagaatttctgtctcattctctccctttcccctcccctcttcctagggttggggattggaactggaggaagaattattttggaacaggtgctcagaggcgatgacagggatgaggcgcgagaagctacccacaggccatagaacatttccatttcttttacctcatttgctggtgctctgatatttttcggtggcagccttcttccgattttaaatgtaactcatgctcatgtagaaagtttgaaaacaacatagaaaactttgaaagagaaaataggactctctagtaatcccatcccccgaaagatcccattaaatgttaacattttgctgtattagcttgcagccttgcatctatatgtcctttttaatagaaaattaggatcatatggatgtatgtagttgcatagcttgcatttttaaccgaatattacattatgataatgcatgatatatttttaatttcatcttcaaagctggcatcagattgtactatgtagatttatcataattagctccactgttttcctctggtgaatgtcattcttttcttccatgatgggtacaaatagccttgtaaagcaatctttgattgcttttctgattatttccttaggatagattgctagaagtagatgcactgagccaaaagttataaacattttaaaggttctcgttacatggagctaaatttgtttccagaagggttgtgttgtctttactcccactctgaataagacagtgcctgtttccttgtacttttgctaaagttggctattatcttaaaatacaaaacccaaacaaaaccagaaaacaatcccatttgccactttgcagagccaagtgttcgtgcccttgacctctagcagctctctgtgaatgtggtcacagattcctacacccatgtgtcttcatcttccttttactcatctttcagagtcatgtttatctttcaatgtctgacagctttagtttggggattttcgtcttatcttgggatttgaggccatctgggcttctcagctctgctcttgctgctccatctttattgtatctgggcttcatctctaatgttttgtaccatttagcctctttgtgccatgcacaccagcctagaccagtgtggcatttaggatgacaccctcataaaggcccttaataaatgctctgggatattgcagcaaaaggcacacatagcattgcaaagttaaattattcaggctcaccgaagtatatataatctattccaaggtgagacagcaccccctccccactgatgcacacatttccccacctgcttcacacacactcactcaagtgcacttcttcagtgcatcacaaagggaagtctttgagggcctctcactaaaataatcagagaatccatcttcttggacctccttgataaatgatgtttgattgaagcggtgaatgacttgttgcatactttcctttcaaactgagtgtgcattacccagatagagaagaggaagagcacatttccaccctttcatttaacatcttgcagtcatcctagcttgacacagtggcaaagccatgcaggttaatagctttagctttgggacccttccagaagaagctctgtgccggaaaagtggtggggaaatggtagatccatcatagttttaaagctgcttctggcacctttacatcctagttgctctacgttgggaataatagcagaggcacccagaactgagcatcacttgggaggtagaaaagctgggaaggacaagagcagaaagaagaattgaaatcttctactctggccacacatttacacattctcttctattatttcaaagtgattcatctatttctgtttttttcaattcagggaaatcagctgcaggaatgaatgatcaccttacttttattccaaaggttcctgaatatgttttgtcccattcatccatccttccatccagccatccattcattcatccttccatccattcctccaataaaaatgtattaagtagtattatccaacctactactaggaagtaaccacttgtggatcaaggttttctaaagcttagcagtgatgtataacacaggaatgtgtgttaagtgtctggaagcccaagtggtggcttggtggggactcactggtatatagagaatgctgttttcattgaagctggactgtatgaaaaacagtccatggagctaaatttgacatgtaataatcatgtcattatataaggcctcattatttaatggcagtggttacagcagataaagcagttgaggaggcaggcagggaaaatctttaactgtgggtcagagaacttcacggtcattgatgaaactgccctgtgtgctctttcttcctgatatttcctttcagttcctatttttaaaaataaataaataaaaagggatgtcattatgattagctcattttggggatgtggctggatagtgacccccaaacatatcctcctcctaatccctgggacctgtgaatagttaccttctatggtaaaagggattttccagagatggcaactggaaacctacatgcgggtggttcccagtgcaaagcaatctcaaatattttgttctcataaatatatttttactttttagacaacttgccctagttttctgtttggaaaatatctccatagcagacaacacagtaatgaattctatcctttatctctttagctttggaggaatttcttgcttcatagttgagttctttggatattgagcacttattgtatacaagattatatctacagctagcataagaccaaatacaaagattaataccagctcctactctgtatgactttactacctgctctaaagctcccatcgctttggccttatgtgatatcccaatagtgattaaattgcccctgtaaagaagacatatacgagtctcccacataggaccgagcggttaagcttctaaagaggttttctgaagttttaaggagaagcagtgctctgagtatgggtctgtcagcatgtggggacacttaatgtgaatgtttgatcattattttaacgtgtgccctttgtacaacttgacattgacactaccgtgaaatgtaaattacacggaactccatgggaccactaaaccctctcccactcagctacagagttagcagaatgaacgcgtgacccagttagatagctatcgcgtaacttatctgagttctctccgcttgttttcagtctccttaaccactttcaaaatcatcatgtaaaagtctgttgcacactctttccctagctgttcagactaagctccaaaagtccatagcttcggaagacgcatggacacctctgttccttggacacacactgctttcctcaaactgcatagttgtgcctttgttttcattttcccttctgaggggaggaacaaggactagcaatgaatggcacctggctaggcgttacccttgaacatcctgatattaagtaaataggcaaataaagtctctttgtaggcaaataaactctggtttgcctgagtacaagccatgatgatggaatcaagctgtaattaaaaaaaaaaaaacttagttaattttacttacaacaatatcctgaaatcaaaatggatttaaaattgcatacttatcatgaccaataattagagaatatggctccacagcctgtggttttggaggctttgcagcccatttcagctgtttgtgtgtagttgtagctcgtttgggttgtaaattggaatctgattcttcccccctaactaccctagttcccttctggcctgtggaagataagctgttctgggtcaaaagcaatgtggtcacatgaccagcctacaaaacagagtcagccttaaaacttccaggactggactgatttggaaacttggagaaactttgctacacaggaagatgtctgccaccggggaacaaaccagcaattcatctcatgcctttcatctggagtagatcatgtgccctgaggtcatatgtatttttaaacatttattcccactcattttctttaatttgagacactcgggcttaatgtagtaagacattttaactgaaatttaatttgaataggtcctcacatacagagtttggtgctctacaaaaaataaccaaggtttaaaaagaaaacaaatccaggaggccttcaaatataccacttaaaatgatcaactttatgttttttaacaaagattgattttgtactctgctggaatgtggccccgtaccaggtggagccttctcctccggtctttttttttaatgagctggagtagctagtgagatctgaaatgggtctacgtaaaacaattgtgaaagagttgctagaattttggcttcttttctgattgtaccaagtggtgaaagcaaagtggagttggaggtgaaatgaattattataaaaggctaggtatgtcatgaaaaagccagcagagaaacagcgatcattagcgtctctgggactgaagcgtctagcctgttggagcttagtaatggttgacattgaatgacagtcttcactgctcttcaatacggtgctcaagacttaaaacgtggtcaggagcagttggcaagtttgttgagactgacgcacctcctcagttgtttctgctatgtttactgatggccatgaagtgtttctccttactatggtcacactttgccaattttcctgctttttttttttttttgagatggaatcttgctctgtttcccaggctgtagtgcactggtgctatctcggctcactgcaacctccgcctcccaggttcaatcgattctcttgcctcagcttcccgagtagctgggactacaggagtgtgccaccactcctggttgatttttgtatttttagtagagacggggtttcaccatcttggccaggctggtattgaactcctgacctcgtgatccccccacctcggcctcccaaagtgctgggattacaggcatgagccaccgcgcccagccagttctccctagttctaatggggtcactgtaccataaaagaccttgagatactgggtgatcagaaccacaggagcagcagcagcagcagcagtagctgctgcatggtaagttgagaccccagattccttcatcttttgtcaagaagcggttgacctctgcgatctcgggatttgtcttctccaggtcaagggtatatacagttggccactttaaaaatggcatgccgtttttctttctgttattaatagaatgaaggaaataggcaaagaaatggtaaataaggagaaagactcttaagaggttgtaattcacagccaggatagggaagaataatatttcattattacagattccccctttattgtggtatttgagaaaaaccccctcccatgatactatgcctgacacatgagtgttcaaggaacactcgttgagtgggttagtaaatcaatgaatgtaagtagcagtcactgggaatgcaggtagagactccagttgttcctcagcatatttaaacttgccactaggcaggagcactcagcactctaccctcaaatgcgtacagcaaatgtaacgagccccaagcaataggcttgctaattcttacaactttgacaagcaaggggaaataatgaatatcagtactgtgatcacttgaaagtggagaagaaatgaattgaccccaagtttaagaaatgtcatgcatagagaaagagcagacttctgtgagcagtgaaaatctaagcttgcggccttccccttcatctccccactgtcataacctgcaccccaccgtggagttccttgacctcctcatttccagccaccttctcctctactgcactgctgtcactagaaactccacccaaaccttcatttccaggcagccatactcacagcacctccttgccactgactagtccaccctttccaccatgataactcttcagcctcattggaacctttcagcctaccatgctttctctatcattgcccttctttcttcagttcatggggttggaggtggaggtgagagtaactatgaaataattaagatcatacagaaaatccacttcccaaggaggaccacacttttaaaatcagctgaatcataatctctatttttatttaatattggggctggatacatttttgtagctgtattattagtatgctacatacaaatcttttttaaattatttttttaaattgacagataaaattgcatgcatttactgtgtacaacatgatgttttgaagtatgtatacattgtgagatgatgaaatttaactaattaatgtatgcattacctcacatggttatcattttttgtggtgagaacactttacattcattctcttagcatttttcaagaatacattacattattaactatagtcaccatgttgtaaaatagctctcttgaactcatttctcttaccattttttctggccgaatagtatttcactgtgtatatttaccatattttctttattcattcatccactgatgattgattccatatcttggctgttgtgaatagtgctgcaataaacatgggagtgcagacatctctttgacatactgatttcatttgctttggatatatacttactagtgggattgttggaccatatggtagttctatttttaattctttgtggaacctccagattgttttccattatggctgtgctaatttgcactctctccaacagtgtacaagggttctcttttctccacatcctcaccaacacttgtcttttgtctgatagcagccattctaacaagtgagaaatgatagctcattgtgtgtgtgtgtgtgtgtgtgtgtgtttgagatggagtttcactcttgttgaccaggctggagtgcagtggcatgatctcagttcactgcagtctccacctcctgggttcaactgattctcctgcctcagcctcctgagtggctaggactacagttgcccgccaccacgcctggctaatttttgtattttttgtagagacggggtttcaccatgttagctaggctggcctcgaactcctgacctcaggtgatccacccacctcggcctctcaaagttctgggattacaagcgtgagccactgcgtccagccgtatatcctcttttgagagttgtctgttaagtccattgcccattttaaaatcaggttatttgttttcttgctttggagttgagtaccatgtatatattttgactgttcactcattatcagatgtatagtttcaaaacactttttcccattcggtaggtaatctattcactgtgtgtattgtttccttttctatgcagaaactttttcgtttgatgtaattccatttgtctatttttgctcttgttgcctgtgcttctggggtcatatccaaaaagtcatttcccagaccacagaaatcttgatgcttgcccttttggagccataagctcatctgcctgaaccagtggttatactaacaggaattcgctaaacagggctgaatggagacttgtagatgccttcaagtacacaaatgcttattgtagcatgtaggttgtctatttggcttctgtactccaaacagcagaatatgtttaaaaagaaaactatcttagtgcacacaaattacgagctggaaatgtattcacatcattttaagaaaattatccagaatacacagtctgggtctctaagctaattttggtctctgttattcttctaataaggtgaacagtcataccttttatcttccaatgattaatgtgctgacttagctatggttcatctgagtgacttcacaactatctcttctggttcccttctataaataattaagctatgtcctagttttatattatagctataaaattagcctaaagctgtgctgtttgacatgacagccacaggccacttgtggccatcgagcacttgaagtagggctggtttgaacaagatgtgctgtgtgtgtgtaaagcacacactggggttcaaacactcagaaaagggcaaaatctatcataatcattttcattattgactacatgcttaaatcataacattcaatatattgggataaacaaaatattagagttaattttgcctgtttctttttacttttattagtgtgactgctagagaatttcaaattatacctgggtatggtggctcacacctgtaatcccagcacattgggaggccgaggcgagcggatcacttgaacccagaagtgtgagaccagcttgtgcaatatggtgaaaccccacctctacaaaaaatacaaaaattagccagatatgatggcgtgtacctgtaatcccagctacttgggaggctgaggtgggaggattacttgagcccaggggatccaggctatagtgagctgagatagcgccccactgcactccagcctgggcaacagagtgaggccctgtctccaagaaagagaagaaaatttcagattacccatgtggtttgcatttgtggcttgtattatatttctgatggactactctgtctcaaagtaagtcattgttttaatttataaatgattattgcttaaaatttaaatgtatgtatatgcatacagttatactctgcatatagttatatatatgtatatacttatgtaattatgtaatttgaagattacataactataacctacttcctgtgataaaacactattggacacgtcatctaaacaaataattgacactagtgcttaaatacattaatgtatatcaagtcaactttaagataatcagactaagttttcatagattttattgtgtaaagttttattctttttgcctatgtctgagggaagttagaattttggaaccagtgcgaagttcattttcatatgttttattctgaatcactaacattaactcttctgaatctgtgacagccagcatttggaaagttaattcgagtgtcctaaaagtcactttcttcagtttgtttacctatcttattatcatagtctaaacgtagctaatagtaaaaaacctctaagtaacattgtttagtgattgagccaataaattaaacattaacaagagaaacttggaattccaaggaccaaggctgagtaaatcaatttcacccacctgtccagtgagcgtttgctgagaggagaagatgtagaacactgttctgtgttttaaatttttatatccttagcaagatcaaactccttcttctccctcacctaaaggtgagattcggaagcaggagatgtgttctaatcgctgtacaggttgcctagttcatcaaagttgggcagatggggccagtctggaagctggcaggcagcttccctggcaggaaactctccgccatgttctctgccttcatataaggcagccagcagcattttacatcgacgttaataataacggaagaaaaaatagatcattctctgttcccttaggttatttaaattttacttttaacctttgttttctaacattgaacatttctcaggagcatgctcaccgtgtgtttcttatatagaataagtactggtcttgcatgatcagagcctcaaagtcagcatgagaaatttgaggctcctttgaattcatgcaagctcgaattagaaacagcctcaaacagcttcagttagagtcttttttctgtggctctccaagagatggagcaataacttataattatcccagggtgaggttacccacaaaatttgaccatccacttctaaggccagaaagacatccgaataatgttactcaagggcccaagacgtgggaattggtcatttttgttcctgtgctttccttcaccatcaatacttcagtatttcataagcgtaatcagttttaagtgaaagggcaacaaccactgccacatgccgaggtgtccctaagccagcagccttcatggagagccattcagcagccctcgctcaagatggcttcttcagaaaacagtagaggagagcttgcttagtttttgccttctcttattttccccaatagaacaatgtatgagctttggcacatgcctaaaagatgcaggtggttttaagcaactatatacaataatagtaatcatattattacatatcaagcactgttgaaagagctttacatgtataactcatttaatctttacaacagccctttaaggaagatatggttaatacgttgtttgtcaatcattgaggtacctgagtcacagagaggttgaggaacttgcccaagatcacacagctagtaaatggcaaagccaggatataaaagcaagccctctgcctccaaagtgcataagtcataatgccacgcaggagattaaaataattttgtgtgtctggatatttatgctaagttttagttttggaagacttgaattggtggtttctgaatcctgttgaaaaaggatcctttccttcctttccattccctattagaaactgacctaaacctattagggatccttgaatatagacacagcggttctattctgagctgtgatgtctcttaagcccttccaaatattaacagtatatttgtgtggtagcaggcagtatctaaaacataatcatacctttttatctcttttgagtgctacagctgccctataggctaagcattattcaattcagttttgttttgttttgttttatttcccaaatgaccatgctgagactcagcaaaggttgtgaggatcagctttcacagatggcaaatggcagaggagggcagcatccagcattctttctcccaactgtgcatttcctctcagattgtagatactctctgtcactcagaaggcacagatgcataaaatatatttccaaatagagactagagaagttgatggaaatatggatttattttaagtttcagtctggaaacatcatgatcacagagattcagaaaatgcatgaagaagaagtctattacaggatttttactttactcaatgctatgtatgcttttaattaaatgaggagtgcactaaatgaaaatctccatgagaaccatccagattagtgcagagcatctttttctggggggcggggggagcagacagaattttgctcttgttgcccaggctggagtgcggtggtgcaatctcagctcactgcgacctccacttcccaggttcaagtgattctcctgcctcagccttccaagtagctgggattacaggcatgtaccaccacgcccggctaattttttttttttttttttttttttggtatttttagtagagacagggtttctccatgttggtcaggctagtctcgaactcctgacctcaggtgatcctcccaccttggcctaccaaagtgctgggattacaggcgtgagccaccgcaaccggccagtacagagcatcttaaggttggaaggactcttagagaccatagtccagcctcccacttgatactgaaacacgtttgtgaattcatggcagatgtctaacttccctcaccacctttccgatatggacagttctcatgcccagaagcaaaaccttctttattgtgcttgtcctcccttgactgtcatgcatataatcagcatctttcccactaagtgaagggcccagactcgagcacaggagcacagcaccccttaaactcacgaggggctgcattcacaccatcagcagggagattacacttgtgtcatttgtgacactagacaggtcagctagcaccatcaagtacttttttttttatatgaactgctattgtgctaggcctccccaatcctgtacttgtgaggttcatttctttgaacccaaatacagaaattcctgtttattccttttgcaaatttgattattcagcctcttgggagaatttagattccaagttctgtcagtgagtatattagccattcctctttggctgtcttagccattcaaaagtgtgataaagatgcttccatatgacatattgaatgaagtatcagggccaggatgtcctgaaaaataccttattgaggacacagcataaatacaggagcctgcactccactcaccaaaatctaccatatggtgattcacatttcatccaccaaaatatcatgaaaaatgaggtcacaggcctcggtgacatcaaaacacttttaaaatctatatccgtttccattctacttttcttatgacccaattggggcaaggggaaagttcttgctactcattgaccatttgctaagtatttctaattcatcagatcaaaagttgattcttgacgttttctaggaattaataagccaattaatcttggagagggctccaatttggttccctttgaacatcaatatggcttcacgcattagtatttgcctatgattgccagcaatgataggagattgcttctgccacactgtgacttaacttactcagacgtggagactcgaatttttaaaaaaaatacctaacaggcaatcttttattatctcttttcttacttcaagctttggttccaccttaacagtgttttcctgatgctttcccaagtgcagatcattggcctcaaaaaaaaaaaaaaaagaaaagaaaagaaaagaaaaaggaagctaaaagggttgcctaattttgtgtcctatattcctattccaccttcaactctgatcagccattttaacccttttccgtccatctttctcagaactgaacttaagttttggaattttttttcttttccaattctcagttctttgaggcttcctgaataatttgtgctacttaaaaaatttttttttttattttttgagacaggtctcactctgtcacccaggctggaatgcagtggcatgattgtggttcactgtggcctgtagcacccgggctcaagccatcctctcacctcagcctcctaagtagctaggaatacaggcgtgtaccacaagcccagctaatttttaaaaattttttatagagatggggtctcactatgttgccagggcttgtcttgaactcccaggctcaaggaattctcccacctcagcctcccgaagtgctgggattacaggcgtgagccactgcaccccatctatttgtgccattctgttgtattcatacaagaccttgagtcctactttccagtttcccaatttttagaaatctgacctcatggagttaacaaactgcgttatcctttcaagggccaattacaaattacttgatgactatgaaaacttcttatttacaaaatatttaggttatgctccaattagggaatctacccagttacctgaagttatggctgaaggcaactgcttagtcaaagcaattagcctctaggagaccagcagaattgccctgaagtttgtcaatggcccatgtgaggtccgtcctgtacttttgcttttcagatgaatgtacaggatctgaaatacaccgattgtcccttaggcttctgaaagcatgtaggcagctcccacagggccagttggggcttagtaaaataatcagagcccagtaaatgagaaaagtaaatgcatgtagactgccctgggccaggatggtcttaaagcaaatgatggacatcttgcatgatgtttttcaatgctggagcaattgtttttccatgttcagaaagtcagtggaaacaatttaaacagataggtagtcagcatataaatttaggaacccataaagcattgagtcaacatgtattaatactaaaaatttctccaatatactatgttaggctctggggattcaaaagtggtatcaatttttcagaaagaatcctatataccagggtgattaaaaatttttttaaaagctaatgcattggtgggtcactatgaaggaaattaaaatgtaaactcaacaaaccaattcttctatctcatgtctaacaaatgatgaagtagctggaaaaatgagttctgttattttgcattcatgcacccattaagtggaaagtaagctgcagattttgatttattaagattgtacagctttgtagccagccacttctgctcagagcttacctccaccatgaagcaatctcttcacctggaagtccagttgccttcatttctggaggcattgcagagccctatggaagtcagtaccctggagtagaaagtctaaacagggggcctgtggtgatacacgtgtaactagaggcatccctgcttccctggtagaccgtcctccgctccagggccattgccaccatttcctttaggccccattatgctgagcatggtggattctttaaacaggccaggctgtctgacctcagtgtttccgtatcactgcagacaagcacagcctcttgatccaagtgacaagaccatgttgaccccagctctgcagggtccaaggccacccatgctgggaggggtacagagctccttagcccccagcccactgcagatgatgaggaggaaacccagcaagaggaagggcttcccacccaaccacagcatgggctgtaggagaggtcattcctccttctcgcccactagtggacttcccatttcacccccttccctgccaggggattatgtttccatccacagagcttctaaagccccccagtgatgatcacttcatatcccatagaagtcatattccacacttttttggaagcagtgctccatggaaaggtcattgggtttacaatccctgcttcaggagataccaactccaaaccgcattcgcacaaattgtattttattttgtttagtgtttgacctgagacttaattagtgacacattctcttcaaaagtggcacttccgagagttaacgccatcagtctctttactgtcctggccgtggtggatacagtcttgccctggctctcacgataagctgcatgcttgctcggatcgggccgcgggggtgaggtcagcctcgtggctgacttccagggagttctgcttccactgagagaatactcaggcttcccgggagctccggtttctttttaacttatcatctttcagttttatctgagtggctgtcacttcaggtaactccagcagtgccattccctgccagcctcttcttgcctgccctgaagtgaccctgcggtcccctccccattttctcctccccctagacttcctccacgaggtgagtccccacttggttcagagccaaggtgacagatctgtagacatcatgggaaatggcttggcctagagcactgtaaaaaggattcttctttgctgggctgacagccagacagccactcactgcctccctgagacctgggcctgtgactcttgcaaccccagacacggaagaccccaaagaagcttggctaccctcagttgtattcagtctccagagcaggacagacctgtgaatggtgtctcccaagcatgttggccacccaactgcactaaatgccacatagtgccagtgccaggaatatttgaatttctcccaagacactgagtgcaaactcttcgtcagttcagagcagacttcccagtgtaaggtggagctaattcttccaatgacaaagcatgacagagggtcccaaacctaccctttaaaaacatgcaggcaaatagtatcttgacttaaatcaagaggagaaaccatgtgaatatttagacatctttctttgttcatctttctttgttcttcctctcatgctccagaactgagcagggtgaatattggaggagagtatctcacaattcgtattttaatctgggcaatttagtagagtatttgcatggtaatgacctatgccgtcagactaccaagctctgtcctttctctttccctttagctggttcttccccgtattgaatcttagcaccctgaacatatctgactttcttcttcttcttttggccatggaataaggaacttcagcttagctttttgtttgtcttctctttccccatgaagttatatgaacctcctgccttctttgtcaattttttttcagccgagagcagcttgccaagttgagaacaaatcattccttatggtccagttaactttgacccactggctgaaaggggattacatgacaaagtcaggatgatcaaatgatgggattggctcagggcaatagaatggtgaagtcaaagtgatcaaacatggagctgaccagaaccactcgagagccagggggctcaactggggtcttggggcaggaagctctgacctccagtcatccagtgtggtcagcattcattgaaatggagcagccaatcctggcataacagtaatctgtagctaccctttctgtataagggcattttagtctccataaaactggactcagagttcagctatgattctgatgtagggtttactatatttggagaaaacatatggagtgttgttgtttgttttgtttgttttgtctgatccaccaaaggccctgtttagattgtatcaggttatgctttcccaacacttactttcttccttcctttcccttgtggctttacagacacaaacaaacagcaagcagcaggcaggtgttctgtgttaggtcctagggatggtgctgagtaaagtgggtgcagttcacgtatcctttagctggagccagggtccctgctgactctgcacaccgcccactgggcacttgcaagtctgttgcactgacgtgtcttgttagtaaattcctgaagtcatagaccatatctgaagcatgtaggattcactacggcagtgagtcccagaaagtgaaggaactgggcctagaggaaggcagtggtgcatctctaggctcaggactctgctctaaggagtctgccaggctccaggctccttcctgtcaccaccatgctcttccttggaggtagctgtcatggccagtatttactgtgctctctatacccagtccatctgctctcagttgccacccaaaatacccagccccactgcctgcctgaaataaaagaaaaactccaaatcctttgccagtctcaagtggtgaagagggctgaatccatcatagatttgcctgtggcctctaggcagccctttcaccagtagccagaaggaggcagaaggagcaccaggcctgaggaggtgggtggcctcctctcccaggcctgagtcagttggtccacacccttctaatgggtcaatcccaggaaggtctgaatccacctgggcacctcccacctccacctctgtgcttggttcttccagaccatgaaggagcaggcactgtgattggcatcctgccttagggaataatctgaaagtgttgaaaatgcaaaggaaacagtgaatatagagtccacttccaggaagctgcccgtttaactgggagagaggaccaaagcacaccttcccaagaaaactggacttcagaatgcttcaaaaccaaaaatatgtaaggaaggaaaaaggttttgtggttaacagcaaccccaaaccatgtgaaatgccgaatgctattgcccctcgtggaaagggccagttagctgagtcctgcatagagcaccctgttgtgactctgtttacctacttttgcttaaacttgcttggccatgactccctttctccaagcagcatctctttatatgagctccagagacccactttgggaaatattcttccagatggatcttggaccttcctcctgcaaagaggtatcataggaacaagggggagtgaatgaaggcacccactgctatctttctaatctcccctcagtttaatcctcagccgctctggtttgtaaatttcttaatgataaagaggtatcttgagctacctgactctcagcatatttggtttccttgtccccacgtgcaataccaaaccagtgcgtggagcccgacccacgctggccttgggtcctcggttatgccaccttcttctcctttgcagtcttccaggagaccttgtccttgggaggatgctttcgccaagggaccgacctctcctctgctctccttggcccattgcgctgttcgcccttctctttctgcatctctttcctacctctgtgtgttgttctggttcccagggtgacggactgctgtttatcccctcagtaaactctgcttctccctgttggtgccgtggcaacctgagctgcttgctctacaaatcacagcccatttaaccgagcccttgtattagtttaaaatagtttttggagggttgtacttttttttcatgataataataattttttaaaaatcaccgctttgcttttttttttggtaaaaagtattgctttcctctgcctcgtagcttcttgaagggcagaaagagaataactccaggtgtgggctacattccaagggaattgtgtaccacttggtgctgaagtactgagttcccatacagggtttgccttcatcctgtgctgaaatccgtgaacatgttggggttaggatcaaagaaggggttcccgctgaaggtgcagggagagtgtttcctcttcacacgcattctgctaaaggtgaagtcagtatagatacgcactgggcattcacaccaggcaggaggaagattaggtagctgcatttactggatcatgtatagcatttgggatttgtgtgtttcccagggtggagatctgcttcaccgcagagactggggaaggtaaagttggaggccagcaataagccctgcccagccagaacactgaaggcatctcagtgagggtctttgagttttgttgtttgtgttgaggtccctcctaaatgatgcagcactttccttgaaaggtgggaaattgttgccatgatgagaagcagagaacttgaaaagtgagtccatgcgtgctgatgggatgagagggcccgtttttctgagcctgggacagggcctgcattcagggtggtttggacaccctcactcctttcccatgctctcctgtgaggctgcttgtgacctagtcactttctgtgtcgaatccttcctctgcacagcttctggggcgatctgttaaacccaccatcccagattcttcagtgctgttctgctgacccattgctgcataacaaaccactccaaaacgtggtagttgaaaataacagtttatcatgatctcttaactcttgtgcttctgtgggctgcctggacccagcttagggggttttgcctgggtctctcaggtggtcgcattgagaggttggctggacctatagccatctgaagacttgatggcccagatgtccatgacggctcacgcacgtgcctggcctctcacagctgctgtcagctcagctggagctgcgggcaggagcaactgcatgcgacctctctacacagcctgggcttctcccagcttgttggttggcttccaagagggagcttctgagaactcaagcggaagttccaggatcacttctgccacattctgtgggttagccaagttactggtgcctgctcagattcaagggttagagactggagggtcacactcaagagagcatgtgggatagaaagacagctgaatccatctttggaaggtgctgtctgcttcccatcacctacttccagctgaaagcttcagcatctaagcaaagctgtaggggcctttgaggaccaaaggaggcaaaccaaatatgtctccatccgaaatgaaaatagctttgttgagttccaatgggggggaaaatgtagagacttaacatttagatttcaaagttgttgcatagaaaaatgtcaaggagaagtttggtgctgcttttcagctcctgaaatcctgtcttcttggcttctctgagaagttcacgaagcttagacagcttggtaattttcatcctttccatgtgcttgatgtgtttagagaaaacagtgtgcgctcacatgcatgtcctcatttcatgttgtcatcatacttgcacagatggggaaactgaggctcacagaggcctcctgctttctcaagttattggcagagctggggctgacattgctccatctgcacagggccctgtttgtgtgtctgacctgacgcctccctgccgctcctctcttcctctagaaatacgaagtaggctctttgatgccttcctgcctctgctcacactgttcctcctctcggaaaccctgtccctaaacacacaccttcttccactcctgactcacgctcagccttcagggcacagcctaggaggccagcttgggcaggggtttcctaactgcaccctctctgcaacagcaactgcgtccccttttttcttcttcccacagtgaagtatttcatgcttgtctctcctctagtctgtaaaccctcagggtcttatctcctgctgtaaatgtgaactattatcagatgttaactcatccttgagaaaccgtttctgttcctcaccccttacctacaacctgtaattctaatattctggcagaattcaagctgcctgctactctggcagcaaaagtcttctgcaaaaatagatcacccataaaccaccactaaaaccgagccagggatttgataacgagttcaaaagtagaaattactttgtgttaatgagaaaccatattggaaagacttgggaggagcgtaaagatggaacgtgtcagctgttagatttaaaccagatctgtttccagcattaatatagagaattcatcgtaatactagttaccataaataatttttaactgcatatgtattcggtagatgcatatttaaagtaaaaacatgaaaaaggagatgctgttttcgtcacttttttttttgatctgcactcacctgctccaggtgagaacttgttctaatggcatgtctggatcagggccagcaatgaaaaggttagaccctgggcttggcaccagcttatgcagcagagacattaattgtcatgtccagtcagattatgctttttccttccattctgaatgttgcgtcttctctgacattgtatatccacaccttcattctcccatgtgaacagagcctcccacaaataaataaagttgacagtaagaactgactggattaaacaaaagttaaacaggtttctttttaaggcaccaggaactatagaagacctacagaaacaggaatgctgccatccttgtgccttgaccttgagaatcaacttgggtttctttctgattgttactagaatgcttcctgaattcacaaacatgttgtacttttattgcatggcatctcagagcatcttaaagcaaaggttttaattaattagaacaccttgtgagtcttcaactgggaggagaaggcaatatgacccaaacagatttaaccacaaacccctgccctttgctttcccctcacaaaacactttcctagagtgatgctggagtctgtctgtaacttcacagtgagatgtcttgtatgacaaacataatatgtacgaggtccacacagcaatggggctcagtacctggagctttggaggcgaatacacttgagtttgagttcatttcttagttatgcaacttactcgctcagtgatttgggacaatctttaaaaatctccctgagacctgattttcttattggtcagaagagatgacgatgtgtatctcatggagttgtgattattaataaagaaatatgtgtaaagagccttgcatatgatcctggttacagtttcttcagtgactgcagaggtagtagtcagattaaatatatcagtgagtcagacagagaaattagatgtcagcctgttctttatgaagcttgctccttttcgccgtgcgtttcctctttttaataaaattggtgattacatttgaatcaagttttttaatataaaactcattaaaggaagaatgtgtctcattatctttgtatgtatctgaccatgagtagttaataaatgtttattacatttagtggaaagtttttaatattaaaattaatgtgatgtctatatctaatgcaacagactgttctgtcagttattaaacgatggaaaattttagtgcattttttggggaaaaaaagttggtgtacagttgactttcattatgtgtgagagttattctctagaaattcactgcaaacactaaaccattgctcttaggagaaatccagggttaccttcttgtgagtctctggtcaaatcatttttgtcatttttgcacaaccttgttttatgtgtgtttctgtttaaagacatcgtatatgtatatgtgattcattaacattgaactcaaggcaaacagcacattacgcatgcctgaatgaagcttatctaacacacatagtctctccctgagtcatatcacagctttgttgtgcttagaaacactagacagccccacagtactatacttgggggtcattgtatacagtgaaattaccaataaaaaacatgacactaaatgggctgcggagagcacactcgattatggtgtgagagccgaagcaagaaggcagctgtttgacttcagctaggaacgtgtgcagcagcctctccaattttccacgatcctctccaattttccacgatccgtgcatgtccacaagtgactgtgaaagtgccagaaatattgacttggaggttacaaataaattttatgcctcctgcagtgactcatgcctgtaattccccgactttgggtggccgaggtgggaggactgctttgagcccaggagttctagaccagcctaggcaacagagcgagactctatctctgcaaaaaagaaaaaaaagaaaattagctgggtgtggtgatatgctcctgtagttccagctgctctggaggccaaggtgggaggattgctcgagctcgggaggtcaaggctgcagtgagctgtgattgcatcaccacactacagcctgcgcggcagagcgagaccctgtctcaagaaaagaaaaaaaaaattactaagtaggtgaattcaccagtacaaaatccattaataataaggatcacttgtactgctttatcaaaattaaatgtcatagcatgcaaagaatttctcttttccagtaaaaagctaccttcccccatccattgaacagccccagctgtattaatggtaattaattaataatgcagccatccgtatcgttgttaattactgactggcctcagtgcatgggtgtgaggagggggcagaagggacaagcgcccccagcgtggttgtggcagtggccttgctgctttatgtgcattcgctttgctccctggtctgtctgagctcgcccttgaagctggatcatggtattcctctgagggcacacgatttaggaatcctcaccagaaaagtaaacacacaagctgtttttttaagttgttgttgtctttggggaggcagaggttgggtgaagaggaactgtccccccaaaggagtcccgatccagggtggaaagcgggtccaggcccagctgcccaggaaggaagggatcggagcagcaattcaccaacagtccaattcaaattagacctcacaaagcaaactactctgattagggaagaattgctcctccaggagtctgtcctcacagtttgctggctgcctgaggagactgtgctatggaaatgccctacaggcttacccatcacacacaaaggctcccagaggcccccaggtgggcctggctgctggcactttggctcagcttgtgactctgagctcccaaggccagggccagcctgcctgagcagttataagtggcaacacaccctctgggtggggacaggcagcaaaaggaggaagggagtgaggatttagcaatagttgtatacatcgttagcacaggacagccctgtcatgggcttttttttttttgtcctatgagggctcttttctctctggcagtcatgagaggtaggtacttggggggtaatactgcatcactgtgagactggggcaacagtgtgctgatgaaaataactccagttgtcgcagattaataatagctaacagttactgaagactccctatggtcaggtgctgtcctaaacacttcatgcgctcatttcatcctactccctccaagacaggcacttattatgcccactctacagataagaaaactgaggcctagagtggctaagtcctaaataaaccttgggttacacagctggcttctagccgttacacaattctgttgaactataatgcagaacactttgtctaactcctcgggttctcagggttatagattcaggcgtcagctgcagcatatgtgcattgtgcatggactacatgaagtaggtctgcacccagggcctcaggagatgtgaagatgagcctggcagccctttgtcccccaggcattggcagtctgggagggtgggaaaggcaagaatgggcagaaaacagcaggtgcccctgaggggtatggggtgctctttcgactcagggatatggcagattggaggaaagggaatagattgttaggggtgtcagggaagaatagggaacggtatcttaaaagaggtgacattgcagtaggtctagaacaagtttcccaagctcattctagaccctcattttactctctgcagtcagggttagccagtaccccagcatccacacagagccttcctacccaccagctcttatcccctcctcaccagccagcacttttcgtatggggaccctgcagtgtgagtgagggatccattgtcaggtgacagagtccattccccaggttttgctgtaaacgaaggcaccacagttccctcgggcatgagcacacatgacattcagcacctgccttcatcctgccatcagggctaacctgcctttacttaccatcttcccataaataaaatggagaaacttccaatatagaacatttggaggtgaaaacgcacgtggaacagtttttgtatctaggcttgcattgaaattctctgtgactctcctgccagaaggattttcttttttcttttttttttctttttccccctgagacggagttttgctctgtcacccaggctggagtgcagtggcacaatctcggctcactgcaagctccacctcccaggttcaagcaattctcctgcctcagcctcctgagtagctgagattacaggcacgcgccaccacacctggctaatttttgtatttttagtagagacggggtttcaccatgttggccaggctggtctcgaactcctgacctcatgatccacccacctcggcctcccaaagcggtttttctttctctgtctctctgtttctctctctctctctctctctctctcagctttttagttttgaattttaaagcaccatgattgaaactactgagtgtgccttgagttggaagtctctgagacaagttgctttggccatgtgtgaggtatgaatgggcccagcctctggaactgtcagcttggttgttggttggctgggctgggctgggcctccctatcctgggtccttttgaatctgcctggtggggacacaataacatctttgtaaggaggggcctggactctaaaggaagcagctgactgtgttttgaattcaagctcttttccctcttctctccgtatgccccatctctgccaccctccgccccacaatagagggaaggtttttactcctcagagaaattggattttggttgtaatgaagtcattacatagaccccgtaattgtttaaggtagcgagtttacaggcagtcggtgctggcattccagtgtgatttattcttcagcttctcagctatcctgctgcagggacaaagcgggtattaacaacctgtcatgcaaaaaatttgacacggctataaagataatccttctctctgtgttccttcttcactggcctcctactgctaaagtaaatgagtaacgttttaaagtatccattctttaacatcaaaatattatccttaatttgcttttctctctggcttttgtcttcgtgtgaggataaagccagctaaaaatacctgtgataattctttacatagcagttatccagcaggtaccaagaaacatacagatcctgtgatgggtgaatcgacccttccttgggcactagggaagaacgaagggcaccagcatggggccgggagggtctttccgttgtgttccgctgactatcagtggggcctgtgtacctctcaccgtctcacgcacttactgcctaccccttattattttgagtcaagttctattattacagtctttaatatatgggaaagggaatctggttatttgctgtgatgtttaaggtgctttcctctgcaagaagtagaaaacccatcaaactgacttgagccataaaaggaatttattggcttatgtcgctgaaacatcacaggcagatggtttcaggccggggctgatccagtgactccatggtgtcactgcagacctggtttctttccttttactggctctgcttctgcagtggttgtcttcaaactaagagtggctctcctcatggtcccaagacagttggcagcggctttgaggggggggttctgtcacactcaaaagagaaaagagtctcagaaagcctgtgtctctgcatcctctgaagggtcttacttggcattgtggtcaggagaatggagtggactgattggctcagcctaggtcacatgatccgtatttacagttgggggtggaatcggcttccccaaaaccacaaagatccctgggtagaaataccttgagacgggaggagaggggagataatgctggagaagtgaccaacaaatatttggtacatatgacttatcagtcgcttaattataaacaaaataatagacctttttctgttctgtgtatttaaattggttaatattggtgctagaaatatgttgttgaaggcaggacttcatatatatttttttttaccgattccctggtctcaatccctcgtttttcaggctcagagactagacgtgcaggaaaagagtttgctggaagtgaggtcagatcacagagctccttgctgctgtcccaggacctgaagtgggagggaaggaggagaggacagaaatggagacatgatcactctttcaataaaatatactttaaaagtttatattccttgcagcattatttataaagaaacaggcttagtgtaaatgaatgatgataagaaacatccctacctaatttgttactttccacaattggaactttcctattcacagttctcttgtccccctctgcaccatgccacatcctcactcaaatcctgttttttttatgaacgataaagaatcctccatcttctcttttcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactgtgagtgccgcctgggccaggctggggagagggtgtggtgggcgtcagctggcatcttcgttccagctggaccacgccacagcgagcccgagagagggatcaggaattggttctgctgtatgaggtgtgtgagaacaatgccgtgctgcctgacctgaaacccagctgcagggatctagaacaaactctaaagagcaactcccatcactgtggttccacccagtttgcaagagggtctcccagtcttgcggttcaccactttctggggttcatctttgccgtgagcacatctgttttctgagtttcctgttaagcttcaagcatatgtccttctcccctctcactctattcctttcctctctctgtttgtttttctgcctttcttcctctgttctctttatctcttcccccatctcttccccctccatcttaaatgcacgaaccccatttttaactgttaattccatcaacactaattatatgaatgggtaaaattgagccagaatcactcaaaaaggacttgtttttaaagcaagttgctgattttctcaggcaagccatgcccgtcggatgttattatgggaaactgattgcggcaggttattctgtggcgtttctcatctccctctcccacccctccagtccccagcttcctgcctgctgtgctgagtggggccccactccctgtggctgagtccatcagcacatgctggcgagagaggacaggaagccagcttggggcgcacatctgctctgtctccgggcttttgggatggaggcgagatgtgagtgccttgagggaggaggggcggatggaaccaaagaagatttgaggacaaaccaatcctcagtggctcgtagtgatgacaggctccatccattgaattcagcctcttgaattcagatttgcccttttgcccatccaacagtccccttctttgcgatccaacggcctccttctttgcagataccttaggggtaagaagagattttcaagaccagaggagaaggttggcagagctgccaggccagctcccaggcgccaccctgcaggtacctccactttgcaatcccaggtgcctgcggtccccacagcatcttgtctcatcactgggatttgggcacatttctttatgggtctcagctacaaatttcttaaccataaaatggggttaataatatctcagatggtttatggggagataaatgagataagaatttttaaatacctaacactgtgctggttggtagatgacattaatatgctccctccctcccttccttcctctctctctttcccttccttcctccctctgtctctccctccctccctctctccttccttccttccttccttcccccctccctccctctctccctctctccctccctccgtctccccttccttccttccttccttcctccctccctccctccctctctctctccctccttttctccctccctccatctctccttccttccttcctccctctctctccctgtccctccctctctccttccttccttccttcctccctctctctctccctccctccctctctccttccttccttctttccttccttcctccctccctccctccctcctttttctccttccctcccttcctctctccttccttcctccctttctccccccttccaaatcagcagttctcaatcttggcacaagtgacattttgggctgaatcactcttccttcaggctgtcctaaacattgtagaatgtttagcagcatctctggcttctacctactagattccagtagcactcttcccccatgttgtgacaactaaaaatatatccagacattgccacatgtaccctgggggcaaaatctcctgcttcccctgtaccctcccaccctcgtaactgagaactctggctttaaaggaagaacagagctttaaggggccaggagattaaggacttgcttagggtacaacagaggaaaaaggacaaatcatggtgtaatcctcactgtggctttatgtggctcctgggagacagcagcctagagtgaagatgggggctggggaaccagacagaactgggatcaaaatccagggcaaatcctttcttgtctttaagcctacatttcctgccttaagacagtgcatacaaagtgcctggaaaaagaaacataacaaatcacaactattctgccttttcagataattcccaggttgtgcccagtgactcaagaatgccacttatcctcatttcatactaaaatatttgagcgatgcctatgagtcactgcccctcttgtgcctctctgcgtgtacatattgtgcattcaacatctgttgtctgaccccaattcatagatagttcccattaggtgcatttactctgtgcctaaattgggtggcatacaattatttttttttaccatttgattatgtaaaaattttatttataatacagcaaatatagtgttggaggagggttgtgtcattctatgaaagttaacacatgtaaatcatgtaaccagcagtctaattgggactcagaacagttcccatacccctacatactccagtaccccttgtattaatactaccccttcatgcctgccctctactgcctaacccctggcaagccctgagctggtcttcatcactgtttgtattagtccattctcacactgctataaaggcagacctgagactgggtaatttgtgaagaaaagagattcaattgactcatggttctgcaggctgtacaggaagcatggctggggaggcctcaggaaacttacaatgatggcagaaggtaaaggggaagcaagagccatcctcacatgaccggcaggaggaagagagagagaagggggaagtgctacacactttgagacaaccagatctcctgagaactctatcaggagatcagcaagggggaagttcacccctatgattcattcacctcccaccaggcccctcttccaacattgggaattataatccgacatgagatttggatggaggcacggagccaaaccatatcactactgttttgttgttttgaaaatgtccagtgaatagaatcatacagtatgcaagtgtttgaaagtagcttctttcactcagcataatgcattggagatttgtgcatgaagagtgagtccgtttttattactgagtagtatttcattgtatggattttttataaaccattcacccatttgggttgtttctggtatttgataattaggagtaaaactgctacaaacattcccatacagacttgtgtgtgggcataggtttttatttctcttcagtaaatacctagagatcttgggattgctggatcgtgtagtaaatgtatgttcaactttatgagaaactgccaagctgtcttctaaagtgagcataccgttttacagtccctgcagcaatggatgagaattccgattgctccaccagtggggctctgtactgtttttcaattgtaggctttctaatagttgcatcttggcatacagctttacattgttaactgcatgatgaccctaaatgaaagctgagcgatctcactaggaacagcttttagatggagtgagcgggagggcccttaggagctggccacatccttcacagggctagacaggtccctggttatttgctcttcataaattctagtgtcccctaggagctgactatttttgcctcttcaccacccaggcatctgaggggttgtgatggttaccttcatgtgtcaacttgactggaccatgaggatcccatatatttggtcagacattattctgtgaggatgtttttggggtgagattagcatttgaatcagtagactgaataaagcagaacacattcgggaatgtgggtggctccgtcaatctgcgggaggcccgaatagaacaaaaaggctgaccctaagtaggagaccatttttcctgcctaacgtggctttgaactgggacaccggcttttccttgcctttggacttaaactgaagcatcagctcttcctgcgtcttgagcctgatggcttgggctggaactacaccagcagctctactgagttgccagcttgccgactcacctggcagatttggggacctgccagcttccataataatgtgagcaaattcctatatatgcatatgatgcgtaggatgcatatgcacggtatgatgcgtgtttctctggagaaccctgataatacagtggcactaagtacctaagaacagaaagtgcacccttactattatcttggaagtctgtcccattttttatgtatttacgttaccttgaagaggtgtgttataattttttttctttttgctatacttgttttggaggttatgttttataatttttaatagactattgaaaatattaaatctgtccaggagaaacagtcgtctttgcctttgagaaaattatcatcctaaattctaatgtctttaacagaagctttagtcatcagtgacagattccatttccacttttctttcttaagaatgctgaagtacaggggtggttagggagagaatcaaaatgaagaacttgtcagaatataaccccaggaggtaatagtggctgtgtgtctgaatcttctggttcagtagtttccgtgtggatatagtttttggatttactgctttgacatgaagtccacggcaagtcgaacttcctctgagggttagtgatgaagcgggtccccttgttgaaaacttgtgcctgtctctaccttatatatgtgagttctgtcctccagactccatgcccatccttcccactgaaataaacatcccaaactaccccttctcttggtatttcatgaaccactgccactgacccaaaaaggtatctttgctgtcctttgtacagaaactatttgggatctgcattaatggtgcagttgtcaaatcccagtccaggatctgccctttaccatttttgcaagcctgaaagtcgctttaaaggcatatgtttttcccctacttgcttcactggagaatcattcacagaggatctgtcattgcagctcagcatagcatatacctgaaggaggcaaatgtgatttcttaaaatcacgatttcggatttcatgtcctccacgtcccattgttctctaatgaagtcgtgccaataccaaaatttcttcttactgtgttgcagctcacccacacatcatcacacgggcaagccactacaaaactttcaccttcagtgcttgaatcgtttcataactcgccttgttatctggtgaagggcgaagccaaactcacagaacttaaagtcgatgctatttctaaagtgtgtggcattgttcctcagcagccctggcttctagctttccattcctaaacttgctgctcagaaacagctaggtattttggtctgtggatagttatgcatttttctgtctagctgttgtctgcccagccattgttcaaacccaagtgcccttaggggctaggcatacaatgtaaatgaggatggttggcctccatgaagcctcagtgtcagggatgcaccagccgtggagactgtggcccactggagccctgaggccccaccccgaagggacagccaccaatcagttgattgttcctgtgtgtaattttggattcagtgttgtcagctcttccagttttttcaggaaaagtctgtaatctagatttttaatattggcagtcagttcatagtattcacgaacagacaaaataaaacatctgaagattgtgtgtcttgtacacaatccaaattctagcctgttttatgtaagcacatactttatctagcacatactttatctagcacatactttgtaagtatgtgagcacatactttatctagcacagacttccaaattctagcctgttttatgtaagcaataagttgatcactactataggagaagtaacatgagaaagactgcctcaaagggttagtgattctatgggaagggcaagatgcacacttagcattataaaatgatttttttaaaaaatatacagtttaaaacagtggctcttaaactttagcatgcatcagaattgcctgaagggcttgtttgactatttgacaggcttccagagttttgtattcagtgggtttggggtgggacctaggcgtttgcatttttatttaattttatttttcctagagacggggtgtccctatgttacccaggctggcctcaagctcctgcactcaagcgcttctcctgcgtcagcctcctgagtaggtgggactggggtgtaagccactgggcccagctcagaattgactttttggtttttttcttgagacagggtctcattctgtcacccaggctggaatgcagtggtgcaatcatagctcactgcagccttgaactcccgggctcgagtgattctcccacttctgcctcctgagtagctgggattacaggtgtgtggcaccacactcagctattttttattttttgtagcttcagtgtcattttgttgctcaggctggtctcgacctcctgggcttatgcagccctctcaccctgtcctcccaagttgctggaattacagttgtgagccacaacgcccagccagaatttcaatttttccttttttcctaaccttgaaagccagaatttccatttttaacagattcccgggtgatgcggatgctgctggtctgggttcatcttttgagaggctgtgctccccaaaaaggatatgttgaagtgctatgtccctgtcttagttcattttgggttttgcaataacaagaccacagactgggtaatttatagagaaaataagtttatgtcttacagtgctggaggcaggaagtacattttgctgcatgtgatgtgagtcttcttactgtcataacatggcaaaaggcatcgcgtggcaagagagggcaagagcccactcccaggagcccttttttaaaggtactaaactgacccatgaaggtggaggagcccttatggcctaaatttcttcttaaagtccctacctctcaacactcttacaatggcaattaaatctcaacttgagttttggagaggacaaacattcaaaccgtagcaccatagtatctcagaacatgacctttttggatatgagattgttttagatgtaattagttaagatgaggtcatactggaatagcacagagaacctaatctgataggactggtgtccttataagaaggccctgtggagacagaggaatggagtgaagcatctatacgccaaggaacctgccagaaactaggacagaggcatggagcagattcatcctcagatcccttagaaggaccatccctaccaacgtactgagttaggactgccagcccccaaaactatgtgatagcaggttgttgttttaaaccaccccatgtgtggtcctttgttagggcaggcctaggaaactaacacagaggcaccagttaacagaaactagatttcctggactgggagcctactcgcatgttgatctaaaattctataagcaagttagaaacaaaacaaaacataatgcctaattatggtaatgccatcaggtaactgcaaaatgacgcaatacatacatctcactccctgcagatagcctgagcagagaaggattggagcgggggtgggggtttggagtctaacataagataaggaagaaatggacatcaccaggttctggcctgcttcaggatggtcacctgagtagctctggatcacatgtctgaaaggttaccatgttaagaattataaagtaaaagtgctaagatggccaagtaagtattggcatggtggattgttccagagaaatcaagccagtttggttctccaatcctaaatgtctccccttatttgttctgcttccatttcgaagcacatctttaaaacagagtaaccccatttagctttctctctctttctttgtgacaggaaattccatttaattagtgcagtctgctatggttgtagccaagtgcagggcgtggagtgaataatgcattttttatatttaaaaaggtaaattttgctgatttttttaatcatggtaaaacaacatacagtttaccatcttaaccatttttaagtgcacagtacagcagtgttaattctatgcatattgttgtgcaacagatttctagaaccttttcgtcttgcaaaactgaaatgctgtgcctattgaacaactcctttttagctctgtgttttactttggctaagttaataatttctggaattcagtttgcccatcacaaacaactgctaagttgtattcaaacatttgtgcaatattaggtcactttatgtaggatcacggttcagttggctcactctctcataaccaaactgagatgcaaaataatcagaatacaaatacaactttgtttttcattgtatgtcagcgtggtgcatgtatgtagacgaacacatggtgccttggtcagcaagatcagaatcgcaagagcctttgaagaaacacatgcagtgattaaagtgatagtttcaaaggatcttaaaagtggcaaaaattgtacagagctgaatgtggtggtcgggacttagggaagctgataaatggggtgtgtggcacagagcccttcagtctccctgtctctgcttctctctgggcgctcacgaaccacaatagcacacactcagacttcctcaatgcgttcttttgctgccacatttgttctctcttttctgagctcgagccagctcttttgactttttgaacttttgtctttattcacaaaggtaatttcaagagctcttgtgggttccacttctggcatcccgctcctcagatacctactattaggcaagagcagagaagtaaagtgcatttggcagcagtctctgcctttcaaagcagagctaaatcatgtaaaataggttattttccatccaggcattctcttgagaaagaaaaccctgtgtgtgtcttcccccatactctcacttcttgccagttcagttgaaaagtgttcccttaatgttattaaataggtattttcactcactgaagtggattatttgatttctgcacggtcttaagaaaaagtgagacaataggagtcttacaaacaaaccctatgtggtatctgtgagctcatagatctgtagtttttaggatatagtcataactttagtatctgccatgatgttctccatgctgaatacatgagctataagtaatatttggaatctctgtttatctccaagaaagacccatgatcgtggttaaagtttgggaaactgaggcaatgctgcttagtcacagctccaggcaggtgactattcttagactccttcccagggactagactcttctgcatcactctctggggtggtgcaggtcctgcaaattgttcatacttcctcttagaaactctccctgatctcatatcttcttcttcctgttttggccaactgcttccccaacctgcacatcaagcgggtgtaatggaagagaactttgtggaattgcggctttagctgtcccctcacaggtactggttttgcctcttgcccagttccctctcttcgctgctccagtatgttccccatccttgtcgtgggctccccggcactgtggctgccgccatcctggccaggcagctgcctctctccacccagagccaagtcccttccaggccctgggactgcctgtttggtggtcaggctccactcaaaccttccatttggctttcccccactctggtcatacggagtccacatccaggtcttgctgtgcccagaattctgggatggtgactggagtgagggttggagacaggcagccggggatggttcgtctccagctggtactccaagacggagagtgcctaggccacaggtcatgagagcattgctttattagatcagtatctgcaagcaggtcagtgacagtcttcccaagacgtccttgagcccctcagagcatccccttctgcctcacgtccttgcaaaatgtggtttaacaagcaaatacttccaagaacaacctcatactgctttttcctcctaatttgtatttccagataaccaagtattacctcaccttcttctatttaacaactctttatttccctgtgtgtaacttgtttttaatattgtcaaaattactgcaatgcaaatgaggaacatcagggatccagcgggaccgctgggaatatgtgcttgttccgtgttgaaatgtcagtttcatttccagcctctgaatgaaggcagtgaccgagcatggctactgtgagatgcaaacactattcaattaacagagttacatagaaatgggctcaaggacctggtcttccctggacgacagaagtgtcattgacgtttcccctaatattttgataggaaaattcaagtagagttgattatttcaaaaatgtagggtagaacgttcactacttttaaggcacttgcacttaggcatgggtcttcccaaactgcctgaagagaggatatggttaaacaactgagtggctttccttggaggaaaagggaaactgcccttcactttacctttctgagtcagccacagtgggcgcctccctgaaatgatctcatttaatccttgcgtgcaactctaggagagtggtgttaccaccctgcaggtaaggaacgctgtgccccctctgtccacatataggtcacaggagccggtagagagatgctcattctcagacagtagcctcttggagagagaattcttttgtttgagttttctaagccctaggattctgctaagccactgtaggattttgcctgcaaggccccattgtctgtgggctggttggccagctttgctcttccttcttgagagtgactttcacattccagtggttctggagacacatttgctcctcctccatttgaaagcagtgatttagaagcttttgaaagccaacctggcctcccagggcccctcacctttctgcttccttctctagcgtggctgcattgttcttgcccctcatttcttagcatttccatgaagttgggggtgggcagaagatgttctagttttccagtgggattgctgaagcctaggagtgggatggcttcatgggggctctggtgtgatagtggcatgtgcctatatgccccttgcatatgtttctttgagggcaagactacgtcctactctggcacccacagcactgaagactgtgcttggcccaatacatggatgtcaagtccagatagagcaggaagaacagcaggatctgaaaaagagtcacgtgtggctcaagaaccagttagttgaccagggagaaggacagttttggggggaaacgttgatttacttgcatgagcttcagaaaactcttgactgagtttcctaaagagcaaagtaccccatcctcttgagtatcagggtttgggtcagtttgggtcctaccaggaaacagacggcccacacaaacagggaaatttgagacttaacaaacatgtgtgcaaggtttggagaacatgataagtgatggggaagcaccctctgagaatggagctgtcatcacccttgggcctgaaaagtaaaacaggggagtggtgtgaggaccctggaatggataacttcctggagagcactgcataacacaagctgagcctcagtagagggcctcagccaaatccacggccacatggctggaaactgttctccttttctgtggggctacctgttggccaaaccaaactagtgtcctgttttcaagggaaccttttgattcagtctctatgagcagcctccctaaacccagaagtggatgtaggagattggagcatagatctggagaggcagggagaaagtaacttcactctgggttcaaagagatttgtcttggttctctagtccagatgacacttcagtcctgatgctgtagctaagtagttacaacccaaacttcccggtgtcccccttccccaatggcatccttccactgaaaaatgcacaatttgtcactgcatagttagggtccatttgatctcatgccctcttttctcaaagactttctgcccatcagaaattctttaaaagggagtacatttttttggaagcatgatccccttttgtttttcctattttccacttccttattggaatggggaggtagagacatggagggtgagggccagaagtcttggctctttggcaggtgatagctttccattgccagggccacttgcctagcaggaaagctcaacaccacctacctcttctaccccttgggtgccacatccatctcagaagggatgcgagtggtcttggtgctccttgacatccacgtttataatggatgcaatgggaagagttttcctggagacaggacgcaatccatactcactcccttctcttccttgactctcattcccccttcagatcactttcatctaccttccatttccactactgccactgaaagggtgctgccaaaactttcttatatttattgcaaagtgtattaatttgtatgcagcccatgatactcaattgtcacctcctaatcaattggtaatccctacagatgtgtctctaggtctctctggagccctacagttgcttctccagtggcctactcgacatttcctccaagacgggtctccccaggtacctcaacttcacgtgtcttaaactggactcatagcattccctccatagtccctgctcccctctgcttctctagctcagtccatggcatctgcatcttcctggttgctcagactgggaagcttggagctctccttgcttcattcttctcccctattctccactgtggcacacatctagtcttccgtgatgtcctgcaggctctgccacagaaagagcttctgagtcttcccttattaccattctcttactttggccctggcccagaatctcaagaattcttcctgaattattacagcatcctctagtttctctcctgttgagctcacccctggattcattacaaaacagctgcttctcttgctgaagaatctttggtgaatggcacatgaatagatgctcaatattattagtcagtaggatctataactcagaagcactgtgagatggcgcttcacacccactaggatggctctaatcaaaaagacaggcaatctcaagtgttggtggggatatggagaaattgtaatgctcaaacagtgctggtgagaatgtaaattgttccagccactttgggaaacagtttgtctgttcctcaaaatgttaaacgtagttttcataggactcagcatttccactcctcagactgtacccaagagacatgaaaatatatttccacatgaaaacttacacatgaaagtggtagaagtattattcatactagccaaaaagtggaaactaaccaaatgtccctcagctagtgaacaaaatatggtatgtccattcaatgggctgttacttggcaaggaaaataactgtgacaacatggatgaaccttgaaaacatgctaagtgaaagaggccagacccaatagaccacccaccctatgattttattgacatgaactgtccagagtaggcacatctgtggagacacaaagtagctgcgtggctgccgagggcaggtgggagtgtggtgggaaagtagggtggctactcatggacacagggcttctcttgggggtgataatgttctaaaattagattgtggggatggttgcataaccctgaaaatactaaaacccagtgagtggtacactttaaaagagtgaattgtatggtgcgtgaattatatatcaagaaagatttaatcttggatgactccctcctgcccgctgaatgaggtccatgattggtagagtggtgcagagcctttgaacctgtgtccaggcccctccccatattcatccatgtctcttccaccccactttgcctctgccctgatgctccacccacagagaatgtcttgccattgccagatcacacctgttcccctgtagaactcctactcatccatcaaaacccagctcacatgtcaccctctctggatttcctacccactccagttaggtttaattgtttttgtacttgtgttttcctcactttttaggcgtgtgtcgattatagcacatactgtactgtattttaaacatttatgtgtctctcctgcagtggactgtgagcttcctgaggatgtgccagtattttactgatttatttttctgtgccaaccttgtaggagaggatgtacatgctagcacactgtcagtgcccagtgaaagtggttgaagttgaattctgtcagggagactggctgggaaacaacagtaaggactctgaggaaccgcaatgaggagctttttcatggcaaggacagtggggtgaagagaggaaacagagccacaggcactgcttcccgaaggctctgccttgcacgtgacctgccatactctaagtagtcctctctcatgagaacggggcagtttgtcagcagggctgatttccaccctgggcctgagaggattgagacgcaggaccatgtgttcaagctggatgcatgggatgggaacgagctcaatagaaggacagtcgatgggactccacgggacaggcattgagaacctattatatggccggcattgttatgctagaggccaatgacagtcagaggtgggcggttgaaagtaatgctgctgattgtcgttgtcatctggtagagtcatgcccatcacgtaacagctgccaatgcatatttctgcaaagaaggaaagaaagccgatgagctcttcagaagatgagctcttcagacaatcctaagtctcctttacccattacagcatcctccatggcactcaccccaatcttactctggcatgcatgggcccagacagacgatgctgttgaaaaggagatctgaacctcatctgctctccttagaggcctctggtgggggcagatctctgctctcagcccctgcttccagcagagcggggtttcaggccaccctctccctggccctctccccaggtgggcggtggagaccctctgctcgtgcccctccgctcgtgcccctccttggtctctgattccctctcctctcagggccaggtgttttagagctcaaagagggaaactgggatagaaaacgtgtgacagccttagcacctgctgagtgaattccagctctttccccttttccatcgcttcctcctcctcaaacccttcttccccctcctcagactaagggaagaatcgctctgctctatgcctgttaaaattgcggctctccatgtctcaaggtggctaaagaacaggcagcacatccttcggatcagctgtgtgcctctgatgggctggtggtcctctgtcctgggatttccaggtcatggaagggcagggagaattaagcccagtcaagaaggaggaagagaaggagtagggggagggggagggggagggagaggggaggaggaaggggaggaggaggaccgggaataggacagggaggaggaggaggaggactgggagtaggacaggtaggaggaagaccaggaagaggacagggaggaggaggaggaggaggagctggtggtggtctgtatttccctggataatagccttcccttgttttcaactagcccaggcagattgattttggaaaaaaaaacccatctatggctctccctgcttggtttactctggccgccttttgttccagtgccagttataattacccaggctgaagagatgcctggaggcccctgcttttccgtttgccccacttttgattggcctaattatttctgtgggtctccaaagcctgggctgaagccattaaagcaaccagagacttggcatgtgctgcggccactctggctgttaagtgtcttgtttctctgtgcctgagcactttctttagttccagcccgggaatctccatgtgtccactggaggatggagctatagtttgtctgtcaggcactttcctttctaccctccctcctccaagtattgcctggagcaaggattccctccctttcctaccctgggacagcatgcattggtcatgaccacttactttgagtgctggggtaaatggctgaggttgtttgtggctggagatgatcacctggaaggtccagcaggatactccagggccccatgcaatacccaaaggtgtggggagaggcctgtgcctctacacacccacatcccgtttacagcgacccggttgtcaggctcggccattgcactgggggatgccgtgcccagaggctggtgggcttcccacctgcaccacctagtccagatttcctccattcctgtagccatctgcagtaagcatttctgcatcttccagcctccctggccttcccagggaggaaagagtcttcatcgtcttccttgtgtgtatcactcccattgttggtgtgccattttctgagtattttccagactctgtgtttctcttgaaatctagagctcagggtggtctgtggtctgcagttctttggatgttgaacattagggagtctgcctcttgctttgggtttgaaatcaattgcattcctgatgcaggcagctgaggatccactctgactctgggcttttttctctcatgctaatagtttctcatctgaattcgtttttaacttcacctgaagtggacactgttgagcacccctctctaccctctcctgcctgttagaactgtggcctgggtgactctagaccctcagcctctcatcaccaatccagtaatctgcagttcccccacatccacactgggctcggtagagcctcggcaacatcagagccctttttcacacgttaccacctctctccaagggcatcctttgggcccatggaatgacttgggatgcacattgagccaccattctagaatggctttcatgctggctgccttgcacttttttttttttttatttctctgagttgatggcctctaccattttcatttctaaaaggtctctgggaactttaacaaattctgatttcatttctttggagtatttttatggtacctcccccatccatttctctttcccatgcgccctcgctccctatcccctgtggaaacaaaaatgcaagcagagaatcagaaactgagccaatgcccagtgttggggtaggaggctgtggtttctgtgaatccttcgtaggtgtgacaacctcctacaccagacaccctgcagggtgtgagtgtcaccctgctgcctgagcagcaggctccggtacctcacaaaacagcactaaaggttgtcttctcctgaaggttgtctcttacaaaccaagtctctgaaccaagagcacattttcaagaactccagtcattttgatgtattcagtgggtagagggaaggtagattctcttccctgaaaggggaagagaggaaaaaaaaagattgcttttggtttgttggcttgttttataaatgcctccttatattccacataatgcttcctcaatttaagaaaaaaataggctgggtgctgtagctcacgcctgtaatcctagcactttgggaggccgaggcaggtggattgcctgagctcaggagttcaagaccagcctgggcaacacggtgaaaccctgtctccactaaaatacaaaaaatcagccgggtgtggtggggcgcacctgtaatcccagctactcgggaggttgaggcaagagaattgctagaacccgggaggtggcggttgcagtgacccgagattgcaccactgcaccccagcctgggcggcagagtgagactccatctctaaaaaaaaaataaataataaggactttttaaaaattccatgtcaagctgagaactgcagcctcctgtttgaaaatccgcgcctcagcaaactgccactcaatcatttggccctgaatttgagcatgccatcatttgagtcagtgggttgggtaatcacataaggggcccactaggacttgaaagcacaattgtttattatgctgtgctggtaatgacttccaccttcttaacagctgagtaaagtggtctggccccacatcctcctgggcctgctggtattaataaatcatggtgcattttcttttcaccaatccagcattctgtttccttcttggatgctaaaagaaagtcatggttttgcttttttcacttatgaatgaaagtgattacattaaaaatcttccttttccacacaggctggaccttaatgcagcttcacagattagtctttcatgcctatggaagaccacatttttgaggctagagaccttttggggatcccaaagtatttccaaatgtggatctttcttttcttggcacagttggcagagctaacaggtttggtccctcatgcacgaggcatacatccctgaaacataaggtttttgtgctggtagcgacagtccgtccccatcatcaagcaggacacaaaggaactggaataaaattgcctgttaattttaggagacattggggaccgggtgcagtggtgacgctatgggctagagggtgggttgggagtggaggtgtaagacaagatagtttttatgaaaggttctgggttcctgagaggaagggattgtgccggggatcgagctaacatttcctgtgcaaggactgtgtgccatgcccttgctcataagtgcctttcatttgagctcatttaatgtagagacggtgaaaaaacatccacctctgtagaaagctgggcctgaggagcaaaacccctcagataggaggtaacactttgttcctggactgggaggggaactcaagcagctttattttttctgaatactgataattgccattcactgagcactttttatatgccgggtgtattatatacatcgtgtcatttaatcctcacaaaagctcaaggaggcagggttctgagattctattgctacaaaagaaagcactccaaagcttcttgatgtgaagtggcaacagtcatttgttttgatcacaaatctgaaattaggacaaggctcagcagggacaccttttccctactccttgcagccacagctggagcagatgcctggggctagaggattccctacttagatggcccctgacatgctgcagatcactcagaggggacccccttccaagatgtcctccacatgactgacaaggtagtgctggctgtcagctgtgagttcagtcagggctgttggttccactccacctgtgctcctccactgtgctagttgggctctcccacagcatggcagctgagacctaaggtcaggtcctccaaaacaggacatggaagttgccagtctcttaaaacctggatctggaaactggcacagcatcacttctttcagattctattggtcgagcaggcacagaacttgctcagattcaaggcgatgcagcaaaagagaccacagctctcaatgggtagtgccaaagggtttgcagccatctttattctaccagaggtgcagaaaggttaagtgtcttcccctggattactcagccagcaagtggacaggacccttatcccctgatttcttccagatcctgtgacactcctgagttggccagagcacccgactgacctcgagtcagctttctgtgtccattttttgccatcaactgtacctgtaacatcaatgcccaccacagcgccagaggcctagcgaagcgaattctataagcattcctaaatcacctttatttggaattgacttaaagagcaacaatggcaggaccctaggcttgagaagaaaacacccagggagcatgtgataaccatcttcagatgtgggagggtgactgtgcaggccacagcgtggttggcgttctgtgacctccattgttcttgagtagttgacaaactacagccggtggtcccgagaccatcacctgcatatgtgtagtccttaagaaggaaatgaaaatgtttttacattttcaaatggtggaagaatgaaagcaaaatagaatacatagcagagttgaacagatgcaagagagtgtatggcccaggaagcctctcacagaaacagtttgttaatcgctgtcccagaaggcagaatcagcacctatgtgaccagaggtagatctcgggtcgctataggaatgaattttctaactaagagttgtccatcagcaggaacagcagctttcagctgaaggccatacaggcagatgctgtgccttggacactgtaagtctatggtgtgctggtaaagctctaacaacaggctccccaggggagagagccttggttggtaatgtttgcctatttctgtggtataaatgctaccacatggccagtctccagctgccagcatagcatcactaaatgcagagtggggaggagatgcacacggtcagctgtctcaggagccccaggttccactgtgatgggctcaggcgatcatcagtatataacgctgccctcgagtagctcccagtgtagagacttgcagggtcttgggtaggcacagtagtgctggagacttctgtgagatgccatctgctgctctgggcccacaggcagccattgttaacatccacaagcccagaaagattaagtactttgcccagggccacacagctgctaaattccacatgctattttattgttctcacatttggtttagaaaatcctgatttctgcagaaagattgataagtttgaccgcattcaaatttaaaacatccgtttaacaaaacatcactttaagcaaagttagaaggcaaataacagattgagagaaaacatttagaatatgtgagatcaaggcgtgggtatccagaatatgtaaggagtacccatcagtcaattaaagttaatgactatgatggttcagtaagaaaatgggcaaaggatgtggacacgcagtttatacccactcaagtacaaacagccactaaacatgacagatgaccaatcttgccactaagcaggggagtgtatgataaaacattggttcatgttttccacttattcgattggtaaaagtaataataccaagcaagggccatttgcagtgactcgcacctgtaatcccagcactttgggaggccaaggtgggtggatcacctgaggtcaggagtttgagattagcctgaccaacatggtgaaaccctgtctcaactaaacacaaaaaattagctgggcgtggtggtgcacgcctgtaatcccagctactcgggaggctgaggcaggagaatcacttgaacccggaaggtggaggttgcagtgagctgagatcataccactgcactccagcatgggcaacaagagcaaaactctgtctctttaaaaaacaaacaaacaaacaaaaaacaacaacaacaacaacaagcaagtgaggacgcgaagccaaagcaacttcatgaactgctgctggaggaatataaggttatgcagcccagcctgcaaccgagcatcaccttgacccagaaattccaaactgggctagatatcctagagcctagaaaacctgtcacatcctcggagtagtcaggtgcacagggaatcattgccttctagtttgtgatagtgaaaatttggaatggatgtaaagaccatcagttagggaatgactaaataaactcttatctagaccttcaggtgaacattaagctacaatgatgaggatgcaagagattaatagcaatgggtattgctgaggtagaatagcaaattgcagattgatgcatagactctgatgtcatttatgttcttaaaatgtacataaaacaatgccatatggtgcatagacttcatataaaaagttccggagggctgtacaccatactcgtgatagtgcatgcttttggggaggtagggatggggagggccagtactggggaggaggggagatgttcagaagcagcttcagttttatagctggatgtttaaatttttctaaaggtcagtgtatttttaagagaccaagccaaagttcagttatttccaaacagaacagtggctgtaaaggaacctactatcttcctcagcaagttcagacccagcaggttggccatggggaggcgcccacatggagaggggtgtctgggtgtggttgcctcggcccatgaggttgaccttgctcctgagggtcctctctcatcacgtctgtgatctccatcctggcctcaggtccccttgacccttgcctaagcaggaaaatgctttttgcttaatttattattgcacagctgggacaactgaagaattttaaataagactttactgagagctgagaatgacaggaggaaaatagagtcacagtaggtaggcggtgttgcttataaatcgcagggttcttgtgccaagcttggaatggccaacacctcctccctgctcagcccagccacccaccccctttgcttgctccctctccccttgcccccggcagctctcaggaatgtctaaactccactgtgtctagacccaaaggaaagatgcagacagagtgtcccctctcccatgtagccatggcccaccttccagcttacctgtttcctgtctaagagccaacctcttccccagatttttggccccaggaatgtccatctgtttcagcaaaaccctactcttcaaccacaggagtgtgggccttattctgtcattagcatgaggtccacatcagaatcccatgcctgtaaacctaggacctgggcaagaggcactcacagaagcttcaagggtttctctcacctatggctgtgaggagttcaggccaaggattgctgcggggaatattgcaccgttgccatgtgccagatgctcatatcctagccatgttctcttcatcaatcccattagaagcataggaactaatatcccattttctggacatggaaactgtgcctctgaaagtaacttaacctctctgaggacacagagcccgatgcaaaccaggctactgcctgcagtgcctctgaacccttgagccatgttcttcccataggggtttgttctaggtaccttcaggaggctccttcctgctttcacacaacctccctgggtaaaaggaaagatcccctcccccatgagctttgagtgccacgcatgcatgctgttctatgagaatccatgcggctccttttaagttgttacttgaacttgaatttgaggtgaaaacagacagaacttgtatattcagatacagcttgcattttggatttaaagaagctagggctaattcagaggaggccttaaggttaggaacttcgttgatatgattcatttaatttgagggaaacagagcatagaagcaaaaaatgtctctgaccccctgaatctatttccaaccttaaattcactccggttcgacaaatgcagaaaggaatgccctgtgttccttcttccccttcctgtgtcccagcttcagttttcattcagcaaagtcctccagtgacccaaggaactgaaattagaatgtgagaggtgagcgtgtgaacacccttcaaggcttcccctaaattaacaggaaagaacattcaacacagtggtgatgacggagcattgagttgtagttcttggtttatttagaggcaaagccaagaggtagttggggaccacctcactccttcacgctgtatacaccaggatagttacggtaaaggaggaatcatctcaaaatgcttggggagttacttaaaccccaaggagagcaccagatatatatttctcatccacatttttctgacctgaattaaaacatttttatagtagtacatgaatgagcccttccttcacaggggaatccaaatgcaaggctaagaaaacacttcagtggattctaattatcttcccctttccttgcttctctttatttcctgaattgctttagccaacctgtaatattttgcttgcagcttgcaaggagttattacttattatgggttggattggatactcccccacaaaaaaataatgttgaagtcctaacctccaggacctcagaatgtgtgatcttctttggaaagagatcattcttctcattggttacattctttgcagatgtaaccaagttaaaatgagggcacttgggtgggccctaatccatatgactggtgttctcataaagggggagtgtggatgcagacacagacgtgtgtggagggcggtctacagggagagacgcagggaaagtgccagttgcaggcggggatgggaatgctcgtctacaagcccaggagcacagagattgctggcaaagccccagaagctgggaagtggccagaagggattcccctccaagctttagagggagcatggctctgtagacaccttgattttggacttgtaacctgaaatttctgtcattttaagccacccaatttgtgctactttgttagtgtggctccggcaacctaatacactacctatacctacctaacccttttattttttattgttttttgaatatgtttttaaaaattttatgtagagatgggggtctcactgtgttgccctgggtggtctcaaacttggggcctcaagcaaccccgccttggcctcccgaagtgttgggtttgcaggtgtgaaccaccatgcctgggcctaactctttcaaagtatacatttaggatcaaataaaattggaaatttcagttcctctatcatagtcagtttgacattatattttccaaagatggcttcagtgttatctgctgtcctacctatagggccaaacacctgaaatcaggagctggattctaaatcccccttcccttggatctggataggcccttttgatgctgtgtgacttctgaggcagcatccacctgcgtgctgggacacttgctctggagccctgacgtgcctgtgaacagtccacttatcttgaggccagtgtgctatgagggagcccaaactagcccagatggagagaccacgcagagacatgagactacaaggagagaggtgcccagacagcccccgagctgcttcagtgcccctgccatttcagcatcagccattgtctgattacaaccccatgacacaccctaagccacagctgcccagccaacccttcctgaattcccaacccataagataattgtcatgattaaagcctaaggttctggggagatttgttacatggcaatagataactgcaacagttagcatgctctgtgctttgcattggtcactttcttttaatttataaaatgtattacattattacttgtgattaaatagttttattatttaaagcagacagaagacaaccacaaaatctggtagcttaacattataggatttatctctcactcactcaaagtctcatgcagatagggtaggttgatgacctcctccaggcagtgactcagggatctacattccttctacctagcctttgctgccccctggtccttcttggagtcctgtgctgggtcacctgtgttctggtggccaaagagagagatgagagtgtgggtgggggattacatcggatgttttggggaccgcatctgaaatggcacacatcattttggtccatattttactggctagaagtagtcctggattcgaggagctgggaaatgccccttagttgtgggcctgcaagaaacagggtagtatggtgggaacacaaccgaggctctgccacatctgcacacagatcggaggatcttaaaataccagagctggaagggccttgagaaatgagcttatctgcgtgtcatctctgcttcaggatgaacagagtcttgttaaaatgcagattctggggcctcactcaggaagtaggtaccaggaaattacattaaaaagatttcccaaattattgttgtgtgcactaaggttagagaaccacttaacctggttactcaaccctctcattgtacatagagcaaaggtgaggtccagagaggtgatatgacctccttatatctcttcaagtcacccaccccttgaggccagaattggagctggcgcctctgcctcccagggctttgtgacctaggagccaggcctcgaaggtgtgccctgggggagcatacttggtgcctgatttcttccactctgaagaatcctaatgtttgccttgaaattggcctcatggggtaattagtatgtagacaggggtcctctgcagcttagatgataaccaaagcggatcctaaatcaagtcttgttatattttgggcaattcctagcaaaagtcaggaaccctccagaatgttttaatttagaaaatggaatcttgcaataccttctcctgcattattaaaaggcccactttgtttttaatgtagtgacatgtcctaaataccttctgtcgtggccaacttttagggaggctttggtggtagtaaaagacatgttgggaggagaaagaaccatggtattttccagctctcttggtgaaaacagcaaatgttcattagtattcatttcacacgatttccctgataaagccataatttaaaacactgactcaaagccctaataaaggaggttaacttgctttctaaatctgctgcacagactgctcatctctccttccatcagcctcccttctcctaagccaattgtagaatttggaacaaagagaaaaagtgcaaggtttttttattgattcccttgttaaccagattctgctgttcagcaacatggtgagcatttgagttctggttctcagcatgcatgtgaaaaatcctcaagtcattttctaccttcagagatttgggggccaaacagggaataaattaccaaacaatgcttatcatgctcccaaacatttgctgaaatcatttagtttcaattattttaattactgaagattttataagcagagttcatggcaaaaacatctgccttcatgaattggcacgaaggaggatgagtatatatgtagaaataaaggaagatgagtatatatgtagagatgaaggaggatgagtatatatgtagggatgaaggaggatgagtatatatgtaaggatgaaagttaattagtatatatgtagaaatatatatatatatatgtatgtgtgtgtgtatatatatataaaataccagatgggtatgtatgtatgtagagatgaaggagtatgagtatatatgtagaatgaaggaggatgagtatatatgtagggataaaggaggatcggtatatataggagtgaagggtgatcagtatatatgtaggaatgaaggaggatgagtacacatgtagaaatgaaggaagatgagtatacatgtagggacaaggaggatgagtacatatgtagggatgaaggaggatgagtgcatatgtagaaatgaaggaagatgggtatacatgtagggatgaaggaggataagtgtgtatgtaaggatgaaggaggatgagtatatatataggaatgaagggtgatcagtatatatgtagggatgaaggaagatgacaatatatatagaaatgaaggaagatgagtatacatgtagggatgaaggaggatgagtatacatgtagggatgaaggaggatgagtatgtatataggaatgaagggtgatcagtatatatgtagggatgaaggaggatgagtacctgtgtagaaatgaaggaagatgagtacctatatacaaatgaaggaagatgagtatacatgtagagatgaaggagggtgagtatatatgtagggaagaaggaggatgagtatatatgtagatatgaaggagaatcagtgtatatgtagggatgaaggaggttgagtacatatgtaggtatgaaggatgatgagtacctatgtaaaaatgaaggaagatgagtatacatgtagggatgaaggaggatgagtatatatatatatatataaatgaagggtgatcagtatatacgtagggatgaaggaggatgagtacatatgtagaaatgaagggagatgagtatacattagggatgagaaggatgagtatatatgtagggatgaaggaggatgagtatatatgtaagatgaaggaagatgaatatatatgtaggaatgaaggaggatgagtacatatgtagaaataaagaaagatgagtgtacatgtagggatgaaggaggatgagtatatatgtagggatgaagggtgatcagtatatatgtagggatgaaggagattgagtacatatgtagggatgaaggaatatgagtccatatgtagaaatgaaggaaatgtagggatgaagggggatgggtatgtagggatgaaaggggatgtgtacatatgtagatatgaaggaagatgagtatatgtgcgtatgggtgaggggggatggagtgaatacatagggccttctgggcatcagttgataagtcctgacctagtgggatagggactctcctaacctttctaatgtctaactgaaggacttggttgcctggacagccatgacatggactgcttcataacaagttgagatttgaacagggacttgtgagaagggtcaatgatgaaaactaagaggatcaactagtgctctccttctcccagtcttgatcagtcactacactttgcagtcctggtccctaactcttggggttccagggttattcattgtccttactcctgtggagttgagtttctgaggacgcaaatactgaataaggcacgagatgaccaggccagagaagggcaagcctaatttccattggctgagcctagtaaacaagcccagttcaagatggtgcatgttctagccttctatggctatgtaaaaaactatcccagacccagtggggtgtagcttgggttccctgggaagcagactctgagatggagaagagtgtgcatggtgtttattaagaactatacttaggatcaagatttggagaagaggagaagggggcaggaatgggtttagtggcagccccagttggccaacagggagttctggggccagaatgacccttgagagttgccccaggttgggctgtgatgacctagtctttatatcagggatcagcaagttatggcctataggccaaacccaggttgccacctattttttaactaaagttttattggaacacagccacacccatcatgtacatgtcatctgtggctgctttcatgatacattagcagagctgagtagttgggacagactgcaaggctggcaaagcctaaaatatttaggatctgcccttgatggaagtttggcaggccctgttatgttccctcattgatcagttgctgaatggacagtctctgacctctgtggcctcggctgcgctggagggtccccttctaaggtgccttccttgctcgaggctccttggccttgttctccaaggacatctcttcttcctgggtttctccacgtggcacagtggtttggcatcgtcgtacttcttgcatcttacctgagggcttcaggaggtgggacctggaggcccccagtccatgaaaagccacagcagggctggcaaaatcacttgtgccattggtcaaagtgatcatggggcctgcccagattcaagagatggagccacagatgccgcccactgcctgaaggaggatggcacaatcacggtgcagaagagcatgaggatgagatgctgtcagaccgtcttcggaaaaatgtggaacaccatggcaggccaggtggctgctcggcagtgccgtgtcaatcccagctcacccaggtcaccgctgcagtgcctgtccctccccaactccacccacggtccctgacatcacgtggggagggagtttgagatggccatggtgggaatgtgacacctcgggaatgggctctacccaccccaacgccaaagaacctgctgcacacccctgctgccatgggaggacttctggtttgaagccacatgggaagaaagacagcagcatttattgagcactaagggtcgctacatgtcctggaacctcaggatgactccgtaagctatgatgttaccctttattttatagaaggggagtcagaggctcagcaaggttggaggccctggcaggatttgaaccatggtcccctcgtttttgccatcctgcctcacagaagacggagctggcaggagaaggagatcctgggtctgaagaaagcttaggttggcagggagggagagaaagctggccagagaagagcgggcaaagcctgaggccagggcagcatggggttgccagaaggctggacagtggagtccctggaaaggactcagggccagcagactgcgccagctgtgtgggtgctggaagattcaccccaaccaggcagccaaactcctgacgtttctcattgtctgaaaaatgcatctctgtactctaagacaacacaagcagaatgcgagtgaggtgggctcgggaggccctgaagagggccacggagagaaagccggcggctgggcaccacattcacagcagaagtttcagttccttcccctcaccttcttcctgggaagcacagtggttaggctcaaccaatggaccagttttaggaggaggagcgggcaggaaggggctttcatattggatcctgtaggaagcagtggtatgctacaggggtgacagtggccttctttataacaacactcgttcccgcaagctggaccttacccacgtgccagccttgccagttacacatgtctattacctttcatcctcataaccttcaagggaagaggtcttatgactcctctttggggaaatgaggctcaagagaaggggtaaccttccgggtttcagggtgagcgcgtggcagaagttaagacttggactggatgcaggcacttgacttctccacatcacgtggccacggtgcctgagtcagcccagtggtgcggggcgccccagagagcacagaagccagggctggagacccaggtgtgatgggagagctttctttgggtgaggttggttcacaatctcccactttttcccccctatagttgaaggattttctctccccgttgtttgttttaagaataagatgcaaaagtgagaagcgggaggccttgccttgttccgtgggcagacagtgtgggggctgtgaggccaaggacacctgggaggggagagggtgggggcagactgcatctcccaagagcagggtggggagtgcagggaagggtcaggaggagagcaaggccactgctgaggcagggtccatgtaggacacctttcgcttggactcctggatgtcctggctgggcccaggccctgctgtgtcccctggaggataggggaggcctgtggactgctcacaggagggtgtggctacctctgccaggcccctggggataggagagtcactccaccatccccgtaaaccagtgggaggccctgcagcaggagcgtggaattaagacgtgggaaaatggtctcagtttttcaggtgcttgttaaagatgctgagttttctggtcaccattcttggaagccctcacacagcagattgaaagtgaggctcagaatcttcatttttaaagcatcctcaaataattctgatacccatggactctagaccgtgctaaggaaaacactgacctggagggtgaaggcatgtgggatctgaaacttttaagaaaacagcttttttgtcattcttatctgatcttatgagcaccaattttcttactctgaatggatgtagatgtggaaggtataatgtttggggagcgctcttgccctaagagagataatgaatacagcagtttgtgcataattgcacttaattattatgttgtgaatatatggttaaacttgataaagattaacttataaaaactcttattaaaacttccctgttatttgccattcatcgctatcgtggagtttttaggggagcttgttcgtccatccacctgataaagttttgaatgcatgctgtgtgcctggctctggcggggagtggggcatacagcagtagccaatagctggggtgggaggttctgaccactcccctccacccacttacagtctggacagagaaataaactaaaaaaatccgcaaccaacaacatacattttgctttttttgtaaatgtattctttttttttgtttttttgagacagtctcgctctgtcaccaggctgaagggcagtggcacaatcttggctcactgccacctccgtctcccaggttcaagtgattctcctgcctcagtctcccgagtagctgagactacaggcacacgtcaccatgcccagttgttttttgtatttttagtagagacggtgtttctccatgttggccaggatggtctcgatctcttgaccttgtgatccgcccgcctcagcctcccaaagtgctgggattacaggtgtgagccattgcgcccaggctactaaatgtgatttttataaatgtgttagtatttacatacaaaccaatactagacaagagaggaaaaaacccttatcagaccatatattgtgaatttgagttttaaagaattaattaaacatgcaagttatgaacttttcaggtactctctaattgaaataagaagatatacactataaattctgtacaaagctggcttgcagatttttttctcgtcattagagttaagacatcacctctaagtatgtttaattaaaatgttttcaagatacactgatattttcttcacagcatttcatctctgcccctcctctcatttgtgaacacggaaccttaggaaaatggttcccaagtgctttcaagcacaaatgtgtctgaatgcagaattgtcaacaacctgcacagagaattctgaatccatgcttggcggtttcagcatagtctttatgctgttttcttgtctgaagtttgagcgcaccaatagtctatgagagaaggaatcaatatgaaacagagttgttaccaataacctctgcttccgggttctcagcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaaggtacgtttcaaagtgtaagccagatagaagcttgtgcagatcacagccttggttgtttctctgctaagaaaaattgaggcatctgaaagagttacatgattttcctgtaccagtttaacaaacagaaatatcactataaatcggcaagcataggatacatgccccccactgggatggctaacctttttgtgggatagaggcttaatgataattgattacattctggaattcttggtaaagaatacaaggggtcttaggagccaggttttttagtaagggggctgctctagccagcagctagtgactggcactggttccttctgtggctctgggcatgttaagatagaaaatgtgttgagtgatgcaaaggcgtatggcctgactctgtcaccaataatcaagcaaaccaaactcagattggctaattggggcatttgcctggctggatgcaggacgctgttggagatgaaagggcatgtaagccgtcctcccagccatgacagaggtgtggtctctttgggaagggaagacacgacaggagcaataggaagtggcaatggtgggaagttccagttcaaggcaggaagaggtggtctggtaaagcagcgcgtgctccatccgagtagttgattcagaccagtagagctgggataggatttcagaggagggaggattttccccattcttctgtagcagagctgtcaatgtcccattcatgtccctgctggccccacaaacaatgtgcaaaagcacacactcatatacatcctaacagagggcttgttgcaaatacctgtgactcttcctggcatcttgtttctggccctgggagctggaaatgcaaaagaaaaatgtccacagaagcaactgtcagccatggaggatggagaaatggtggataaagaccccagctccctcctgctacaattggaataacactgagttctccttttcctctcccattcccccagttacccccacttgataggacacctcgtagcagcttccttctgtttcctgtatctcctttctctaccaagtgtttcctggtgtcccctcccacataacccacttgcatccgaatccttgtctcaggcctgcttcagggagaacctagagcaagacatgtattttcctgctgttctcttccaaccaccctttcttccctactttttggccttttttttttttttggagagaagaactattctgccatcttgtcctcagcataacatatcatagctttttatttatctctctctttttttcaagcctgagaacataatgcttttggatagaaatgtccccaaacctcggatcaagatcattgactttgggttggcccataaaattgactttggaaatgaatttaaaaacatatttgggactccagagtttgtcggtaagtttctttgctcctgtggtcatttacgtctcataaacattattctggcaaacctcccctgctagaagattctttccctgctacatgttcctggttgttgcatgaagatagaatcggttagtttgcttcctcccaagctaaatgagtgtttgtttcctcttagctcctgagatagtcaactatgaacctcttggtcttgaggcagatatgtggtaaggagtatgtccttggtgttgtttgctttctgatttatttgactattcttctgacatgtttttttgtttgttttgtgttgtttttaggagtatcggggtaataacctatatcctgtaagtatcagaattcacaactcatactctcttctcttctatgagaccataggtttaattaaccattaaatgtgctgtgttgatctcttcagcttatgcatgcttttgatgcaaacatattcattttacacccccaaaacatgtttagtttatactaattaaacatgttctcctaatttgaaatgagtcatcagaaactgtagcataatcactgaaagaaagcatagctgtccatcactgccgagaaaacaggtttcctttaaactaccagacgctgttccagattaacttgttaagtgaatccttttgcctgaagctgaagcatttgctcctgacagttaaagccctatgaaatataatcaaactgtgactattcgagcaccagattataatcttattccacactccagatgttataggagcaaaatgacaacaccaaggggtcatcattaatgttctatgcccaactttatttttaacagcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagtgagtgtccacgttcctgaaaggtgcttggccacggcctcagccagcccagagcctgtgtctgttccatgcacagggccacgttcctcagaccctgcttgcttcatctgccaaagggcagcatgccatgtgaaacgcttcagaaaatgcaagcagggccctctgcccccactcagtcagtccctgcaggcacagtgaaataatcacaaaaagaccgatgttgtttttggctttcttccctgaactgcattttccacagtatctgcttggcaggcccagccagcatgaaaacaaccttagtatttgctgctatggtcacagcattttttttcttctccccctcccctcaaggaagagaatgacaattcaagatagtttgcagcatccctggatcaaggtgagttgcatattacgaaactgtttagatcactttctatgtgattggtttgggcaccctggtattcatgtatcatagagtactgctaaccacaggtcacacctggagtgttaagtttgctatttgcatcgtatcttaagaaaagctgacaggttagactgtatactaatgatcccagaggtggggagagaggaataagcgagcacagagcaggaactgaagaaggtcaagcccactcgacaactgtgtttggagtgacctgtggggtgttggcccaaacagtgtatttaacattttatgttgattccagcatgtaaatatcaatcaaatctggatttccagcttctcttgggaaatctgaagatctgctgacactgagccctcattccacgtggccttgggaagtggcacaggtgccttggtgctagggaacagggcgccctggaacattacacctttacattacctgcctggcctggttgacatttggattaaagtatcttcaatccagggcagaaagggctaagggtgggaaagtatgatagttacagaataaaatcatgaaataaagaagtgaacatcacagaatcaggctctgggggcaaatagctttgctgtgcaagttcccagcagttacctgggttctcctagccagctatggtgtctcctcctcccagaggtggaggacaaaagctaaatacatctactgaaaaagatacaatacaaggaattctcctgctataggccaaactaactttgctgacctctgagatccctctcagctctacattacttgatgatacccaagttcaaatgcctcataacatagcctcaccatgaatattgccattcccaaactatcagtgtggaaagttgtgatttagtttgaccccaagctctacttctccccagtgtccatggatgatacgaaaccctgagatagaagagtgagcccgctaagactaggtgcctaggtattccatgttatcccaacttcttatgctaatttaataaggtgaatgtgtaagcatcctgaataaggagatgtttcaaaaaattgtcatataacacattttcataatttgagagctttaattttttttcttggatttttattttagcctaaagatacacaacaggcacttagtagaaaagcatcagcagtaaacatggagaaattcaagaagtttgcagcccggaaaaaatggaaagtaagattgtttgttgtggagggattaacaaattctgtttcctgtgtagagtagtgtgtggtcagggtgcatctcctctgatactggtaatatggaagatacatcctttcctctttttaatccaccctgtagtgttctgcaccattactctattttgaaaaacaagcaaaaacaatattttagtcactttaactgataccattaaatgtaattttgtgttgttttcatcaaaactattctcagtgcaaatttttatagcagcactgtaaaattatagtgaaatttttttctaatactacaagccacattttaaataaattcattctttgtggtaagcagcatgagattacatttgtgctgtaccttgggtaagtgggtctctcagcccagcctttatctgtgagtggttggagtgggggtggggtggggccgtgagcatttgcagggtggcctgttctccttcctcagtgtggatggcctccacaggggctgggtaggacattgctctgaaggcattgcagacctcctggaacaaatcacacttcagggctaagaaggtgatgggatggtttcctgtgcccagggtcatgtcaaacctagaggaagtgggtacctaccgtgtcttcccagctcagggccagaaatgtacctcgttttcacacctaccaattttggggtgccgtggtagggatgaggaagaccacagcactagattcccaaaagtccttagaattaggcttaaaatagagagagagcaaccatttctctttctcgctctcattctttaactgtacttttgccttagagagtaaatgcagagatgtttgttctatagactaagaggtcccccagctgttcacttccaacagctgttgcgttttggttatcacattgtctaccatcactgcttatgtggcacaaaggacacagagcaaggcccctgcagtctgtgcttctctgagggtgatctgcaagggtcagatcaccttctccaaacagcagagaagaaaatatagagagagaaaggatgtggggtgtccagctctgtagttcaataatgaaacatggaaggagaatctctatatcctgttgtcttgatttataagacctttaaaattattctttaagcaaatacaacccattctgctgtaggattgcccaccctgggagagtgtgtgctgatagcaatgaacacgatctcgcaggctttgtcgtttgtactcatttgacaattgttacataagctgtctctcctcctctcaccctgcctttttcctccccgccctccctttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctcctttcttagcactgggtactcagaatgaccaagctgttctatttgttcaacctcccaggaacctgaagttgtggaaatggcaagcttattcttgatcccctcggaggggtttgggggtgctgattgatgcaccctcttgcttctttcctctttttttctctttgatttggatggtgctgtcccccctcatagccccatacctctaacactaccctccacctcgatgcaaacataagcacagaccacccccgcaacacacacacatacacacatgcacagcaaatgcacacacatagagacacacgcactgatattttggtaaaagagaggctagccagcagaagagaaaagagcttatcctaattttcatgaactgtagccactgacatagaagaatcttggttaacagtagcacagaaggggcagacagccgccactcccttcccacacacccacaccagagaatcagggagaatgcagtgctgcttgctgatgtgtctcctagcagaccagaaggccaaacctgcttgcatgattggcctggtgttgactgcccaaggcccttgaatgtaactccaactttcttagttttaatgtgaactttgacaaagtggcaaagatttatcaaatttgttgttcggtactctctagttatttttcctttgtaattagaaatgcatttattttccaatttctagcctttattttctttattttcccctctaatccaaactgaaacctaatcacagataagctcttcagatacgagtggaagtgtccgaattcaacaagactttcccctgacaatcaaacaacggggctttgttaagtcaggaggtgaaggggactccagacaaggcagccacggttgtcctgcgggaactaccctgcccctttaactgaatagtcagcattttcccggtggagccaagtacttcagggtgggaactgcaaacaccaagctccccttttttctccttaagttagtagcttcactgaggcttcacatctagccttgtggagtgaaatgggattggagatgtttgaaaaaaaaagcaaaagagaagcagattagggcgagaagagagagaagaggaggctttgtttgggaattgttagagggtggctgcacaaccagtgaaaagataaaaactgtgactctaggtaagataatgagaatgattaaagattgcaaattgaaatcactgaatattcaactgagagacaatacatgtgtcacagtgaaaagtttagggtaggagagggaccaagggtcttgtaggagctccaggtggaaagataccctcccagaggtcagattcccttatttccatattctaatcatggggatgagtcataacaatctgctttattccttctgttttccccatttctcttgacttgcactttcatgtaaacgcctcttagtcattgacttcaattgtgatagaaaagcattcttaaacatgcattttatacaaatattactaaaacccacatgaaaagtgtttggattcagatctatagagaagagaaagcagatggagagaaatgctttctccattctcccccacaagcagagattcagcctctgtagattaacttttccagatttgaaattccagtggtcataattctgtgtttataagttcagaaattttgtttaggatttttctagctaattccttagttttaatgtgaattttgaaagagtggcaaagatttttccagtttttgttcactactcttccagttatttttcctttgtaattagaaatgcatcagttttctgatttctagcctttattttctttatttagagcctattgttttaatttttatttttctgttttttataattgggaccagctttcagagatttttgccgtgttattctatacctagcaatggaagaaattcaagtgatcagaaaacaattctgtaattggaaaaattgcaaattgagaatatcttattcaaaggtatcatttctttgctgcaataggcttttctttttccttatccaggaagagagtctgtgttatacctaaaaattttcacagtggttttaggaactatgttttgacagattcttaagataaacacaaagggttacttatcatcattatttgaaatctggatcttggacattgtgtctctgggctatactgcaggtgatattaaagcccagataaagagtagatagtgcttgtttgcaacatggaaggggcaaaaattccttcctaggtccctccatgactgtatggatttggggagtaaatggcttactttcctctgaatgcccctgttaacaagtgagcacaggtttcttttatgttggtaagaaaagcatggctagcaatgtaactctgtttccatcttggctgtctctctcaaggatgaggaagactcctttgtgatgaaagccatcatccatgccatcaacgatgacaatgtcccaggcctgcagcaccttctgggctcattatccaactatgatgttaaccaacccaacaaggtctggttctgttctgccgcatactggaggggtgggtcacagcgaccttgcccttccatatccaaggaaagaccccatctgcttctccattctcccttccaattggaagctccatactgtggggaaaatcacttctgtttagaaagtgatttgagttacaaataaggtctttgtgcattgagggccttccttcattcacgtattgtatctctacccatgaaattttagatcttctcatcctgctaatgaaaatgtccctgatgatgagaatccaaaaggggaaggaaaggttttatacccttccacctgtcttctcttcctgccacgcagtggtagctctatgtctgttgagacaggggaaggtgtgtggtaacagcaatcatcgtttgggcttttcctttcctaccaaacctgaaaattagtaatttttttcttgcctattctagcacgggacacctccattactcattgctgctggctgtgggaatattcaaatactacagttgctcattaaaagaggctcgagaatcgatgtccaggataaggtcataattgttttattgaaatgaattgaattttaaagtattttcaagtgtctcttaatcataggggtaacagaggaaaaaaatttatgtcctaacttgtttctcagtttcctgtaaaggaagatgagctgcttttaaacagcttggtacagcctgacacatgggttaaagaggcaaacatttatcatttatcctccccttggcgctgctgcttgacatcagcatttctttgtacactacccagattttacttcttaccgatcacatttactcaacaatgttagatgtcacacatgaaaaagttttgttatctaattattctcatcagaaatttgtttgcctgcttctgcagacgtcagcagagctgtaagtggagtagatctggccctctgcagtaagggaatcctaaccagagaggggagatgagggtttacaaacataaaataattgtttataagcaattgtttattttgaaatcatttttgatttacaaaaaaaagttggaaaagtggtacagagagttccatcattcgcttcacccaggtgcccctaatgctagcatcttgtgtaaccacggtacatttgtcaaaggtgtaaaatagaatgagggttttattcctctgggaagttgctcctctggggtttgtcatcacacaggaagggaaataacagtgagtctgaggaatgcatgcatctggtgctgtcagctccctagaaatgtgaccccaggttgattttcctgcagggcgggtccaatgccgtctactgggctgctcggcatggccacgtcgataccttgaaatttctcagtgagaacaaatgccctttggatgtgaaagacaaggtaaggccacttctcttaggaggaacatgaggtggtagtaaatggatgcatgtgagtgtgagtgctggcctaccgtgtgcatcgggacccaaaggaaaggaatcaggaccagaattcacctgcagaacatttaagttggaaatgtcttgttgcctgtggtttggtctaatactgaaatcagccttaagtcaaaatctttcaggtagttgccataatacgcacgcattgaattataatccccataacataaaaacctcaaagttctagtacagacaaccagagagagacctcggtctcgattcgattttcttcctgactcaaccttgtgcttttaagcggatctctcctattctcttcttctttgaagtggctgacagtgctgacctgacaatcacagacactagaagatattaatgagacaatgcacataaagtaataaagtaaggcttttttttggcacaacggtgttataaaagttactgatttatcaagataccttgttttcatatgtgtgtgtttcattcagttcacacaacaatcctgtgaattaattggctgtgctggaacctgaacctggaattcctacctactcatccattatttattctactgtacaatacttctctgcttccagtactggcagactaatttgacgtttagtcaagctgccacatgcagttgcatgggttgtgcactgcaccatatctgaggggtaacattcatatcagagacacgcatttattatggcagttttctggaaggtggcaacactatatcttgttttgtcttcttaaaatttgtttattctgatgattttctgtggggtggatagaagtaaagtatcttaaaggatttgcacttgttactaattcacagaaagttattgcatgggcaaatagtgacattctttaaaatttctgagaaaatctctgagaatataagaaaataagtttctaatcataggcaatgaaatgagaagcttattaataaataaaattgttcatttaagtaactgctgaatgatgaacccaatagtaaaaagagagtgttgtgtttaaagagaaaatcacacagctagaagtatcagcacataaagaagactgagaacagctatcatggaaaagggagagccttctcctgagttgtttgcacttcacaggatgagccaagtatgtgggcttaatactcactgtgtggtggacaccccaacctcaggtccccatcctagccactataggggcatctgcccaaggtgggtgggtggaaccaaaggggacagagtggaaccaggcaggcctgggtgtaggccttgggttctggtctccatagcctgctcacagatgtggctctgaatcaccggctccttttcttctgcagtctggagagatggccctccacgtggcagctcgctatggccatgctgacgtggctcagttactgtgcagcttcggctcaaatcccaatatccaggacaaggtgggtcgtgactgacatcctcccttcctctgctctatacatgaatgtacaggcagccagatggtacagtcggggcctttagagttttatccaagctaggctttctgtcttcccctacagagggcaaggctcaaggggcagggactcaaacagaagtactagctaaggtgtgcaaggtgctaatgccaggatcaggtctaaccacttgattcattcatgcattcaatctgctgaacagccctatgaggtggattactgttatcattctcattttagagatgaggaaattgagacagggaaagtttctgtaactttcccaggctcacaaagctcagaagtggtagagctggggcttgaacacacacagtctggtttcagagtccacctttgtaaccaccgccgcactaggatggcctctcatcggtgcatatatgtatctagcgatgttgatcctgaagatacaggcctcacggtctataaggacttcccttgacttgttcaagtgtggctctcctaattaccttcttgccaaagcaacaatactgttaccactcaccttgtgttgtaaacatgacagaaagctagaggcattaaggttgctggaagaattcatgctcagggaagtggttacctactgttagtagtttcagataaagtcagcgaggcacttattagaaagatgctgcaatgcacctgcacgaaggctctattgttcagacaagcagggccgatggtttcaacgggctcccgaaagtcaattgtcagtcatatgcttgagaaagccaaattcatcaaacacacaagtgttgaggaaggaaaactaatgaaagagagacatcagatctacctcttaatgctggtggctcacactcatgttgttattttattccagattaatatttcactccaatacctatgagctctttccctctgctgccttggttgcgtttctgccaaatttgacagggactctcaccttgctttatactttgtttctcattattgtgttctcctcctctctgtactcgtctccttggccaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcatccgctgtgttgtaaaaagacaataaaccactcttgtctggcaatctcgatgctagaccaggtttaattaaacaaattcagcctcatctgtttttattgtgatctgtacttaaaacaagcctgtgatgttgctatatacggttagatttgggattctgtagttaatttaatatctgccctttgtgaagttattttctttgtatagagcaatggttctgggtcgggggcgactttgcccccaggggtgtttgataatgtctggggatactttctggttgtcacagctagagatgggggttgctactggcatctcgtcgatcccagccagtggtgctactaaacatcctgcagctcacagagcagccccctcgacagagaatcacccagctccaaatgccaatagcgctgaggctgagaaaccctagcacagtaggttttagaaatgtttcagaactctccacccagctcctaaaactcaacacatctattcattagggattctgtaataggtagaatgaatgcccgggctggtttttcatgggatgcagaggttacacatgttaaatctgcttctcatttatatgacagcccttgagcaagttatttcacaatactttcacatttttcctggtgcaaggtaaaataataggctctctatttaggaaattggcagagattgctgggcaaatgtttttaaaagtgttttacaaatgctttgattaaagaggccattggagtatcaacaattacttatgttctatctgattgtactgctgaagcctaaatgaatcaagctagtgttcagcttaggctgtgattatttagagaggaatatgtaaagctccgcatcctcccagtccttacccctgctataggagtaaagtttcttcatttaaatcctccactagggcttttagtagtgatcttgttgccaattaaacctcactcgatggcggcagaaaaggtgaagagacggaggccacatgcccaagtgaaaagctctcatgatctctggggtttgtttccaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaaggtatgcacagagaacaggatccctacagcttccaactgtgtccatccacccgattctgggtcctgattctgtgtcctctcacctgatcccaggtcctgattctgtgtcctcccacctgatcccgggtcctgattctgtgtcctcccacctgatcccgggtcctgattctgtgtcctctcacctgatcccgggtcctgattctgtgtcctcccacctgatcccgggtcctgattctgtgtcctcccacctgatcccgggtcctgattctgtgtcctcccacctgatcccgggtcctgattctgtgtcctcccacctgatcccgggtcctgattctgtgttctctcacctgaacccgggtcctgattctgtgtccatccccccgatcctgggtcctgattctgtgtccattcccccgatcctgggtcctgattctgtgtcctcccacctgatcccaggtcctgattctgtgtccatccccccgatcccgggtcctgattctgtgtcctcccacctgatcccaggtcctgattctgtgtccatccccccgatcccgggtcctgattctgtgtcctcccacctgatcccaggtcctgattctgtgtcctcccacctgatcccgggtcctgattctgtgtcctcccacctgatcccgggtcctgattctgtgtcctcccacctgatcccgggtcctgattctgtgtcctcccacctgatcccgggtcctgattctgtgtcctcccacctgatcccgggtcctgattctgtgtcctcccacctgataccaggtcctgattctgtgtccatgcccccgatcctgggtcctgattctgtgtcctctcacctgatcccgggtcctgattctgtgttctctcacctgatcccaggtcctgattctgtgtcctcccacctgataccaggtcctgattctgtgtccatgcccccgatcctgggtcctgattctgtgtcctctcacctgatcccaggtcctgattctgtgtcctcccacctgatcccgggtcctgattctgtgtcctcccacctgatcccgggtcctgattctgtgtcctcccacctgatcccaggtcctgattctgtgtccatccccctgatcccaggtcctgattctgtgtccatccccccgatcccgggtcctgattctgtgtgctcccacctgatcccgggtcctgattctgtgttctctcacctgaacccgggtcctgattctgtgtcctcccacctgatcccaggtcctgattctgtgtccatccccccgatcccgggtcctgattctgtgtcctctcacctgatcccaggtcctgattctgtgtcctcccacctgatcccaggtcctgattctgtgtccatccccccgatcccgggtcctgattctgtgttctctcacctgatcccaggtcctgattctgtgtccatccccccgatcctgggtcctgattctgtgtccatccccccgatcccgggtcctgattctgtgttctgtcacctgaacccgggtcctgattctgtgtccatccccccaatcctgggtcctgattctgtgtgctcccacctgatcctggattttggccaagtttctatttgcatgtgtttgttgttgaaagtgaatattacttatatggacatgtacttttttatagcgttttgccatcttaagttgcattttacatgtgacttttgaataatttcatagataaacagaaaattattataataagtactttttgcataactcagtgtacactgatggaaatcccgtgtgtgtgtatgtatgtgtgtgtgtgtgtacatgcatgtgagcatgaggctctgtagaggaatcagagaagcatggtaaaattgtaacatctttctagagcactaagtcttcaggaaaatgtctagtgacattaagatttgatcccaggactgtatttctcttttttattttatttatttattttatttattatcattattattattttttttgagacagagtctcactcttgtcacctgggctggagtgcagtggcccaatcttggctcgctgcaacctctgcctcctgggctcaagcgattctcatgcctcagcctcctgagtagctgggattacaggctcatgccaccatgccctgctaatttttgtatttttagtagagacagggtttcaccatgttggccaggctggtctcgaactcctgacctcaagtgatctgcccgcttcagccccccaatgtgctgggtttacaggcatgagccatcacacctggccctatatttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccagcaccttcccttttctctgaattccatatagatgttcattaccaaacaacacagactattgcagattcctgtgattttggccctgtagctgtattaaagacaagcattatgccattacgattatgctaaaaatgaagtccaagcacaattaattttttaatttcaggaaatgtttatcaatggcatatacaatgccagtaggattctagtatggtttgttggaggtaaaaggatatctgaaacagctggaaagttatacttttatgtacacttattccttttgcatgttatgtgattaactcaagcagaaattgaaattggtaatttcacattctgagactgtgtggaagggcagtatcccaggttttagccattagctgctggttgctttcttagtttgtcccgttttaatcttgccaagtcagttgtgtaagtggcttaaggggaaagccaagtgtaatatgaagtagcatcaagaccttgggtttccatctaggattctttaaatgaatcaaaagcagcttcaagggacatctgcacttatttgactctctgtagacattcccactgtgcacccaggggtctactatgtgtgcagcatctagaatcagctctccccttgtgagaggagagaggaggagctgagcatctcatggtgctttgccctaacctcaacagggaatgtgttcttcccagtttcactccatacctaaatgtacaacttcacttgttaaatacactcttcaaaaaatccacaagacagtcccagactttcatgttttgaaaccactggcttatttactggaaaagtctcacatttttcaggctgcaaatatctataagtaaagtcgataaatgctgacataaacttgtgtaatcactgtctgtggcagagcagctgtacatagagggccttctgtagatgattttgtcattgaatgaagctcagctgatgtgaaaatcatcagttccagtttcaaccccttggaattagcagcaaaattcagacccgtaattcagagcccatctggacagaagtgtgctggttccacacaagctctgcatctctgcccccgcagacaggctccccaggttggctttgatgctcccatcatcagcacaccctgactttggggatctcacagcttcttcagaagggttgctgtcaggcttgttttgctatttttttttttaaaggaaaggtgatgggggctttagaagggcttaaaagaagcacaggtacgtaacagaaggcatcgcttcctaccaaagcacatccagctttctagagactcactcaagtaactgattgtgagcgtggggtggcatccacattctacaaggaggctgttgctctttctccattgcgtggtcttgccttttccttatctgaattaagttcctccagaaataaaaatggccattcaaatcctaccctgtcaccagtatgtgacaggacctcatggctatgtttgacgctaatgcagtgaaacagacatttctgcattcttcctccttctcatatggaaatcaggagagtggccgtttaacttgccgtgttagaaagcacggaaaggaaagggaatagatggcgcagaatgcatggcccttacccatttgtccctctttaagtcggtgcttcccataaggacagacagaaggcacgctgtgcacacgcacacatctgggaggatgagagaggactccctgcctgtcaggtgtttatcgaggcccttccagggcagcactgtgcccagcgcagagggaggaactcgtagatgccaaggtgaatggctttgccctcaggctacttttagacacactcaaattcagatgtagcagcatctcatgttgtcattgctgctgtgatgggcataaggtgctccagaaacacagaagcaacaattcagatattaaagaaatcagggaaggcttttcagagttgatcacttaagatgatcgaggctttgacagatggagaagagggaagcctgttttccaccaagggaagccagtgtgtctgccgtgggctgtcgctgacacacggcgggtgttgggtaggtatttagggagggggttatggggaagggagaaaatgaagctggagacgttgggtccaggtgtggcagacctggaatttaaggctaaggggtttggtgtcattctgtcccaacctgggcccttcaacagtggccgtttcctctgcccttttcttcatcacactctcttcctcagctttcttcccttctagaaaactgtgcattctacaaccaaaattacatctcccttacattgcatcttctaaacatttcacccagtcttcaaaactttcccttttccttctcacgtgaactctaggatgcttgaaagcttaatatctgttttctgcattactgcagaagataataataaagaaatatgaatgtatcccacactgcagcagtgtttacactagccgggaattggagctgcctagcctcccgcctcagtggctgaatgaatcatgagagccacacagtggacgcgattcaggcattcacgagaatgtgatccctcccgttacaggcatggaaaagtgttcccaatctactgttaggtggacaaagcaagggacagagtgggaggtgggctatgaccacatctcggctgtttaaattatttctctcctgttgaggattcatagataagagcttgggaggaaatggacaaaaatgttaaacagggacagctctgagctagggagcttgagagtaaggggggaggggagaaggaagatttttattttgtattatgtttttctaggttgcttggatttttaaaaagagcatgtgttaactttataacaaaaactgatatttaaaaatacatagcattaaaaaaaattcccaaactttctcagttcacaacatcctcagggtttcagtaattagttttttcatggttcccctagatcaaaagaaatccctaacagttctgttcattgagtggttcagtccaaacaacttagtaaccgcttatgtcctaacagcttagcagcagctaagaaagataatacacataaacggaaagaaaactaatattttcttttccttcttccatgaccacattacgtacaatctgatgagtgctcccgttgggcactgcacttctgaaaccttggactcagagtggacacggcctcatttcctgtccacagtgatttcctcaagactcttggttcctctcagggcagctaccaaccccccgctgtgagagacatgatgtcatggaaggcagggtggtgcagtctaatgatgacactctgcacctcttcaagcgagtagttcacctggtctcagaaccatgtttcttatcaaaaactttagatattcctgggcacccctatgaattcagtacagttccctgggttaccttggcacacaatttgggaaccataggcacaaacaaggcttatgggcttgtcctggtattttcactaattaggatgtcttcaatatctgtcttccatgtcttcttccctggctgtgtctaaatttgaactatggtgcagatcttgctggaactctggaccttgagcccttgactcctgtctctttcaggccagcacagcaggaaacttacttaagttatctttgaagttgtattttgaagctcctcttttaattgcaaagtacttggaaaggttctgcctggctggcctgccccagtggagagcaagtttcaggagaagggagatggctccttcctcctttctggtgggccctgaccccttccttaaccttgtgtctccggaatgtcatcctcagcaactgcgtgagaagaacgacctttggccttttttctctcttcccagtatgggcgaacgcctctgcaccttgcggccaacaacggaatcctagacgtggtccggtatctctgtctgatgggagccagcgttgaggcgctgaccacggtgagtgcccacagggcttcgtgaaggagggagctgctgggagcctctggcgcctccagggcaggagggacagggcttgtatggcaactctgcattctgaagcagccaggctgctgttcagccatagctcctccactgcggtaacatagacattcgcctacacatgcccagcctaatgtctccttaatgttcgtcctcttctcatctcaccacaccctgctctgccagggattccgctgcttcccgctggcctttttgtttttcatgtcacacaccagggcccctgcatggtggggtgtgtgtacttccccttcctaaatgctcctctgccccagggtgctggagcccctgccctttagaaggagctgggggaggaagaatcctcagtgggtgttgggtgcagtctccacatttaccccacaagaccaggctgccaggtgccgtaagcaggagttgcttaaagagtcaggcattgctttaggcctgtggagtattttaagtgagatttcttcagttctctcactccctgctcccgatgccagacctagcacctccctgctgaggaaaccctttgattcacatttcatgaaatacccaagaaggaaaatgcatcagctaatgaggtatggttgcaattttatggctgcagtgaaataatatcattcgagtgtttgctggcctgagagtaggctgactgtccagtctttgtgggacagtcctggactcacagatgagagctttactgacagagggtgattctctgaggagaccaagagggcctcatttcctggagatcatccagaggttagcaaaccatggcccacgggccatatcccgctgctggtctttgtaaatgaagtcttattgggacacagccatgcccaaggtttgtattggccctggcggcttccacgccaggtgtcagagctgagcagctgtgacagagaccatatgggccacagagccgaaacacctacttgcctggcccttgacggaaaatgtttgctgaccgctggggctaggatgtcgcctccccgaatgcactcatgttactgggatgtcattccctccccagaagtaataggtctgatctgtgcagtggggggcccagctctgtgctttctctgcaggcccagttattaccagtactccgcatggggtgaggcccctttctagggcacctggtcacccaccgcaaacgcacacaccatacccacatcaccctgctgtgcctgacttgctagatcttgttggccattgtcaagccctgcccagccatgcttgggcacaggttccagttactccctaatagagcatttatatgcattttcaagacgaagaaatatttttgtcctatgtgtggcctcatgaaagacccagccaggccattattgaagatgccagcagctgacgctgctgattcccgcagtgcgggttggggctgctgaaatgtgcggccccctctgtagggtccctccgtgagccgcgggcccctctgcccttgcccacgacatctgtatcagtggtccccgcctggctcctcctcaggtccctccgtgcacctccttgctctcccgcttgccaccgcaggaaaagcgtcttctgtccccaggcccctcccacggtgcccagagctaacctcagagccgcacccgcagcgctcattctgcagccccctcagtcactctgcacacaccgcacccgcagtcactccgcacacaccgggggcacagtgagagcggggagtccagagggacaagacaggcacgcgcccctcaggagacttctggaaatgggagagggatgctgacctgagagtcatagccgtcaattacagtcactgaatgggaccgcgtggtgacaggaaggagtgggtcctgagggcgtggacaggggctgggggcgcccctgcgggaggcattgctggaacctgcaggccaggccccgtcctcagccggacagagtcccgggaggatctccctgccctgttcaggaccggagctcagcggcctccagtgccctcctgcggtgggagcacaatgtctggagctggcgtggaggcccaggagatgggagggtgagcagagcttggtgggcccggccttccccgcagggaaccggggcttcctctcccgtgggcagccaggggagggttccgcagggccggggagaccctccagactggagggcattactgggggcgtcgccctcagaaacgtgaccacaccacatccctcggtttaagtttcctagcagccacatggaagaaggaaaaagaaacaggaaatgaatttcaataatatattagcacaagatatgcaaatattatcatacctgtcaataaatttattgattgatttattatttgtatatattcatagggtacaagtgcaattttctccactggtatattacactggggtgaagtcagggtcttcagtgtgtccatcactggagcaaagcacattgtacccatcaaacaaactcccatcctccacgcgcttccctccccttcacccctccaagtccccgttgtccatcattccacactcttcttccctgtgtacacatcatttagtgcccactttaagtgacagcatgtgatatttggttttctgtgtctcagttgtttcacttagcataacggcctccatttccatccatgttgctacaaaggacatgatttccttctcttttttctttattttttatttttttgtttttgtttctgttttttgagacagagtctcgctcttcgccaggctggaatgcagtgaggcaatctcggctcactgcaacctctgcctcccaggttcaagtgattctcctgcctcagcctcccaagtagctgggactacaggtgcaagccaccatgcccatttttgtatttttagtagagacggggtttcaccatgttggccaggatggtctggatctcctgaccttgtgatctgcccaccttggcctcccaaagtgctgggattacaggcgtgagccaccacgcccaggctgatttccttttcttaatggccaagtagtattccattgtgtatatataccacaatttttaagtccagtcctctgtcggtggacacttagtttgattccctacctttgctactgtgagtagtcctgcagtgaacatacaagtgcaggtatgtttttgacataatgatttattttccttcaggtagatacccagtagtagggttgctggaatgaatgggagttctatttttagtcatttgagaagttgctgtgcgtaatttctctatgttttccatagaggttgtactaatttacatacccaccaacaatgtataaaagttcccctttctctgcatcctctccaacatctgttattttttgactttttaataatggccattctgattggtgttaaggtgatactcattgtggttttaacttgcatgtctctgatgattggtgatgttgaacatgcttttcatgtttgtgggctttctgtcttcttttgaaaaatgtctcttcatgtccttagcccacttttaagtgggattattttggggtttttgttgttcttgttgagttgtttgagttcctggtacattctggatgttagttccctgtcgaatgtagagtttgcgaatattttctctcattctgcaagttgtctgttcactctgttgattatttcttttgctgtgcagaagcttttagtttaagtcctgttcgtctatttttagttatgttccgtatgcttttgaggtcttagtcatgaattatttgcctagacccatgtttagaaagttttccctgagttttccttcagtatttttataatttaagatcttccatttaagtctttaatctatcttgagttgacttctgcaaatggtgagagagaaggatacagtttcatttttctgcaaatagatatccaactttcccaacactctttattgaaaagggtgtcctttttccagtgtatgttcttatcagttttgtcagagaacagttggctgtaagcatgtggctatatgtttctgggttccctattctgttctattccattatctgtttttatgtgggtaccatgctgttttggttgctatagccatctagtgtaatttgaaattaggcaatatgatgtctccagctttgctctttttgcttaggattgctttggctatttaggaccttttgtggtttcatatgaactttagagttgttatttctaattctgtgaaaaatgaggtgagtattttgatggagattgcattgaatctgtagattgtttcaggcagtatggtcattttaacaatattaattcttcccatccgtgagcacaggatgtttttccatttgtttgtgtcatctataatttgtttcattagtgttttttagtttgccttgtagagatctttcacctccttggttaaatatattcctagtttttttttttttttttttttttttggtagctattgtaaatgggattgccttcctgatttggggctggatcgtcattggtatataggaactctaatgatttctgtatgttaattttgtattctgaaattttactgaattaatttattaactcagaattttttggtgacatcctcagggttttctagatataaaatcatatcatcagtgaacagggataatttgacttcctcttttccaatttggatgcctctattcctcttgcctagttgatctggcgaggacttccagtattcttaaattattgagatttttcacattctttggtttatacaaagctttccttctgtgccctcacagcgcatccttactccccaggtttcaagctgagtcaaggcctagggaggggcctctggtcttcctggaaggcccagcacctacgccttcctcctaccctccagaagcaattccatcctcctctccttcagaaccacccttgaccaccagcgccccctgctgccaccttccctctccgctgagtcctcagccagggggacctgaacaagtctgcacgtcctgtccccactttgtccttgcctcccctactcctgcaccctccactgtcttgccttccgttccacgtaaccctcagcagagtccccactcacctcctgacagctttccttctaaactgtcttactataaaagaaagcatagatagaaaaaagcacataaaccaatataaagcttagtgggtttccataagacaaacacctttgaattccacgcaggtcaagaatagaactttcccagccaccccaaaggccccatgaacctggcccagctgttgcctccgctcccgcccactgtgagcccctccctgatttgaagccagctcttccttttgcttccttgttatctttccacccaagccccagctgctgcccctaagcctctttcactggatatccccaggactgggcacccttggcacgccctgacaatcctgcctgggctgagaaagtccccgcgtcctgcttctccctaggcctctgcttcctgctggtccatcttctccctctccatccccctggccctctctggcccccagacttgcagctgtccaacactgaggcccatgctcaggtctctggtccctgcttgcccctgagtgccagcctcacacagcaccttcagaggccctcggcccccccacaccagggtccctccctccagttctgtgcttcctcctccccagtgttcagcctctgcaaagggcttccgcatctgtctgtcactctgcccaggatcatggaaacccttcttactctctcctcacctatttgcatctagccggcagcctactaagtctcctcccacttctccatgaccacgaagcacccgcctctccagcccccacctggttaagggcgtcacccttaaccttagtctcctccagaccagtcggactcttcacccacccctgcactgtagcctcctgccccttgggaccagtccatcccagccccacgtttatctttctagaaatgccagccactcagtgggctccactttcacctccacctggggctcctctgccttcaggatgtgaactctgcagcctctgcccagcctccccttcccctcttctccccttcagttgtggctgggtcctgggaagcccctgccggctcccccatcatggagttgtcacctgctgttctttcaccctggagctcccctttcccccttcaccccctgcgcatagtgtgcccacagcatcagcacacacaggcacacatctctctgcccacttctgccctgagggtacctgatggcgctctgccttcagagagagacttggaatgcccgctacgggcatgtgggcacacagcccataacattcggggaagactccgtggcacccactcctcctcatccatcaacattcacctccagcccaggaaacctcctctgttccagcctctccggtgtgtgtgatttgcccctgtgggctggtagtcccttcgccttccttgctctattggaatcgtatccggatttctcctagcaggagtgagcccttgggcaggaatcactgggaattcattgctgcctcctaagtgggctccctgcttccacccttacctgtccacagcctggtccccacgcagccgcctggtcagacgtaagtgagatctcatcctccttgctcagatgctctagcaacttctcatgggaatcagagcccttcaaatgggggcttccccaaggatctgcccctgacattgcctccctgacccccatctcctgttccgcctcctcccgtctccctccacatcagccccatgagcttccttgatgttcttcaaaagtgctggccatccaccgcccgggggcctttgcacttgctattcttgggcctgagtggctcttccccaggtatccatgtgatttggtctctcaccttctgcaggttttgactcgagcttcaccttctcagggaggcctttctggaccaccctattttaaatcctatccctcccccacccccaggactgcccctcatctcccctgccccatttttcttcatagcacctatcaccacctgacctactgtattttactcacctatttgtttcttgttggctctccccactagattctggatcccatgaaaatagggacttttgttggttttattcactgctgtatccatagccctgtgcataatacgcactcagtaaatacctgctagatgaaagtatgaaggaaggaaggaaaaaatgaatggcaccatagtccaggcaggacatggagtgtttgttgaccgagtgctaagtagatgagcccttataattctgtaggttaacaaaaaatccatattttccccaacactatctaaagatgtttaaatgactgtgcacattctttcagatcatcttttcactggggatacacaaataggtttccctgtcaatgcttgccccagttgaaaccccatctgttcctttgcgaagcatattacacgtgtcactagaagtcatgactgtgagcatttccccagacgtcaataagcagcatgtctgtgaagggcaggctcctaaaactggctggcctgtggggctccggcttcttgaacacaataagtgaagtggcctttcacctttccatggatttctttctatgtcatggggccaacttgggaatcactgcccacagtctagaatgtagtgttgtgggctgctggtgcacaagagacaccgtgatttctggacccaactcacccttctgcagccacttggtccccagggctcacgttgagatgatggacagctgagtgctgagacacttggccatctttctatatcttttcaatgcatgcacttcattgagtccatgagccctgttggtaaggaggagggcagcaagtgtaagtgttgcttttgcagcctccgtcggggtgtccagtagagccaagaccaaaatgcagagatctgacttctgcccctttccctctcagacagaaggccaggtagttagggcaattctcagctcttctgtgaataatttccaacactgcttgcttcttctgtgcctggcactgtgctggttctttccatttggttttctctcacctgctcaagaacctgtgcagggagggtgccattttccatcttgcagatgaggaaacccaggcttgggaaggctgagtgacccaccacatagccggtgaggggtgggttcaggacttcaaactgggtcttctcccaacttcaaactgtctcctgcactgccaggcatttctgttgaaagtctgaatagtgtcctttagagcaacatgttttgcaagctgtaaagtgcagtgcaaatgtgaggaaacatttttattttatatatatatatgtttttgtttttgttttttttttttttgagatggagtctcattctgtcacccaggctggagtgcagtggcacgatcttggctcactgcaacctctgcctcccaggttcaagcgattcttatgtctcagcctcctgagtatctggaattacaggcatgcaccaccacacctggctgatttttgtatttttagtaaagacggggtttcaccatgttgggcaggctggtctcaaacttctgacctcagatgatccacccacctcagcctcccaaaatgctaggattacaggcatgagccaccatgcctggctgtgaggaagtattgttgatggtggttctcttgactttgaagaggttgaacagtggagagttcatcctgtcggtgaaaggcctctgcctgtgttttgtgcgcgtctgagctctgcaagaggaacgtcctgttcagacgtgtcgggggcaggaaacttcagtcaaggctcagatttcttctaactagggcagtggttcccaaaccttgctgcataatagaattaacctgggagcccaggatgtaccccatactgctgacagcagtgtctgtgtgggagctgggcgacaggatattttcaagttttacaggtgattccagagtgtaatggagaaccccttctctttatggacttttcttgtgtccacaaaaaaactagagcatttggcatggatccctggttggagatgcagtgtctgataaggcacctaattcacccccaaagcaagcttgaagccctggcctgcccactgggggatatttcaggaatttaagggaacagagagacgggcagttctgactgcacagcaagcctccactggagcagccacctgggcttcaaccggcagcctaaggcagtggttctcagcaaggcaattttgcctcctcccccagcaattgccaatgcctatttggttgtcacaactgggagttagggggtgctactgccacctagtgtgtagaaaccagagatgctactaaaattcctaagaggcacaagacaggcccagcaacagagaattgcctggtgcaaaatgtcagtgttggcaagattgagcaacagtgtctgaatgggaccccaggcatgactctgggagtgacttgggttgaggaattgagaggttgctgttaagtagatttcggatatccctaagcttctacaaggatgcaactttgttattgatacacattgatagataaaccaaatccttacttttttattaaaaaaaaacattcattttcatttttttaaattgcttttcatcttttctacttttgaatttttagtgatctctaaaactgcaacagaacagcccctacatgtcccttttctccccagtggcaggggaacagtgacagcttctgcctctcaggggtgacttcaaggactgaggcttgcagagagcactgagagctgggtcgagcacatattatgaggtggtgttcaataaatacttgctgtcatcgtgtatgttcatggtgtagatacagaaacaaatttattcagtgtgaaactgcagcctatgaaaaatctctaaataaaaagcaagcataaaagtgctgtggactcttatttccttgttttctgttcaccaaaagatctttcaatcaaaattgcctgtcaaactaagtatttcctttgaaatgcacagtaattaccaggagctggtatcatgcaagggctgggtttgtccctgtaaggattataacacagtagcttgcactaactagaatttggcacctgatgagaatctttactgtctgcctgattggagattggagagaggggttcaggacagggaggaaccagccagctgaggaggctgttgagttgtgattaaacctgtggacctgaaaggtgtcgctattggacaggaagacaccaacatgtgctttgttcctgcgtcttaccttcctgtcctggacaatcaagtgaaataaggattgcacagccagagaaacacaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggtgagaagttctgttataggtctgaagttctctacctgtgtttatgtgaaaaagtctcagtctttttccttatttgagaatgagcaaaatgaggctctagacagccaggttttaggaacagtggtccctgtcctgtggtttacatgtcagtcggtataaatgcatcagctccctatctgttttcttctctatttggacttggaaatcatttagcatgtttgcagttgccgtgcctggttttccttctcccactctctctataataaaccactcccacaaagtagcgggggatgaggacgctgactctgcctctttccttcttatgtttgagctccaagatggctgttaagctcctatttatcaaacattgttgctctgaggcttaaagaaacatgacaaaaataagtaaaggcaggtgcaccctttccagcctacaacatgacagttgtgtcaggagacttcacaatagccataccctttaatctaggaactctgttttatgcttaaagatgttcactgcagtattatttataatacagtaataaaaattggaaacacagataacccacgataatgtctagtaaagggtcctacagccatagaatagaatggctttggccttttaaatattttaagaagttttactaataggagtttattgcttggggtgggggggggtcactgggcttcaaagcagaagacagattgtatataggtaataatctctactatgttaaaatccatagaaagaaaatgatacaagtgatgtttttcgattttgctattatactcaacattttcttctttaaacattagtgtattttaaaaaatttaattactgtattttttttaaaatgttataacaatggtaatcatttttttaaaaaccacaaactatctagaaataaaatgataattcatttggtttaagtgcttgctgagaagataatgtccaaaatatgctccagatatcccacaaagttcttgccatatagaccgagaagtgcctggggagaagtgctgaggtcataaccttcacagcccctgaagtttatattttcatacatgtcctgtggtcttgccaggggcaggggggggccacagattgggataatttctttcctcatgcagaatatagacttggagagacacacttcatatatgcatattaaaaccccttggagttgacctggcaggggtaaaatcatgggtgattgattttcacacccttctgctttggattctgagaactggcctcagaggcactgagcagatgttaataaactctgagagctgcgattcagtctcccctttgtcctggaaagtccagaaagagacaagtcaggtaaaatttccctagccttactcacctgttcttaccagaaattcataaattaccattatgggctcagtgatttctcactctgtaccattatggactgtgtcattatgccagcgaatttggactagaaactcaagggaaaccttttcgtttacaggcaaaacaagcaggggcaagggagatcccgtgagtcgtggttaccattcaagaatgagccttttcatagagtttcctaagtttaaaattcactgtctttcaagcagaggaccagccaaaccagacacgttgggcacagaatctcacgcctctaggctggtgtacatccattacccaggcagcatccattgatagtgaaaggagaagagaagtctggtttttgcacaggctaaaagagcacaatttctttttcctgttagttattaggtctctattacggtccactagtaggaagaaacactattaaggaaggctgaaaggcttcttcgacaggcctcatagctttaccgagtgcataagcctgcttggtcaggtgtgctcaggtttccacacagagaggctgcaaacccacctgcagcacctggcacctggcttgcatccctgagtccccatgctgtgccctcccaggtgtatgatgccctggctcagctcacacagcgccagcacttccaccactaccgccctctggaaatccgcttaccacattcactctcaacttcgagtgctgtttaccatctaagaaactgtattacagagcaggggccagggggacctgcagtcagctcattgtgaggcggacactcagctgcagcaaggtgacctgcaacaccctgtcaggtcactcgggaaacccacctcatgcagagggaggaggcgtctcgtgggctgtgctgtgttctgctgcccatgcccccttagcaatggtcccttctttgacttaaaagtagcttactgtgcgagatgcaaacccactgtttggacgagtctgaaaacagtgaaggaatgctcagaaaaaggaccgagggagagcagtgttgcactagccggggatggtcggatcggtggtgggtggaaggtccttctcccgtcctctgtccccgttatctgcagcctgcttagatgactggcatagtgaggagtagagatgcaaagcaccttgctgcggcgcttcctccaaatcctcagtgaaaggggcttgttcccatttagaattctgagtttctgggggtgggctctcaccctgtctcagtttgggattttcttttcttctatccattggtacctttgtttttggtgcctagatttttaaaagagatgggaagtgaactattacagctataaaatacaaaatacaaaaatataaaatatattttatagtttataaaatagaaaaaactataaaatacaaaatattattttgtgttttaccattatcctgtggtctttttctctaaaggagaggtcaaggaaaagaatagtcaccttttttttctttgtttttttttgagatgaggtcttgctctgcggctcaggctggagtgcagtggcatagtcagggctcactgcagcgtcaaactcctgggctccggtgatcctcttgcctcagcctcccaagtagctaggactacaggcacgtcagacacgtgtctccacacccacctggctaatttttaacatttgtattagcaactatgtctcaatacattgcccaggctgtctctaactcctggcttttagtgatcttcctactctggcctcccaaagcagtgggattacaggcgtgagccactgcacctggtcagaatagtcatcttaatgccctaattaaaggacaacatcccccttagcacccagagtccagtgaaaagtcccccctcatctttatgtagaagcaaagtacagagtagtgcctaagagcagagactggaggtcagatggcctgggatccaactccagctccgccacgctctagctaggtgagctagcaagctgttcaacagctctgtgcctcagtgtccccgcttgtcaaatggttgagtcagctgctacctcccacgaccgtgataagggttggatgggtcgatgtagatgatgtcccttgcacactgcctgcacacagtaagcaccacgtgtttcctgttattgttggaaccccgcagaccactctggaacagctgtgaggtgcagcagtggcccctgtggctgggcaccctgagtgtcatttgtgatgacagccaccattgagcgctcagtgtgtgtggtgggcactgtgattttacaacacacagtttgtaaaggtttacagaggggaatgttgctgcaggaaacctggattcaaagaggtgagcaacatactaatcagtgcagacctgaggtcctgacctgacctggaaatacctgtgatctgcttttaatcaatgggctcggggggctccagggcagattcctggcctgatgggatatgtcctttccacactggctgctgtacctgtgctgagccacctgctttgtagtgcacagggatctccttcccatggggaggcccagggttctaattccctcagaatcttctagatgctgtgttcaaggagtccctggaatttgtttgtcttcatcatccctcagtgggctcttgacgttagcccctgattagccataatgggaggagttgtctgccaagcattgctaattgcggtctttcttccttgtgtatgaatataaatccccatgcaagtaactgcttggcacctgggcacacccggtactggaatttggttattggaaatgactgagctgtcgcggcagcttccttggagaatgcatcgctgaggattgtggggagcccagaagcaggcaatgcctgtggaggacaccaggaaggggactgacctgcagttctaacttgggtcacctggaggaggagacaatcgggtacatgatcggggaggggaagggaaagaagaagtcattcaccctgcagagcatcttaggaccattttcctttccatgtcatttctccttgatattccccagtgtttctcactgggtgctgttggcagtttgggtgactgggaggccctgtccttgcaggatgtttcttgtccctggcctccaagcatctaacatgctagcattccctacagccatattgtgaaaaccaaaagaatccctccacacattttctctcaacccctagggtgctaccacactctgcaagaaccactgcaggttgatccaaagcgctgtcctggggagaggtctgtatctgggacagctgaggatggtggccctacattgcctgccattttatttggtttccaaatgggccaattgagcaaaagaaatactttctatctacgctgtcagctttcatcagttgacattgcctagcaatgtgtctttaaactatatttgctagggaagcaatgggatttggcatctggaaatagaaccaaaatcatcctgtttgcccgcagcagtggaagatgtgcaggggagagggactggctgttttgatcactggagagttcaaggggcaggagactgaagactgctgaggccaaggctacagctcttggggaagaaggaacctggggcagggctgagctgcatgggatcgactctgacgcacctccacattaagtgaactcgggcagtagtgtgcaggagcctctggtgctgtccctgagcgccgagcttgttttcccaacctggtgacatcacatgggagtcttgaaatcagccagggagggagcatttgcaccacaggaatcagcaaatgctagagatgaagtctgcttctccctaccaaaggttgttgataggttcatcattgctttgggggtccctgagagcccgcgcttggctgtaggtaccaccttatcacagagggaagttgtaccttctacttccttgcgctcagtcagtaacagagccctgggcagctgtccaaacctgcctgaggactgtgttgttgctcagccaaacccagttctccttctagaagaaaggagggaccccttctatgggaaaggggttgatctagatttttatatcagcacccatttttactataatcactgcaagttccattcttatctgattttaaaataagaatttcaagggggttgaggagttggcttatttttattttgtttggccatccttctaatcagattttccgtaagcctgaaattaaaagtaggctgggtgcggtggctcacgcctgtaatcccagcactttgggaggctgaggcaggcagatcacctgaggtcagtagttgaaaaccagcctggccaacatggtgaaaccccgtctctacaaaaaaaattaaaattaaaattaaaataaattagccagagatggtggtgtgtgcctgtagtcccagctactcgggaggctgaggcagtagaatcgcttgaacccaggaggtggaggttgcagtgcactgagatcatgccactgcattccagcctgggtgacagagtaagactctgtctcaaaaaaaaaaaaaaaaaaaaaaaaagtagtttgcttttactaaacctaagacccaacagtgaagaaaggtggccaggaatattttgaaaaatgaaaacaattggggagttgcccagattgaaaaattcaccacctgtaaactgcatttgcgtaattaaaagttgctgcaccatccgtgcagtctcactgcaccctgccacatgggcaaggccacatcgcctctcagtgctcttatctggccttcccagaccgtgaatggtcttccccatcagcttgctaatgtttagtcttcttgtctgatgagaaagtgaaagctaagttgctagggagaaaacagtactggaagaaagaaaagtagaaactaggagatttaccagggcttcaaagagcaacacagttaccaaataacattcattcactcacacactgaaaagatatttccagtgtctactgtaagagctgttctaggcactgcagagaccacagtgaacaaaatcggcagaacccagccaagaaaccgataagaaaaatgtgtaagtcaggtcaaggggtggcaaacaatggcctacaacccactgcctgcttctgtaaataaagttttattgagacacagctacacactcttgtctgtgcctggtgttcctacatggcagagttgagttgccacagagaccatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccgggtagtgaagggttggaggagctcaagcataaaacaacaaagaaggagggtaactgggctagggtcagaggatgtacctgggtgtgcaggcagagaacaatgcccgacatgacccgagaggcggcacagctctatagaccttacccagcgggtgaggagtttgggtttgggccaagtgcaggcaggtgtgagatctgccttaggtttaggaattctcccggctgctcagactggagcctcagggtcaggatggggagcagagggacctgataggaggtgatcttggcagccaggggagatgtgacggtgcttggactggggctgtccaggctctattacttagtgagccttgggcaagaataccagggaggctcctactcctgtgtaaatatttaaaggatgtgattagagctaatacaggtaaatacattctaccctacacacacacacacacacacacacacacacacacacacacacacacacccttatgaccacctggaaggttctgagtcagaattctgcgctccttggagttcggttctgcctcctcctctccccagcctggtctcgccctgactgcaggaggtcttgcccacaccctggatgccccaggtctcctgagtaccctccagccacacccacagacctaggggacacacactggagagcacttcaaaccatgagccaaaaatgtcggtggcaccatagtcccctctcctctcccctagaggtgttggctgcacatggctcccacctggcccagccagggagggcccgaccagcctgggcttcgtgccagccaggtctcagggttgtcttgtaacttgtgttaaacacacactgtgtaaggactactgaactccccctccaaataaatcagtcttcctagcaccttctagacctggcctggagccctctctgagttggagatagatcattacgtggatgaaagctgctttcccagggagaggcctctgcgccacaacccgtccctacccgccatctggtagtgaaacgtgaaaacgtgcctccaccaatgagggagatatattcggatgtgcttagattccccaaggttcttagtgagcaggacgaggggtcatctgccaggatcagctgagattttcttgtgaagggaaatacccgaggatattttgcttttctttgcctttcaagatgatggtgaattctgtaagtctagatcagcgcagtttcctggcctctcttcccaaagacttggtgaagggtgagtgggcacatcttggccaaggctgacagctcctggtggaggggaagggggtgcaccaaggacaggtgcactccaatatttcactccaaagggtgccctattcaggaagtgccttccgagtgggatgcactgtgaggggccctccttggatggtcctcagtgctgtggggttcaccttcaatgtgcacatccctgtctgttcctgtctcctctgcttctgaggaacctgccacctccctttcagtgtccagcagtgggaggaagacctggtagtgagttctggctttgctctgtcaccttgggcaagtgccttggcctctccaagcctcaatttcctcatccgaaagggaggaggatggcattaaccacaaaggttccttggaggttttcatagggaatgtgagtgaaggcatagcatgagctggaaggcgccgtgcacgtggaagttactgctgcagacaggaaacacatctgtctcaactcctcctgctgcctcctccctccttctccatttattgtgctggcccatgaaacaggcagattgccaggagcttctgaaccagcattgccctgcgtggaatttgaaggagtgagctggactgtcagtacagggaagtcacaggcatagcttgccctcatacacaggagcaagtcagcctgcaggttcagtcgcttctagaagcctctcacaggggcagcggtgtctgtagttgaccatggttcgagtctcctgagagtggaagggcctgtgggattcctgcagaaggaatgagcttgccccattcctgcagacaggacagacgtgtgtgctgaagctcaaagtgtcaagatccacaggcacaaaacaggaagaaagagctgcaggcagattcatggcacagtttctttaccaaaatgggggcacccgggatccagtgactggatttaaccaggagcagttttctgccttcccctggtctcagatgaagcagactcgggccggtaccaagaatctctgtgtggcaggagctgcgttcagggaatagatggggaagtttgcatctaccctgtgggatgctcaccatggaaggtgaccactgctcagcacagtggacgcagctcaggtgctcatgcatggcatggtgtgggtatagccttggactcacaaggaagacccagggctgctgcggaaggctggagtaggctgggaggtggaattgctccagggtcggtggcagcgcggcagcatgggcgcacctggtgcacgtggcgctggggacaattcagagccccattccttccagcctgacaggtgccacccccaatgagtaactcctcataatagaatctgtccagcttttttgctgattcaggtaatcagtcagggacattgctatcaagacccccagtcctttcctttccctttggtgctctgtctctgaacctgttgggatttgaggtcagaagaaaacaccagagtacagaccacctcgtgttctacagatcatggtttggtgccgtggcctccaccccagctgccccagcattttacaacacaccttgtgtcacgctcccttgtagaatttatagacagggacgcacctactacacagatagtttcaaaagatcagtagcatgccctaactgtaatataacacagaccttgtgggagcatgcgcatagtgaaatatgctggatgtcagcatgcatgtgctaggacacaggcaggaggaggctgggaaacccagcaggtccctgcactcacgcacaggatcactgagtgcaacccccacagacgcccacggacactggagggctgggatggcagctccagcaccacagcagcgtgctgagctgatgtccagaaatcggagacagcactcagcaaagataaaaggaaaaaagcaaagtgtagttatttgccaatctataaaatagcagcattcgtggataactcagtatatattaaatactgcccccaaaaccctgtggatgatgtgtaaaatgtagttaagttctcagctcagatgattgtaaacaggcttttcccctatataaatgctcatcagatgctcagaagtcaggggacccaggagaattcttcgctgtgaggggcattttgttacagggtgtctggacacccagcgtctggctgcaggaatatcccctcaacattgtgggaactaaaatgccacctcagatttccacagtgcccaccaggggtcagtatagttcctgttgaggaagtctggtcctggcttaggaattgcaaatggaaataggaaaatcaaagccttcaggagagttatgtatgagattgtagcaatgcagttataacagcaaaagtaacactggcttttgctgctggaagagatcaggagatcagaagtaagtgagcgcctcccaggatttagaactgaaggaatggtcccgccaggtgtagatcacatggaggtgcccttgcgtgggtccctctgagttctgtcatttatatgacactggtttatggcgattctacacctgccagggctgggaattccgtctgtccccgcagatgggctcctggtctagaagggagagcaccccataattacaggtcgggggtcaccatggagagccacacatggtgggaagaagcaaccaggaggagatggcaggcaagacaggttttgtgggtttgtgggaacccacaaagcaggttaaagcagagggggtcctcctgggtaagggtgaggaagaggcttcaggctgcacctcacggctccaaacaggtccttgttagggagcagggcaggagtggtgggaagggatggtggcctgtgagggggtgtgacaccagggtggcatggtcagagccacatcacgtaaaccttgagcaggttcccttgggtgcactgaacgccttgcctacactatcctgttaaaagctcttacttggtattagatgtgaaattgttcacatgtctgtatctccccaagaccatggatctgggctgaatctagattttcctgttgtccgcactgcgcttagcatggggttggagggcctccctaaatgctggttgatgaatgaaggagtgagtgagtagcgaactatttcattctgtggagcctcctgcttctccatatcagatggaaaaagaagaaagtaatgaggatattgtgttcccagccccctctgcagcatggagcttgtacgttggagtgccccttctctcatcctcttgtcccattactgccctaaaggatccagacacctccacacagagagggacagatgctcttgctggtcagacagggctgatcctatttcatgattaaatcgaaggcttctacctttcttcatctcctggctttccattttctttcagcctcttaattgattagggtaaatttttgattatcctttttattttatgtgtttagtaatatattaatattttaaaatttatttatttatttatttatttatttttcttttgagacggagtctcactttgtcacccaggctggagtgcagtggcgtgatctccgctcactgcaagctccacctccgaggttcacaccattctcctgcctcagcctcccgagtagctgggactacaggctcccgccaccacgcccggctaattttttgtattttcggtagagacggggtttcaccatgttagccaggatggtctccatctcctgaccctggtgatccatgtgcctcagcctcccaaagtgctgggattacaggcgtgagccaccgcacccgatttgttgtaggtctgttcctaggcttcttaggttgtcatgtggttgaaaccaaaagtgatggtagatatttttaatactcacatacaggtgacattgccatgaagttaaatcaaaagtgctagtagctatttaacagtaagataaggttcctattccagacctacagttatgaagtggacatttgggccatccaattatgtttttctgataaatttctaaataaagtgtgggggtcacacacacacacacgcgcacacacacacacacacattgaaggcttcacagttgctccatccaacttgtcatgcatcaaaatgcaatggaaataggcagattcttagagacagaaaacatctctatggttgccaggggctgagcaaagaggggaatgaatggcaagtgactgctcacgggtacagagcttccttttgggggtgacacaaatgttctggaaggagacagcagtgatggtcctgcagcactgaaaatacactaaaagcctctgaatttcacagttgaaaatggtgactttgatgttatgtgaattttacctgaattttcaaagttttcattggagatagaaataaacataccgccaggcacggtggctcacacctgtaatcccagcactttgggaggccaaggcgggcggatcacctgaggtcgggagttcgagaccagcctaaccaacatggaaaaaccctgtctctactaaaaacacaaaattagctgggcatggtggctcatgcctgtaatcccagctactcgggaggctgaggcaggagaatcgcttgaacccagaaggcagaggttgcggtgagctgagatcgtgccattgcactccagtctgggcaacaagagtgaaactccgtctcaaaaaagaaaaaaagaaacatatcttcagcatgggtaaaaactgcacaccggggattaggaatcttgagaatcattatttgcctctttttctgtcactcactggctctttctcatccatgctcaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacaggtaggaacctccatgctggccccgtctctccagcaggtgttggcttccgcactctctcctttcaaggtctaggggggaagggagttgtgtttgggtcacttggcctatactggaccctgtggccttagtggttttcaggtccaggttggctggtagccttgtgtgtgctgcctgttgtccagcagtaacagactgacttggcagtagcaaaacaagggcctcactgaaatcacagccacagacacaaaggtccatcctcataaatgtgcaaactgcagaatttgcacagtcagctttggggacacagttgcaaattgcattgcattctactcagggctctggccttagagacaaaaagagctcaaactcaaacagtccaagcatagcacagatccaatagcagcccaagaagggtcctcaacccttatccttctttctggagtgctacaggcagacccagtattgtagatacatagagcaacaaaaagggatttccaggaagcaccatcctgctcagttcaaggttggatagaggtttccagaggctccttagtggttttcagggatggtctctctggtcacatccaccctccttgggaacgtttgctgccttccgggccttccacagacagggttattgattcacattagggggctgtcacgaaacacctggcagtgagcaagagaaaatgatgcaatcttgggtgtgattccaactgaatcctcctttagacagagcgagtgagtttgtggaaagataagagaccttccaagagtttcctaaaccaggacagttttgtgctttgtgccttgattcattctctgtatatgatgtcacagaagagccaggtctgttccccaggttgatgctaaagtttgtgtttctcttacgtcccctcagtgagggaggacgctggggagcatgggtagctgcggagagttggctgagatttatattcccttttcaacttctgttctctgaacacagctatagaattgaaatgaggagaagaaagaataaccaaaacagagttataattcatattattatattgctgatacatatgtcaatatttatagagtactgtgtgccaggaactggaagaaatatggtctgaaggacgcctcatttaatccaagtgacagcttccgaggtgtttttaccgctatttccctgcagccttgaggggtcagttggcttctctgaggcgcacaggtggcaaatcccagaacatctggtgcctgagccagtgcttgtcaataacaccctgcataaggaattcacaggcacacctttccattttccagtgtgatttttttgttttttgtctttgcatattaagttaaatgttattacaaaagagtcaaaactttaaaaaatttaaaagtagataatggaaaaaatgtgacagaaggttaagattaatttattattaaagaaaaaaatttattttatttatttttttttttttttgagatggagtctcgctctgttgcccaggctggagtgcagtggtgtgatctcggctcactgcaacctccgcctcctgggttcaagtgattctcctgcctcagcctcccaggtggctgggactacaggtgcatgccaccacaccaggctaacttttgtatttttagtagagacgaggtttcaccatattggccaggctggtctcagactcctgaccttgtgatccacctgcctcggcctcccaaagtgctgggattacaggcgtgagccaccgcacctggcctccagtgtgatttctgctctagttgaggatttaagtggggttcagttgctcccttagagggaggcagcacgctcctgctgtggttaagggcactgcagcctgaacctctgtggttaggagggtgggatatgagagagagagagaggtcatgagctcatgatctggaaagtttgcaaggcctaagtgggtgtgcagatgatgcccaggagcccccattgtggagtcctgggagtcacctgtggctctgcccttggcctcagaggtgaggtatccatggccttgcttctcctcagtatctgtgtctggtctttgcagcaggttcctggtgaagggtggctctgggtgaccctttttctgcacgccccaccatggggggagcatctttagccagggatcggggagggggtcctggcgcgggggcagaagcccctctgcatgagagccctaaggtgcaggcacaccagctgctttcagcccagccgtggggtctggggaggaggcagctgtcctggtccctgggcccccacagtcagtgccgcctgcccctggtggaggaagtgtgcgctggtggttgcccctgaagcctggtggctgagggatccctgggcaggaggcatagctcggcagctggacttggaggtggatgagacagacaagatgcccccatccctggactgggcgggtcaccaggcacttgctgccctcacagcttgtacatcagcatcagacagcgcccgggaaatgcagagcagggcacaagcacagggcaccgcgagggcggcctggggagattggactttggcagagggtatgtgtgttgggggccaacggagcagcgtggctttgttagacacccgaggaactgccgctcctgagcatgcctccagggactgggcctggttcctgaagcagcaacactgtcacctgccagggggcactgctcgtgcctggcaggccgtgctggggtctctttcaggccagggctctggacaccagtgacctctcctagaattgtcaggcccttttcccttcaatgagagagatgcctacatggcaacatttatatcatcagacagcaagaagtttgcttttagaattttggcccttttccactgccgttctcttgagaacgctggaggccaaggctgagctcccagccaggagaccggacggggtcccctcgaagttttctgttgcacacatcactcagctgtggggacactgagggttgtggctgttgagctgtgggaaggaaaacatccaaggtcataggaggcatgaatgtccaggaagagtatttgaagaagccattcctattcccgcggagaggagcctgcgggaggaattcccggtgaccaggtaaagtgggtctcctgggagccgtcacgttacaccgccagggggcagtagctaacaaaaatgatttcctgggatttcggtgcttccccatgaaattattgttttcataacaccttgtacaaagcctgtcctaaccttttatcctcccaacgaaaactgtcaccgaggagcaggaatgactgccatttaccaacgtctgctctcattaagcacagggccacatgccactaaaagaaggcttgttcctgacaggcaggcacccagacacaaattccaggtcacagggaagtggacagacccattcttgggcaacccagcagcttttgcaggctgggattaacaatatgcagagaaatacactaaaatggcagctatgttgacatcaagacttacatcattttgcttttgttttctatttacattcctatctgccaactttcctacagaaatagaatatgtgttggtgtttttaagaataaatcttgccctcctagtgccctttctcctttccctgtacctaatcctgcccttaggatccacttttcttctcctcatcccctccgttggatacccccattatccatgtccaaagtcttaactctttggtctttaagtaagggattaccttggtgtttggatcgcctgttttaaagtcagatacccaggtgaaatggtcacttctttagtgcctcgcaatgtctattgtattaatggtaaaccaatggtactgcagttaagatcaatgaatcccttctccaatgcaattcgttcaccaagttcttacagagcactctctgtgggccctgggtcacagccctgaccagaaaggcagcttctgcctgcacaagcctggtgggagagacggggagcagggcaggccagtgagtaactgagacagtgaggaagcacaggctctatgcctaaacgcaggggacccagactctgttattcagctcccgtacaacacccacaagttcaccattgtttacataatgtttcctttaaactgactcactttttaaaatgtactaaaatacattgatttgaaaatgaaagttaatatccctatcataaatgggaacccagtgtcactgccataagtaaaaataaatgcagtgaacagcaaccaatgtgaataaaatcccgctaaacgccaatgcccacaccctcttcattaaaagggaagatgagcaggtgttgaggaaatgctaaaatcggaaggcctcaagtggagactcgctgcaagaacaactgaaaggccttcaagggaatttcaaaaaggagtagctttcacagtgtgtgattcagcattatttaatgctatggcctgctactgtctgaaatcattttccatttaacctgcaataataatctcatgtgcaagagagagaagtcgctcagtgggagctggaggaagacagagactgcgagtatcagcaaagtagcaggaagtgagaagggaagaaacccgacctctgccctcccaccctctccacagcctcccgttggctgaccctaagcagaaatcacatggcaagccagcctagagacacaatccctaggaccagccacccgggcaacagggcggggcagaaaaggttgtggggaggtagagcaagcggaaaagcccacagccttgctgggaacactgctgccctgcacgtgtgagggcagacacactcagcctgaagccagagttggggtggggacagaggcgtgctccagaaaaggaaacctcagggccagcctgggagggagacaggcacacgctgcccccatcgagtactcatgtgatcctttccatcctgcagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggtatgccctgcctgccccaagggaaggacctcaggtttcccttcaacagggttgtaagtcatccctaaagggagcttgtcctgagctgtatctgtcacttccagaaggaaatccaacacagactgatattcagagtgagccaggactgaagcatggctggctaccatccctaaacagtgaaattaaacactggggtattgtcagcgcctagtaaagcacttggcatacagtaagtgcttgataaatgactgtggagtaaattaataatatttgtacatatttatggggtacgtgtgatatttcattgcgtgtatagaatgtgtatgtaatgatcaagtcacattatgtgaggtgtccgtcactttgagtttttatcatttctatgtgttgggaacatttcaagtcctctcttctagctattttgaaaaatacaacgcattgttaactatagtcaccctattctgctattgaacactggaatgtatttcttctatctaactgcatgtttgtacccattaaccaacctatcttcattcccctctccacacacacacacagccttcccagtctctggtatctatcattctactccctacctccataaaatcaacttttttagctcccacatgtgaatgagaacatgcagtatttatctttctgtgcctgggttatttgacttaacataatgacctccagttctatccatgttgctgcaaatgacgtgatttcattctgttttatgtctgtgcataaatagtgttctgttatgtgtataccacgttttctttattcatttgttccttgatggacacttaggtcaattccgtatctttgctattgtgaatagtgctgaagtaaacatgggcgtgcacgtatccctttgatatactgatttcctttcctttggaaaaatgcacagtagtggaattactagatcatatgttagctcaatttttagtctttttgagaaatctccatgctattttccataataactgtactaatttatatttctaccaacagtatataagaattctcttttctctgcatcattgccagcttctgctattttttttttgtctttttaataatagccattctgattggtgtaagagggtgtctcactgtggttttgatttgcatttcttggatgattagtgatattgaacatttttctcatttacctgttggccatttgtatgtcttcttttaagaaatttctatgcaggttcttgctcatttttgttttcctttctttttcaacttgtattttagattcaggggtccctgtgcagatttgttacctggtcatattgcatgatgctgaggtttagggtacaaatgatccctccctcccaccccctctagtagtccccagttactattgttgccatctttacatccatgagtaccgaatgtttagtacccccttataagtgagaacatgccatatttggttttctgttcctgtgttaattcacttaggataatagcctccagctccattcatgttgctgcaaaggacatgattttcttcttttttatggcttcatagtatttcatgatgtatatgtatcatattgtctttatccagtctgccattgatgggcgcctaggttgactccgtgtcgttgctgttgtgaatagtgctgcaatgaacatactagtgcatgtgtctttttggtggaacaatttgtttcctttcggatatatacccagaaatgggattgctgggtcaaacagtagttttaagttctttgagaaatctccaaacttctttccacagtggctgaacttatttacattcccacaacgtataggtgttctcttttcttcacgccctcaccagcatctcttgtttttttgtctttttagtaatagccattctgattggtgtgaaatggtatctcattgtggttttgatttgcatttctctgatgattagtgatgttgagctttttttcatatgtctgttggctacttgtatgtcttcttttgagaagtgtctgttcgtgtcctttgcccactttttaatggggttatttggtttttacttgttcaactctttaagttccttatagattctggatcttagattatgcctttttggatgcatagtttgtgaatatttcctcccattctgtaggttgtctgtttactctgttgacaatttcttttactgttcagaagctctttaattaggtcctacctgtcaatttttgtttttgttggcaattgtttttgaggacttagttataaattcttccccaaggtcagtatccaaaatggtgtttcctagattttcttctaggattcttatagttttgaggttttacatttacagctttaatttatcttgaattttttttttatatggtgaaaggtgggaatccagtttcattcttctgcatgtggcttaccagctatcccagcgccattgattgaatagggagtcctttctccattacttatttttgtcaactttgtcgcagattgggtggctgtaggtgtgcagctttatttctgggttatctattctgttccactggtctatgtgtctgtttttgtaccagtaccatgctgttttggttactgtagacctttgcccactttttgatgggattgtttgttattttactgttcagctgtttgagttccttgtatattctggatattaatcccttgtcacataaatagtttgcaaaatatctcccattctacaaattgtctcttcactctgttaattgtttcctttgctgtgcaaaaactgtttagtttaatacactctaagttgtctatttttgtttttattacctgtgcttttgaggttttatccacaatatctttgtaggaccaatgtcctgaagcctgtcctcttctactggttttataatttagggtatacatttaagtctttaatccatcttgagttgatttttgaatatggtgagagacaggggtccagtttcattcttctgcatatggatattctgttttcccagcagcgtttatttacaagggtgttcttttccccagtatgtgttcttattgcctctgtcaagttatttggctatgaatacctggatttatttctgagttttctattctgttccattggtctatgtgtctgtttttatatcaataccatgctgttttggttactatagccttgcagtgtattttgaagtcaagtagtgagatgcctctagctttgttctttacactcaggattgctttggctgtttggccactgttttgtttccatacaaattttccgattgtcttttctatttctgtgaaaaatgacattggtattttgatagggattgcattgaatctgtagattgccttgagtagtatgagcattttcacaatgttgattcttccaatatatgaccacagcatgtatttgcatttgtttgtgtcctctcagtgtctttcgtctgtgttttgtgcttttccttgtaggggtctttcacctctttggttaaatttattcctgagtattttatttttattgcagctattgtaaatggaaatgccctcttgatttctttctcagctagttcatttttgatgtatagaaaggctactgatttttgtaggttgattttgtatcctgcaactttacctatttaatatgaatttatttctcagatctaagagttttttggtggagtctttaggtttctgtagttataagaccatatcacttgcaaagagggacaatttgggtttctcttttctagtttatatgctttttatttctttccctttgcctgattgttctggctaagaattccagtactgtgttggataggagtgatgtagggggcattcttgtcttatttcagatcttaaaggaaaagcattcagcttttctctattcagtatgatgtcagctatgggttcatcatgtatgacctttattatgttgaggtatgggttcgtcatgtatggcctttattatgttgagatatgttccttctatacctagtttgttgacagcttttatcatgaagggatgttgaattttgtcaaatgctttttcggcatctgttgagattatgatatggcttttgttctttctgttgatgtggtgtattatgtcaactcatccttgcatccctgattgtggtgtatcatcttttttgtgtgctgttggatttggtttactagtatattgtgaggatttttgcatctgtgtttatcagggatcttggcctataatgatgatgatgttgttgttgttgtttttacattcttttctggttttgttatcatggcaatgctggtttcatggaataaattaaggagaactcctgccccttcagttttttttggaatagattgaggagaatcattagttcttctgacatccaaacctggacttctctttttggggaggctttttaataccagttcaatctcattactcattattggtctgctctagttttctatttctttctgattcaatctttgtaaattatctgtctaggaatttatccatttcctctagattttccagttagcgtatagttgttcataataacctctgatgatctttggtatttttgtggcatcagttgtaataccttacttttcatttctcattttgttcttttgggtcttctctctttttttctaggtcagtctagcaaatggtttagcaattttgtttatattataaaagaacaatttttcatttcatcagttctttgtatttttttagtatctgttttgtttagttcttctctgacctttattatttcttttctcctgctaaattgtggtttggcttgtttttgcttctctagttctttgaggtgcatcattcgattgtttatttgaaacgtttctgattttttgacgtaggtgtttattgttataaacttccttcttagcattgctttggctgtaggttttggtcttgtgctttgattttcatttgtttcaagaatttttttaaatttctcccctaatttctttcttgaccctgtggtcattcaggagcatgttgtttactttccatgtatttgtacagtttccaaagttcctcttgttatcaatttctagttttactgcactgtggtttgaggagatacttgatatgatttcaattttttttacatttgttgagacttttcatgtgtcctgatatatgttctatcctggagaatgttctgtgtgctgatgagaaaatgcgtattctgtagctgttggataaaatgttctgtaaatgtccgttaggtccacttggtctaacaggcagtttaaattcagtgtttctttgttaattttctgtctgtataatctgcctaatgctgaaagtggggtgttgaattccccaaatattgttgtattgaagtctatctgttcctatagatctaataatatttgctgtaaatatctgcatgctctggtgatggatacatatatgtttagaactgttatatcttcttgctgaattgatcccttttgcattatataatgaccttctttttttttttttgacttaaagtctgttttatctgatataagtacagcaactttcgctcacttttggtttccattttcatggaatatctttttgtatccctttactttcaatctatatgtatctttatagataaaatggatttcttgtcagcagcatatagttgggccatgttttattagtcaaacagccagtctgtatcttttaggtggaaaagttaattcatatacattcaaggttattgttaatatgtgagggtttattcctgtcattttattaattggttttttgttgtttcatatattctttattcctttctccttcattatcattgtggtttggtggctttctgtagttgtaatatttgagtcctttctcttccttaatatgtttcctctaccagtggatttatgctttcgtgtgttttcatgatgaaagaattgtcctttcacttccaggtgtagaactcctttaagcattgtttatagatttgatctagtgatgatcacttcccccagcttgtcttgtttttggggaagactttatttctccttcacttatgaagcataactttgctgtctgtagtatccttggctgacaatttccttctttcagttctttgaatatagcatttcattctctcctggccagtagaatttctgctgagaaatctgctgtgagtctgacgggcgttcccttgtaagtgactagactttttttttttttttttttttttttttttttttttttttctgttttcagacttccctttgtctttgacttttgacaattggactataatgtgccatggagaggaccttttttcgattgtatctgtttggagagctctacagcttcctgcatctggatttccaaatcttttgccaaacctggaaagtttttaacaattattttaataaatagattttttatctccttcagtttctctttacctttgggacaccaaaaacttgaatatttgattgctttatggtgtcccatatgtcacaagagttttgtttatttttttatttttatttttttaatgttgtctgattgggttattacaaaagacctgtcttcaatttctgaaattcttccttctgcttgatctagtctattgttgcagcttttgaataaattttctgttttattcaagaagttcttcaattctagaatttctattttgattctttggtaaacttctcataatattctgagttgtttttctgatatctttgtattgtttttctggattctcttgtacctcactgaacttgtttaatgtcatgattctgagtactttttttagattgcataggtttatttttcattagaatctgttgctggagagttattgtgctctttcggaggtgcaatatttccttgctttttcatgtttcttgtgtccttacattgatatctgtgcatccggtataatagtcacttctttgaactttttgaacttgctttcataggggagggcattttcctgaagatgtgtctatggtgttggttgagtagggcactttggctttgattctgggtgcatgcagtagcatagtggccatacgattttttttcagctgtaagcagctccagtggtgcctgtaattttctcagtggcttagggtatggttgttagtggaggctgtggtaaagtttttctggagatggggataccacgtgggccagtcctcagaacctagtggtggcagtggtgggctgagcatgcctgtccttgggccccagggtggtatatgctggtactgatactagtgggtccaggtaggttgattcttgggcctccagacagcttgctcaagtgctggtagtagtagcagtgggccaggtgggtagtcaggttctcagttccctgggcagcaggcgtggtgtgagtgatggcagtagtcataatgagacagccctctggctcccaagcaatctgtgctgatgttggcagtggctgcaatgggctaggcaggccagtacctagccctgcaggtggcatatacaggtgagtgccagctgtgatgatagtggtaggttggatgggcgtgacctcaggccactaagaggagtgctcaggtgccagtggtggtggactgggctaggtgatccccaggtccccagacagcatattcaggctcttaggggattgtgaagtcaagctcagcaggcctgtcgtcaggtcccctggtggtgcatgtgatccccagcctctggcaaaatgcttgagtcagggaggcagtggctgcactgtggctctgctactgggaagagtggtcctgctttcactgtcagcagccatatgcggccagctggggagtgtatgatttgcacatactttagactcagtggacacagcagcagtggctgcagacaggggattctgtccttggggcagatgaaaatgcacagccactactctgctagggacagtggggtctctgtcaatgggttatgcctagaccttggtggcagctgccagccaaggtggtggctgcaggcagagatgtcagtggggctctagggatatagagatgccgaggccattgggctacagagcaggatgcagtctacgggtgtttggaacatacaaatggtgccgcactgtagctgcttcggactcagagagtgcgtgggagccagcctgagctccctctctggagcaatactgtcatgcagtctccaggcagctccctcagctaatctcagggcccacatgggtgaagggtccccctgcaccaggggcaaaaattgcgggagttcatggtctgtgtgcattttgctctcttaaaagttgggcttcctctgagctccccagagcagagctggctgtggcagcacagagagaagagaaacttgtcttgggaccccaggccctgctcccatctgatctctcacagccccagccgcaacccacctcaggaccccacactccaagagccaatttctgggtaccagaactttccatgcttggcctaagcagccagctttggagggtggtccctcctgcttcactacaagtctgagaaaaaccctttagatctcagagtgcatcttgactgcaggattttgggtacagagtaagcactgaggggtaaacgaggtgaagggagccttcaaatcctgtaatggaagtggccctggccaggccgccccagaggccagtggtgggcggccacagtcctggcaggatgtggcagtgtagagagggggcatctcaggtccactggaggttccgggagtcctgggagctccaggtggaatctaatctgcagatatttctggggaaatgggcagccttcacagctccagtatgggaaagcaattgcccccacatacaacctttgacccctgcttgacactttcctgcctgaaggaccccacctcctcccagatccaagcacctcctgtgtaggcagaactgctgagctctgcatctcacacccctgcatgcttcttgcttcttctgagcagcctggacagggccctcagtcacctggccaagtcagtccctgttgagccaaattcaggtgacttttcatagtcactgttacattcaatatcctataccctggcacgttccaaaattcatgtatatttattcaggacacaaaatcttttcacccaccttctctcaattaatcctctatgggactttgtgagtttgggaatcacaaacctaatgtgggcagtttgtccccggctccttccttgtcaggagtaaattctgcaagtgaaggtggagtgtctgtattaaggatatgtgagcctacaaccgtgtcattattattatggatgtggtgttcacacttctgcgtaatatgacctgatggatctttgttttttccccaggtggttctctcttttttttaatacaccaatatttgagggggagtaatacaaaatatatatgtatacagacacacacacacacatttccatgtaagcacccaggcatgcacatatatgtgtacatgcatgttgtgtgtgtgtagcactccagggtattagaagtagtcatgatatagatacatatatacacacacataataatgaaggtacttagggaaagagttaagcaggtgcagacataagtagaaaaacagacatggatatacatgctgtagatatgtacgcgtgacacaagtcgatctgcacgtcagtagatgtgtgtcttcgttcattttgtgttgctataacagaatacttgagacagggtaattgataagaaaagcggttcatttagctcatggctctgcagactgggaagttcaaggggcgtggcaccagcatctgctttgattctggtgagagcttttgagctgggtctaaatgtgacagaaggtcaaagggtaagtggacacacgggaagggacaaaaacctgctttacatcaatccacgttctcaggacctaatccattcccatgagaactaatccactctcacaagagcaagaacacactcactcactcactcactccttcccaccagcaccaagccatttgggagggatttgcacttaggacccaaacacctcccaccaggcctcacctcccacatcacctcactgagtgatttcaatatgagttttagtggggaacaaaccatacccaagtcataacaagatgtatacacatacagaagaatgccataagtatcactatgcctacttcgaatccgtggaacgctaagagaatttatgattgaaatttggttagtggtgtttcacgattgttatcatttttctttttctgtaggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccataggtgagctaagtccctgcaggccagtgatgtcctacctgtggttggccaggaatcgcctcctccttccaggcttctgccctgctcctgccactgctgctgctggccttgcaccaggccatgagcagatcccaccgtttgtggctaacagctgagccaacttcctttctccttcctgctgggagacttccactctgagaagcttcatgaggctcaagtgttcgtggtattctgcaggctgtttttgtttcatgattgcatattcctgcctcaaaggcccactttgaacaatcctttgagaggcatttctcactttttttctacacttgagagccatggtcattgtatgttgggtgcaaaatggaatccctgcttggatagctactgcacctttacctaaagggtacagaattagtcagcagaatgagcagttcttcatcctgtaattccactaagaaacaaagaaagaggccgggtgcagtggttcacggctgtaatcctagcactgtgggaagccaaggtgggcagatgccttgagctcaggagttcaagaccagcctggcccacatggcaaaacctcatctctacaaaacatacaaaaacttagccaggtgtggtggcatgtgcctgtagtcccagctacttcaggggctgaggcaggaggattgcttgaacctgggaggctgtggctgcagtgagccaagatcgtgccactgcacttagcctgggtgacacagtgagaccctgtctcaaaaaaaaagagagagaaatgaagaaagggagcatgttgactgaatgtgttatcttaactttattcctagaggagaggataacatgaaataaacttcctttggtctttgcccacaacaagagaagcagccttccctggtgaaatgcaatactcagcagtcaattttttttctttccggaaaagcatataatacaaggagttgggcttaatgcccctctgggtactgccagttttgcctctttctttgtcctttttttcctttgttttaaacactccccgaagtgggaggctctttgtgtgacttgcaggtcatttacctctgacccatctctgtggtgttgctgcactcaggcgtctctctttggtcttgtaagcggcatcccttttgtcacaggttaaattttccctctccttgtaagtaggggctatttggagacttgagaaactgcctttagtcattctggtccactttgagcaattttccttgtggcctaggagataggcttatcctgtcgttggccatgctggggccttctagggtcacagtgcacagcaggcgtggggccttcatctctgtggcatgttgcacttgtacctggagagtcggcctgggcatgaggccaacacaccgccctcacctgggcaggagaggcagccaggtaggaggacccaccccctgaagcagttccctctctgcccccagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtgaggggcagccacttagtctccagctcacgggtagcctcctctccctgagaactgaagcagaggtgtgaaaagtacaaaggaagtctcatgaaccagagaaaggttttaaaggtctttctttcttggtcaactcttttcttgtacaggtcttgtatcccttattggaaatgatcggctttagaagtgtttctgatttcttatttgtttggattttaatatatgtacatatacatagcagttgaacatcctagttcaaaaattctaaatctgaaatgctctaataaccatttcctttgcatgtcttgtctttgcccaaaaggtttttggattttggaacatttcagatttctggattagggatgcacaacctttatttttcatttttattaaaacaatgaatccacatagtaaatcaaatacaaatgaagagcacgtgatgaaagcaacccccttctttctacctcccagcaacactgcccggaggtgacttcttttagctgtttagatttcagtactcagtattcagtgttcagaaacactaatcagtatgtcttacaatataagttgcaacctactagtgagtcttaaaattcatttaggaagtcgtggccaattctttttaaaatgggatggaatggaatgggataggataggacaggaaaggacaggacaggataggatagatcagatgtcaagtattattttgtaaaacgtttgtttcactgatgagtatgggtatgtacaggattatgatgtaaaatatatgtttttactcagagtctatcaaaacagtttgaacctgcagctttctataatatgctagtatctctgatcttgcattatcaacttgagacatttatctattgtcttgagacactatatctgttgccagatataaaaatggggcttctattaatatttttaggtcagtgatgtagcttttgcattcacacctctattcttagtccctccactttccacagtatctcttgtcctcacttgtaaggtgcgagcattaggcctcacctttcctgcctcgggagaagctgacatctttccatgctgtgctcctgctgcttcatgcaaacctgaaggtcccgctcctatgactcagactatatgccagtttccccaagtctctgcacccactgtgatgaggcagagcccaccaacagcagggatggggaggggcctttgcaaggacaccagaactttccttccctcctaccagcctcttgagccagtaggagcctggcccctccattaaaaggcctggggacattgactcactgctgaggaggctgctgctcttcccttaggtttggaaatgatcttcacatttcaaataagctgtttgttctggatgctggggcttctgggtcaaaggacatgaaggtacttcgaaatcatctgcaagaaatacgaagccagattgtttcggtaagtacaccatggaaagagcctggacccctttgtacttccttcctggtttgcctctggtttcagggaactgcttcatagtaggacccagtaagaggtgtctgcctggacatgtctttatcctagtgccctgggaaaagaaaggaagaatagagaaacaaggagatgatgggagctgaagggttattatgggcaaggtggaccacttcaattttatgaaattcttaccgatttattggtttctttaacaatattttatttatttattttattttttcagagacaggatctcacactgtcatccaggctggagtacagtggtgtgatcatagctcaccgtaaccttgaactccagggctcaagcaatctgtccatctcagcctcccaagtagctaggactataggcacgcaccaccatgtctggctaatttttttgattttttggtagagacagggtcttactatgttgcccaggctggtctcgaactcctaggctcaggtgctcctcccacctcagcctcccaaagtgctgagattacaggtgtgagccaccatgcctggccaattttgggaaaaaaccaaaaaattcaaaagtgacttattgtggaatatttagaaaattcagaaaagtagaaaaacagtcacaaacttttttgaaagacagaaaagaataaatgaacaaagggaatgagactgtattcttgggttgcaagatatgactattttatttttccctagttatataaatgtaatacaatttcagttagcatctgaatgggttgaggggattgggatttttatcttaaaatttccatggaaaaattcattaaacctattataaagcccctgataatcaatacagttaaataggaggaaaagcttagagggtatagaagtaaatcataatatctttagaaatataatggaaaataaatatgtcatttgaatttaatggggtaaagattatttaataaatgaacctggcacaactggctatttgtctggaaggaaataaagttggattcctacaccctacaaagtccaaaaataaatggattaaagcttttaagtaaaaacatgaaacaataaataccttgaatagaaattgtggagagtgtattttcaaaataactagggactgagggaacctgttaaaccaagatctaaaaccctagaaattttaaaagaaaatatacctgtttgaaaatgtaaaaatttttaaaatttttttctagcaaacaaattaagtaaacaaagttgaaaggtgaaataggctgggaaaaagcattctcaatgctttggacagataaatggtcacaccgtaatgttcaaaaagctctccggaattggtaagaaaagggcgagcgtcccagtggagaagtggtggcattcactctggagtcttcctgctgccgaggcctgaggacaaatgcgggcagatgcctgtctccctctcttacctttgaagctgcctctgggtgtattttttttttttttttttaactgctttgctaataagaaaatgctgtgcttcccgcaccagattctggttctagatgtgcttccagaattctcgggaaaccctttcctgtctccagaaaaccctgcccttcacaccagatatcctcgttggggtcccactgtggcatcatcagaagatagggggtagtccggtgaggcctgggaggaatctgtcacagaaaccaggggcggtgatctgggaactaacagtggtctctgagggcccctgtgcttccccaccaggtctggattgaggctgcattcctgaggcaggagggagtgtccctggagatttttgagctgggctctggcatgatctgctgcttctcagacaccccccgcccaacccctaaactcctgagctcaggcaggtggagcccaccacatcaactgcactcacccctgagaattttgtttttgaatgcagagtggaatttagctgacacaaaagaatttgagaggggagtgcggaattaatggcacggtgtagcctgtggcttatgtggtttctaattcagaggtatgtggattacgtgagtctgtaacatatgctgatctaattaaccaagttaaaaggttaaaaatccacttcagcctacataccaagaatgggtctaattggaaacaatatttcaacaacagtccccacgaatgcctaatttactggtaaacactcactctaatattgatgatgatactcattctcttttcctctgttcataaagtgatcattgcctgagtgaaacagtcacgagagagagagcgagggaagaaaggagggagggaggaaaaagtgagggagtgaaacattaggagttggtgaacattagttgattgagtgactgagtccacaattccaaaaacgttcctagaagactcaaaatctatttaacatgaactaaagagcctttataaaactttatatttgagcaatagatgaggcttaaaagcaagtctaaaagacaactgccccagtactcaacccaaaaaacacaaactagccagacacagtggtgtgtacttgtagtcggagctactcaggagactgagacaagaggattacttgagcccaagggtttgagaccagcctgggcaatagcgagacccagtctaaaaaaagaaaaaaaaacgtcaacaacaacaaaaaaacccactcgttcatcaaatcacctgcaaggcgcctgaatgaaaggtgtcctttccactgtggctctgctcagggcacccacagctgcaggtgagttaacctgtctggccctgccccctctaggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgaggtgagcccctgggagcccaggcagggggccgtgagaggtgccagggactcagcctgtcccaaattccagctcttggaagtggtgtgagcctggggaagcagtgtggaaatggtccagctaacctacaacatttccacacgtgtgacaaacacagcctcaagtgacgctctgaactgcagttctcggctcaccttaggagctgtcattttgtcttgtcgtgttttgcttttatttccagagtctgttagtttgggagtgcagtgcccactgccctgggtgactgggtctctcttcactccccctgggcaccaggaacttaatctgctactcctggcagccttcaggatggcttctttgtatcagcgtggagtcatcagctccacacagatctcctgggtgggaaaacagttgagaaaaggcagtgaggtgtccttgtggaggcaatgtctggagatacaaagacagagaactctggtgcacagatacacagagtaatcataattaaagatgcacattaaaaaactctagcaagcaatgcccagcagaaatgattgagaatgggaggctttgctctggttctgtgacattgagcaccagggcgcggtttggaaaccctgttctaatggcatcatatgcctgtcccaggaacgggggcagtgccttcgtgtttctccaccatgtgaaattgggagcctacatgaactagtgtgggccaagaagagcggttctgaatattgcaactaaaagcagctctgagattattaaaagccagatgcttacctccccaatctcaggtgccaggtctggccctatagccagtttgtatgagtcatacaaatttcttgaaactaaacctgaatccacaagccagtgaccttgaaaactggagtcgccgggcagtaatttcatcagcctttaaactcccagttaaatggccagagaatctgccaactcatccaggaatactttaaagtgattgaatccaaggaagaacacaggtgaaggaccacatcttagatgacaagatactgctggatgtaaaaaatgtgtcaattctaattctaaactcctttggcacaggagtcccttgctttctagtagtagaccagcaactttctagatcatatcatatagtctcctttatttgtcattacatccctgcttgcccttgagagtttagtaagtaaatgaagatgtaaagaaggagggtaattaggcagcaggaactacattgtgtggcccgactttgattggccccgggcctcctccagacctgccttccgtatctaatttgcagatcttcagaactccccagtggcccttctgactctgttttctggcccagggtcccacactacgtttagctgactgtcttagctccctgttctcctccactatgggacagtttcgtctttcctgagcctgaggcgatgagcagtgtttaggaccaaactgcaaatggtattccagcaaatgctgtatcaggaactagatcaatattggctctgccctccaggaattttcaacctaggttcaattctgaatagactcttagacagggggcatctttcaggtttaagccagactgtgggcaggaaattactgtgtggtcaccggtggggtcagagcctccaagtgagggagtccagggcgatggccactctccaagaaaggaagcagaactcttccataaagggaaagttccttctgttttttgtcacttttttttcctttctttttatttttttaagaaataaacacaaccaaaaagctaaagtccccttgggccatcatctctggtctcactcctctctccccttctcggaggccaactattatcatggcagcatatcctttcaggccttttctatgtgtgtgtgttaaacattcacataatggtataataatagaatgttctgactcttttttgaaaatgttctcaagcctttagagaagttgcaaggatagtaccatgaactctcatataggctacatttatttatttttttaattaattaattaatttttttttttttttttttgagatagagtctcactctgttgccaaggctggagtgcagtggcacaatctcggctcactgcagcctccgcctcctgggttcaagtgattctgcctcagcctacagacacaagccatcacacccaactaaattttgtatttttagaagagacagggttttaccatgttggccaggctggtctcaaactcctgacctcaagtgatccacccgcctcggcctcccaaagtgctgggattacaggcatgagtcacggtgcccagcctactacatttaagctgatcagttgttgacattttgctacatttgctcgattcctttcctttctatttatttacttatttattttgcagacatgatgacatttcttccctaaataatttagcctatatctcctaaggagaaggatattttcccacataacccaatataattgatgattccagaaacataacattaatatagtactatgattgaatatatcatcctcatacaagggtttgccactggtcccaataatttcttttaaagctatttttatttatgtacttattttgggattcagaatccagtctaaaatcactcattgcatttggttgccatctcccatttttttttcttctttcatttcgctggcctttttgaagacttcaggggagttgtttttcagaatctctattctgacattttcaagctgcttttctccactcggtgtttggtttttgagacgcatccacgtggaatggccttgggtcactccttagagcatctgctcagcctctgttgccggcatcaggccctttagtgctctaagtggctggtgcacctggccagggctctgtccctaagcgtgactttctgttgtccccccgcagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgtt

SEQ ID NO: 36346 - DNA, 24311 bp, Homo sapiens
ggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggtgattattgctgttgctgccgccgctgctgctgctactgccgccgccgccgctgttgccgctggtgccgctgccgccgccgctgctcatgatcattattttaccttttaattctttttttttccgctcttgccaaatgctttggctccaagttttctatgtgtatctattgatataaatgtatatatttatttattctagctgtcaggtgttaaaataaatgccgaagattagtcccacgtctctcccaccataggatatagattgttatgtatttattattattattgttgtctttgagtgaatcggccggtttggggaggcttttgccaccctcccttgtgttgttttggtttttggaaaggaggtggaggagaggaaggaggggaattagggggcggccggagcagagaggacgagacagtgcttggggggtgattcgggctagtctgggggctgtctggccccagaccgcggagaggacgcgcgctcgcgctctcgctctttctgctgctgcttgcgtacggcttgtgatctctctggattcgtgcggctgtgttttttccctcttttctcgcttgcaaactgctttccttgctccgtcgctcctggcctccgcttccctccctcctctttttcctcgcctcttcttccttcccttcccctgtccttctgggtaactccgggaggcaaaaagggaggctgcccgctcgctcgccccgctggctctcttccatcggcctcggtcttttagattccctgccttcgagccgaaccgagatttggaaggaaaaaatgcaagcgaactctttgggtttttgtttttgtttttttggtcataaatccagatgagatgaagtatcgtgtctactatttcctttcagagccgtgatcttcctaatgagagccgagtgttttggtgttccctgcccctgtgttttggggagcttgggggcggggatgttgaacactttgaaaattattctttcttggttgtagtcgagggagtcgggaacctccgcgcgctctccctgctcatcccgaggagagagactgatggcgggacagggcttcttggggtgggtgggaaaggggtgcgcactgcacctgcgatgcctttcagtgtgcggggggactcagggaacctcgacaggacagcctgggagaacgagaaaggtggcgggatttctggccgctgcggtgtttgtattttgggcgctgcgtgactctgtgttggctcccaatggctgttgcctccctttcctaaattttattttattttttcccatggtgcaagctctgtaaaaagggaactgcgggcctgagcgtagtggacgccaggcttcagattcccgaggtccttaccttgggcgaggagaaagacgaacagagccccagcccgcgttccttatgtgcaagactcaggaggagagaagggcactttgtggccgtggctgaggggacccggcgcgggaggagcgggcgcgggcgcgaaagggagatctttgtgagtgattttgcaaaaatagattgcgaggttggttggatttgcaacctgtggctctcctcgagggagtaagaatgggggaaggcgcggcggcggcggcccggggagggagtgggtagagttggagcctcagaaatcggctgagctccgggggcgggcggggagaaagggcgggggggcagcaggagctaggggccaccccgctgccggatgtagtgaccgtggtaaatgtcttgagaactgtgggttgcgttgcctttatgatgccgtgttattggaaccctggcgaaaaatggaactagtgttgcaataatgagttttaaagctcccccatggaaaacaaaaacacaaccaaaccgattttttaaaaaaatgaaaaaagaccctctgtgttgtgttcccttctacgatggttgtgttggtggctggggtttgggggtggggggtcctgacagttgagcagataaatgaccccaaaccaggtgctgaaagtcccaagctgtcacagggcccctgaccacctcagagagccaatctccactccgcgccccctccccgccggcccccgccaccccacaacccgccaggatttaatcttttatggatttttttttcagtttatagtttccaggaggaaagtcttgtaacgctttactttttctcttctttttttaaagtaaagtgagtgtcagtagatgtgttttttacagtctggattttaaaaaaagtggggcaggagagagggaaccagggaaagggctgtttagaaatacagtttgtggctctgagcgatgccaccggcttcctctacagagactgccagtttccctttttctttgcaaggtgtgtgtggttttaataaataacttaaaaaaaaaaagagggggcggcaagatccatcaggagacaggtatctattttgctcactatttactaccaagagcctttggcactagaacagaacctcgtaaatctgcagcccaagttgaagttcatctggccctagtccacacgctattcctggaggtagcaaacatgagctcaaagaagagagatgaaatcacattcttgctttaaaatatatacttttttaaaaaagacgaaaagatatttgtctctgggggaggaggaaatggcgaacaagtaccaggagatgggcattcccttactctaatgactgcagttgagtcttcaggccaaaatagaaacctgtagatggcaactctctctccacctccccgccccgcccgccaccccaagcttataaatagaagtttccagtatcctatttggaagactttccaatactagaggccgaagcattggctagttttaagggttgttgatagtgacagtaaggctagatgctgttcataaaaactgggcgacttgaaggagacagccagaaaaagtgggaattctccaattgcccctttcttcttttcagttttgaagggttttataccaatgctttcttgaaaagactaacttattctgggtttggtggatagggatgggactctaaatgcttaagttgtcgtttgctgagcccttgaagagttccagttattggttgagtaaatggtagccacggctagatgtcaaaacccttccttccctctatcccctacagggtaatgacactcacaacccactttgttgtgaaaaacttaagagatatagaggaggcggtgcagcagcgccacccctcggtgggtgaaactattggcaaaagtcaatttttgaaaaatattgggaagtgaacttatgaaacatttttcccccagagatttaaaaaaaataggggagataaaactaacggataaaaaggactttgaagtttatcaagtagggaagaaaaatgttgctttccaactaggatggtgttataataggcaacgtggttctaaggtttttttttttggtggggggagggtgcctggttgattttaagtagaagagttctccaggcggaggtagcccggccttccccttggattgacttctcagggcatcttaattctgctgcctgtctgataccgagatagtgagggatgttttggtgtaaaacaccatagtggctggaaatgctgtagttttgccggcggtggcaggacgtatgtgtagggggtgtgttgaggaggtttgtggatggcgtggagcaatggtaggctggtctgtagccctctgtgaatcaacatcgaatggcgcgtgccggtttccagcactgcgcaacaagtgggaccgccgctgccgccgcgagcacagcgagggtgcagcgtggtggcagaactggctggtttctctttgccccagtggaaaccaggaacggcccctcccaaccctcccgatgtccactccgagacccacaacttcaccaaaagaccatacccgactccccactcccccgctttgccaggcgcagtgagcctgagtgggatccagcactcggcccccagcgcccctttcctccgagaagatcaggagtttattcccgactttctttgctggatgaccagtgtttggcaagaatctctgccaatactgtcgagtgccattctgccttttgaagacaagtgcaccttctttcccttcccagtacataaagcttttcggaggctgggggagaaatcaacttatgatacatgaaaccagctccagataccgcgttgtggttgctagaggcgggagcatcgggaggaacggaattacatacactaaattaaatgttttctagctttgcttttagaggcaatcacacccccaaccctcgcccccaccagacagaaaataaagaggggcgggtagggatcggtgtggaagctgcggccgcgcggcgattctcggacgggctggcctgccacctagcggtgggctgagatcgagttcgcggccatgggcggtgggctcgccgttccacctcccgggcggcggtaccctgaccagatgctaggactgacagaaggagggcaccctccaatggggatggcatacaacctccaaagttttggcaagagggatgaaaatcagaaaggcctcgctgcttgcccatcactcagcgatgagcatctatttgcactaagaaaaaccacaaataacccgcttcgaacacaccatcttcctgtccctgtggcccctcttaggggaagtcggtagtggaaggatgccacctaggagctcaggggctttgggacgtacaactctgttttgcagttgaggaaacaggcccgacgaggaggcttgttagtggtgagttagtgacttaaccaggaccagattttaagcttctgaatttcatgtcagtgactgaaagccaaaggcgggtttatctcagctccttagaagtatttatgagaaaggagcggctgccagaaccatgagtttaacctcttaggtcacctttgttgccagtgttcattggaaaccgctccccagcagtcttggaggattttttttaaagaaaatatggcctaagattttcggtaatgacacgaaaagcccagatggtgctgaagggtgtgggtctcggagctcgggggtttgcgtgttaagaggggggttaaggcctggaccaaagacttgcagggcgagcctcgattctgaaatcgctctcttccccttcctaacatcctctgcatagtagcctggcgagaaaccgggtgtgtgtgtgtgagggggtgggggtcatgtggataggccagaatttgtgccacaacagttcctccgtaaagttttctttctccgagctcgtgacttaagatggcaaacgcgcgtccgcatgctggcggcccctagcggcagcaggcgcgctctgcagggggagacagcgccgtcgcccccgcccgggtcggcggggatcgagttcggcccctcccactgcgggagccgtcggaggccgcgtcggagaaacgcgcctctgttcggactggaaacgaatctgggaacgagtttgaagcgcggtcaagtttgactcatcgctttccaaggacagttagtgccttccatcttcattaacgtgaataaggaccttggctgacttctttccagatcggatttttaaaggcattgtttgcttgaggagatcatgcttctcccctcccccgccagcctttttgcaaaggctgagcccagtccagccaggacggccgagggatctctgctccgggacgcgatttgctggcattgtcttcgggcccttctggaaggctgtctcgcgctgagcgtatggggaacgtcccttctgcaactcctcttcagatcttgatgataaaacacatccctctgttttattgcatttcctagaagcttgcaggcttgcaagagcactgttggcaggaaacgtgatagaaatgaaagtcaggacacaatgtccccgaacacctcggttatccaaagcggctgtcgaggccatcgcgttatcaaattcgcttttatttactgtcgtctcctgcaccctcccgttccccagccaagagggcgaagagtgttttcccccaagaataaaaacagctccgcgatttgacctcaccccctgccgccggaccacggtggtgtctgcagccgtgcagctagttggctgaaacactgctgagaccgggagccccacggcagggcccctgatgcggggttcactacggcagttgcagccttattaaaattccttgtccttgtccctaaacagtgctttacactttcagatttccctttggatttttcagcgggttattggagttattagattaccaataatccaacagcctctgtagcctctctggctggagaggaggggggaagggcggaaggcattctccaaatcgggaggctctggccaaactaggtcaatgggaaggaggggaggggcgagaaaggggttgacggtttcaaaccttgatggagggctctctctagcgttaggcagcggtaaaaacaccattcggtttgagctcccggaaccacgggactcctaatttccaataaatgcacttacttcattttaacttcccagattctcatccctaccccttattaaatcccaaccgtctctttcacctttatcccaccgggcgaaggggtgagaaagcctcaatgtaggattttgaggccaaaggctcgttctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccgggggttataattcccgggagggccacaggaaggcgaggcaactttggagagtgccagtgcgcgcgcaggggtcggggccccggcctttgccgagtccaagctgtgtctctacggtttcggggaaatcggattcggaaatccttacggcttggcagctcctgttctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacgggggtgagggagaatggaaggcaaaaagagggaaaaaagcaaataaacttcggaatcggacaacttaaagtctcgatatgagcctcggattgtattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagcggccccgcctccctgggtgaatccccggcggccagcgcagcgcaggcagcgatcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggtacggagtggtcggggtggggtagcgaagtctgcctaggcttgccccggcgcgcagggctggtgtttgtgctcttatgtgtgagcgagaaaatggggctttctggtgccagcccaggggaggagggaggaaaaggatggggtcttttgtattggcttgctctctggctcttaacctcgcctctccctcttctctcattttctctctctctctctctctctctctctctctctctctctctctctctctgtcgtttctgctgtcttctctctctctttgcttttttttttttttggttcctgttttcttcttcaatggaaagctcttttaaaggatctgtcttctcaaggagcctagttggctatgcacaaggaaagcgccaaaagagctaaagggaggaagggaagagaaaacatttaactctcccatggtggttactgacccagcgtgggtgcggggagattgggatgggaagtccaggtctgggggcagccagcagttgtcagtttctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcttgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggtaagactcagcagcctggaatggggcaaagtgtttgtgtgggggaaggaacttaaaaatgagattcacccacatcagggtgctgtcttgcatgttctacagcacgtaggctgatttggaaaggggacaggaatttgagccagaagacctagggccgggtcaccaaccatgtacatggcccaacatgaccttgttggcctcaggcctctttacccagaaaatagctctaaaaggttctgcttttttttttttaaaggggggaagacagttcaaatattgttttattttgcagcccacatttgatcataaatgagggtcttacacctgtgcttttaatgattttgttttagagaagccggtttggaaggaggtacatatttcattaaatctcttcaaggtttagtgctccctggccagttctcagctaaatcacatagttaagtcttttaccagcagggagaagcacaaacttagaagcaatggcattctgtctggtcttagacccagtagggaagggagagaacactttgaaaaagaagacaaaggttttcaaggaatacgtagacatgacatctcaggctgtgttctgcagagtctatattcagtcttaatgtttcagatgggcaggaaatactgcctagctgtttgtcttgagcaagccacttgaacccctaagtctcagtttcatcgccagtgaaataaggataaagatattggccctatcgtccttgcggaatcattctaaggcttgaaagataatattttagcaggttttgaatgacgtccagtggttttaggccacggacgaatcgttattgttaatgttgacagaaccatttttcttattttttctttcccataaactctagtggcctttggatagtataaattttttctttgaagaaggaaatatatgtatgtatgtatgtataactaattaatgtatgcaattgtactcccagtactctggataaaaacattattatctcatagcttcgggtgcctgttgtttccgtaagagcagagctggaaaatgtttgttagcttgtggtaaaaccacaccagctggcaagctgcaactatcaaagcaaaactaaatgtgtatgtcctaaaataagactatagtggacaatcttacattcgttaaatcaatttctgtttgctttcttctcttctctgtaggttttgagcaaaattttggactgtgaagcaaggcattgggtaagtaaataaaattatatgctttaaaatgttgggacaaactgtttcttttgaatttgccaatacatgtgtctctgtgaactttgccactgttcattatatgagacaaggataaccagttccctctacatcactcctagtcctcatccttcacctctgtattagactgtcttaccacttgcatggtcaatcattgttactctttctttgtacaaactaatttagccagctaatgttcaccaacaatatgctagctcctcgaggtacaaaagtcaagcaactctaaagcctaacagtagagagagaccaatggtgactgagatgatgaaataagatacctatgagaatagctatgagttttgagagcctcctatgaacgaggaatgtatttctaacttttataaccacataggtattactacttccatttggggaaaccaaagccccaaaccagtaaacaacctgcttaaagtcccacagctagcaaaaggcaagtctagcctgataatcttaaaacacagtgtcttgactgggcgcggtggctcatgcctgtaatcccagcactttgggaggccaagttgggcagatcacgaggtcaggagtttgagacccagcctggccaacatagtgaaacactatctctactaaaaatacaaaaaaattagctgggcatggtggcaggcacctgtaatcccagctactcgggagaccgaggcaggagaatcacttgaacctgggaaggcggacttgcagtgagctgagattgcactattgcacttcagcctgggtgacagtgtgagactccatctcaaaaaacaaaaacaaaaacaaaaaacacggtgtctctccattgcaacatactcactacctgtcagtgcttggcagagtatttggtatgtgggaaaaacactcaacaaatattcattccctttgcttttcccctaaagggctttctatcccaacttgttggataaaagttattctccccattttaaaactatgaagaataatggccagagttggactatgaattgttcaaagatcaaatacaagggacctgagttgcattctgtaccttagcaggctaagccacctgctctgatacctgtggcaagcaggaaacaggttctggaggactaacaggattttggcctcttttttcaagtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcaggtgagggatctgaaaggaaagggtgggtaagtcaaagtggggtgatggtgctggcagccaagcaaggcagaacatgtgggccttttactgcatctgggatgacgtctcgctttgtctccagatctcagcaccatggcgtggcacagtaggctcccaagtgaatgaatgaatgaatggatgaatgcacttttagaaaagaaagagccacgttctgtgggcatagagggagaaaaattatatactgccccaagaaaggatgtgtttggggcagacatggagaataacttcagttaaccagtgaaaaaatgagaaaagatttcaaatgaactttctttgtctttaagtagcttaagcaagttaatttgaaatgttttgctcttttatgctataaatgtatttattttttgctacaactgaatttccatgggtgttcagagtatatgcaagagttagtgagagtgaactagctgattcttcatgtttatcaagtatttcgagttttcagagcaattttatattacatgatatcatcttcctggatctttttagtagtcttcagtgttatgcattacactattgccttcattttatagatggtaaaaggaaagcacagggaggttaaatgatacagaatcagggatctctattgctatttgaaaacttatccaacatctactctaagcacctgatttttaatagtggaaataacagaggcttatggagatataaaaataatagataatgtttagtgaatgcttactatatgccaggcatcattctatatcctttacatttttattcttgccacaacactataaggtagacatgattgttcctcctactttgaagatgagtaaagcaagatgcagagaagctaaatatcttacccaaagttgcatagctacttggtggaagtctggctcacttctggcaacccactcagaaaaagtagaatcaagaatcaagatgatagctcagaattcttctttacaattgagtactctttccaccaccagacagcatggcacctggaggcattgcttggggtttgagttgggtcttcaaggaataacagaccctctgttaatctatggactttgataaaagcagtagagtatagatgtaggcatatttttatttatttgtcattcatagccaaattctaaaaagagatagaattttaaaaataagtgtaaatgcaatggaacaagaaggaatgcttatgacaaaggtagactaagaatagttactgcaaaggggctaaatttaactctggtaatctgtacagttaagactaaaaggaaaacaggccctgtgactttaagaatattcacttaacccccctgatcttagttcccctatttgtaaaggcagagagtgatagtacctaccttgcagcgttgtaaggagcaaacgataatgtatgtaaggtgcttaatgactcctgacatttggtaagctctccataaatagcagctattattaattaccgtagaagttctggaggtaggcccaggggaaaggggctgagtatcagtgctgactgtaagggatcacagattcgatatgtctactatagtgggacatttgtttgttttacagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccaggtgagttgctacccgggtggaagcgtcggagatggaagagatagtccccgatcagaaacctttgataattcatgcatacagaaaaaatactcctctatgatatgctgcaacccacatttccactcttgttgcacacttctgctcttcttaactcttgtgccccaggcagacttaactcctgtggctatacaggtatgtcctatgcattaccgcatcttgctttcttccattcacttaatataccctctcctcccacccatcctgcaaggctaatcttggatgccagctcttccatggaagtgtttctgattaacacttttcctccctcagctcttcctctgtgttgtgaagcattttgctggtgctttaaactttccttctattttaatatttgcatatgtattttagttctcctttagacttctattataactatttacatatgtgccttagttcccgaccagactgtgagctactcaaggttataggggctatcttactcaccttttatgtcacgctgctcctactaggcaggacatttattgaattgaatggagttcactgagtttaatctcctacctgaggggtgataagacatgaccttcatttaaagatgaggaacttgagatccaaagaagtgaagagcttcactaagtgcaacagagactcagagcttaacttctttagaaccttttgatccagccatgctagggtgattgcatcctcgctcaaacagaagggttttccaggctgtgtttgaaaacctccaggagccaggaactcagtgttcccagaaccacacagcataccttggacagttagaaagcttctctttttggcttctctttaaccttcttatgggttctagctccgttaactgtgatcatggtgagcttgcctatttatttcacccacatgatgttccttcaggtatatacagctagagttctttgtctcctgtgagtgatgacggtggcaagatcatcattgctgtcatttacaagtactttcagtggctcaggccttgtgcttagaatggctgagtaactggctccatgtcaccagctgctaagtggcacagctaggtttgcaaaccaggtctggctgctctagaccagggattcatacattggcatttgctgcctgttctttatgtaaactttcatcagcatctgggacaagttctttcttcagtaggctactcgtttgtgtatgatcctccaaaagtgtcataccaacattgtataaattcttttcctgtttccctatgtgtaaaatggagataataataaccacctttccttcctttcaggattttgcatgggtgaagtgagataagggctttgaaagttttatgtgagctataaaatttcataacatcagaagagctatagattcacacacatgcatagatatgtgccttaaacatacaagattatgtctaatcaggcatagatcatgccggaaactcacttcccttctctgggactcagtcttcccaatttcaggctggatttccaggcttctagcataaatgcgttgtaattgtggttccctgctccagagccacgtcacctatgtctagctaattcaaacacagatgtggttatataagtgtcactggaaggtcatctatttaacagttctgatttggggccggtgtctttcctctttttttctttcacagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtgatttcagagactgtctgggtctgaggtcaggggttacctgggcagggttccatgtcgtttcttcttttcttgcctgaattgctgagcctattagaggtgtggaatcagtgcctatagattgagttagtctgagtaaggaagtattttacacttaagtagtgtatattttttcatagcaagagagataattcccttctggggcagaatagcattctgtaaatcccacaggcacttcctgtggtcttgatgtagcaggggaccatcctactacccttggactgagagagattgtgggctgcggggaagctctggctcagtttgaccctggtcagtgatctttctgcagatactgtttggagataaacttgaggacaactctggggtctcagagcttgagtgggcagcccagctctggcctctgggcttgcctacacacagggaggagagggtggtcttgaggccctgccccaggtgctgaggctgtttttactcctgtccataggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagtccttttccctccctcctcttgtcagggagaaggaaggcccctctgctccataggttttgtgctccattttacttatgctgttgtctctgattggagcagtcctcaattggaagtccactggcactccaagtcaccagccgttcatcccacgcttcgcttcttggggaactgggttaaccaaagcaagggatggggttttagagttgatctggggtaatcaagacttaccatacagtcattttagcttcatgccagcaaaagtagcttgtggggctggctgtaactcccagagctttctccattcctctataccaaaatgactaggactgacctgtgtgcatgttattctctgccaggctgtacattctgtaaggagaagcatctgaccttattcattctcacatcccccataggtagtagtaagtccctagcatggggtaggaactcagtaatattagtcgagttaaaagagttgaagagaattattaaattgcagtttctggatagttggtggttggcattcccagtttttaccagacaaaaaagtctaaatcttcgcccagctctggctacagtaatagagcccagtagtacctaatcagggtaaaatcaccgtgacttctcattttcaaattgttacaacaaatgaaaaaataaatcagctgcttacaccaagagatttggcacagggtcatggacccatagatgggagagcggggactgtcccctcctgcaccctggctagtttgcctttgctctgcactccagttctttttctctgggcctctgttcccacttccaccatcagcttcggtctcccagtctcacaggaggatttggagacatgaaatccaaataggtgcaagggtgaccacagagtgttcgtcattgattcctccttcagtgacctcaaagtagaattgaatttgacctatatcttacattcctggaatgctttgtgttttattttgtgtaatataatatcctcctgtgaggtaggcaggacagggatttattatctgactttgaagacagagatacagagagaggctcagaggtaaagggtcttgccctagggcttctgtgtataaatgtaaataaaactgtaaacttatttttaaaaatcaattctcagagctcttggggaaagaaaatctctgttgagctttcctcaaactggcgcaggccctctgagcacctgttggtttgagcttcccttctgtaccttaattcagtccatctcctttctcccttctctatggctaagactctgaatgataagaaaaataaagtccccacagatcctttgctccgagctcccatgaatgtcgggtgggtgagtgagggactgagagttcagtttggcacaaggggtagctacagaggagagcggccttagagccctacctcccttcctcgtgctgactttggtgtccccctaccaccctccaacagagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtatggccctgccccacacgacccgaactctccacaattattggggcaggacagggagaggatcctagagaaagctgtgtggggcctggagacctggtggggcaaggcaggaggcaggccccatcctggcctgaacgaggggtctaaccctgtcttgtctttgcttagtgactcgactcatctactccctgtatcctttgtctttcctctgagatgctctatcctgcttttctgcctttgctggggtcagaagtgttaatcccactgtacaggtgaagagactaagtctgggaaagacaaatagattcaatttttgtaaagccagaaaaaaaagcctgttgatttgtttcaatgacttgttccttatcaactcacattcctttaccaggtagcttctcatgacctgcttgttgtttaaaatctactctcttagtaccgtaaatggccctattatcccaaaaactttccatgaaggaaggttcagccattctattggtttcctctgctgagcatctactcaggcccaagccccacccctcttgcaaatggaatccagctgtagttgccacaagcggaaaaatctgtttgttctaaaagagagaaactagagcagcctgattgtgtctccctggtgaatgagttgatgagtgaatctgtcttatccaagggaaaagctagaagaaccttcccaggtaatctgaagtagcccctcaggttccagagagggaaactgaggcccagagaaggagagtgacttgtccaggttccgcaggcagataatcctaatgacaaagctggttctaaagcccaggcttcctggaatctccccctctcctatcccacacctggcattgttgctactccgtgccaccacttgtttcttggccctggtcccctgcgaggtatgcaggtgcgtgtgtgagagagggctgacagatgtgggggcaggcccctggattctctctctcacattccctaagggaaaggaaaacacaagtggcctcagggaggagcaggctgcttagaaatccaggagccacggactgcagagaccttccttattgaatatggcttttctttttccctttttcttggtaataggtgagaaaccctatcgttgcaacatctgtggggcccagttcaaccggccagccaacctgaaaacccacactcgaattcactctggagagaagccctacaaatgcgaaacctgcggagccagatttgtacaggtgagcagagtgggcaggcgagcggagcgggcaggcgagcggagcgggcaggcgagcggaggagtgggcaggcaagcggaggagtgggcaggcaagtggagcgggcaggcaagcggagcgggcaggtgagcagagcgggcaggagaaagtcccactcagtccccgtgtgcaggtgagcagagcgggcaggtgagcagagcgggcaggtgagcagagcgggtaggtgagcagagtgggcaggtgagcagaggagtgggcaggtgagcagagtgggcagcagaaaggcccactcagtccctgtgtgcaggtgagcagagtggcctggagaaaggcccactcactggctgtgtgctaatgaggggctgcccagaggcctgcagcccaccccagaagacctctcatgccttcttcttcgttcaggtggcccacctccgtgcccatgtgcttatccacactggtgagaagccctatccctgtgaaatctgtggcacccgtttccggcaccttcagactctgaagagccacctgcgaatccacacaggagagaaaccttaccatgtacgtaagcctcttgaggccgctctctgacctgcggggatgtggagggcagggaaggaggtggagcgcagggaaggaggtggagcagggaggcagtggaactgtttgctcccatctcaagcacacagtggggcaaccactacgctaatggttggaagacctagatctgggcccaatggccagacaccctgcttgaccttggcccaagcattaggggactcatctttaaaatgagggtatgggactaggtgatctgggccttaggagaggagtctagactgtggatacatagacttgattcactccacctagattcattcatttcacaaatacttattgattgcctcctggacaccccatactgggctagatgcacatttaagaggagctaaggtgtttgagaaggaacagtcttaggaggaggagaacaaaaagaatgttataagaattaatgatgttacaggaaaaaattaaaaaaaaacataaagaaggtcattttaagaaagaggaggcggccagccatgcagcacgacactgtggataggttcactgggattggaatgttctagggcggggtctcggcagctatagcctgtgtgccaatgtttgaacattccatgaactaggaatggtttttacagttaaaaagtaaaagaatattttgtgccatatgcaaattatatgaaatttaaatttcattgtccctaagtaaaaggttattggaacacagccacgctcatctgtgtacgttttgcctatggttgctttgaggagttgatgacattcttctaggtggtgatggggacaagaagtaatcaatgaatggttaacctacataccggaggttaacctgcaaaacatggttatttttgttcacttgttgatcaagctgtgagtgaatatcttcttacttgctgtttgggcaaattcgttatcctcttagtaccttaatttcctaatctgtaaagtgagtttgaaaatagtatctacttcatggagttgtagtattaactaatgattaaagtgttgaggatagcacatgcacatagtaatagtaaaataaatatctgctatcatgatttgctagaattttagatgcctaggatatcagagttgagaatgactttcagcctgtattgacccaggccattcagaagggagatccaaggcccggagagtgaaatgacatgctggggacacacagcggtgaatggcatagatacagtagattctctatgtctcccaagaccagagagtttacacatggccctgctcattttttatttgtcttcatctatttccattttcacttgaaaacatatactctatctgaacatattttattaccctttttgttttaggatagttttagatttatagaaaagttgcaaagattgtactgagggctcctacccgcacccattttatcctattgttaacatcttacgttagttccatacatttgtcacaactaatgaaccaatactgataatataattataagctaaagttcgtactttacttacattttctttgtttttatctaagaatgtcctttctcattcaagatctcatctagattaccccattacatttagtcatccattttacttttaagtaacttttatctaaactaaagcgcttattacccattcattgaattaaatcaagaaacggctccacttgctaatgtttagttagcttatctaggatatataccctaggaaagaatataactgcatttaaaaaaatttaccctagactccagaatttccgtgaattcagactgatctagtccatttgtccagatgtgttcagattaattgcataatttgaataagaggtatattctgtgaggtcctaggaagattataaagtttaggaaaaaaatagccactgccctcaaagtgttacccactgaagaaggatccatgcacacggagggctgtgtggtaaaggtagaaatcttacagaggctcaaaggaaaacaaggattattttcatccttgagagattcagaaatgccttaatcattagaagagtttgcatctaactgcacttttggataagactcaaacttgtggagttaaggcagggaaggacgtctctagcaagggagaggcagaagcaacacttgggaaagcagggaacggacatttgcacaacgctagcttatctgtcggcagaagcccggatgcatatgggttcttcacctggccttggagaggcaagagctgccccagtccctcgtagggagaatcttcctctctgggtctttgagcaatgacatctttcttgggttgatgacagctaacagtttgcctctgatatccctgcagtgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactgg

SEQ ID NO: 36347 - DNA, 35807 bp, Homo sapiens
ccggggccctacacgccagacctggctcggggtgggagtgcagaggcaaccaaaaaggaacccacacctccctccagggcccggggcgctgtcagacggggcagcaaccaggagattccctgggcctgcaggaagcccttccgcggaccgaaaggtgagtttcaggactttctgttatgttttttaaaaatacatttttaagcgccctctgtttggaagaagacgcccagtcactcctgtctttagaaggatgagacctgccccagagatacaaggaattattcctaagtagcctcttgcgccttcacaactttagttctggtgtgtttccctccttcgcgaggactctcaggagtcttcctctctgcgcctgggctgagtccacatgaactcctcggaggtcggcggtggagttaccttactccagctgccggtaggagcgctttgaaggggacacatggaaattctgttttttactgagaaagctaaggcctgagaccctccggaaagcatcgcgggcttaggtgtttctaaaccattctaggtgaagccagattttctctggagctaaggaactagccaaaacgaaaatatggcgtggagccaggggcggagaggaaacctgtttgctattctgagagtttccagggagcttgctgtgacacagattacttcctaacttctttgactctcagtggtcccacccccagaccccccatcccacccatgaaggtagagtgggggacataataggacctgtttccctaacattctgaagagctttacgggattcatcatatgataatagagttaagtaaactatagatgatagctagtgggaagaccagtcctgcctaaccgaaagggaaactgaagcacagacaagcactcaccctaatttaacagaacaccggcagccagcatgccatgctacttagcgggattgtgccaccgattgcgttatacgaggaagggaaggaaaagaccactggagcatcttggaagctcctcccttctaaagcagttgcatttcatttgctcagctacagctcataaggacctgaagctaattttaaggaaccctcattctgaagttctgttagataatgggagagccttgagttacaaagagcaggacttaaacatagcattgatgcaacctgttcctaacccttttgcaaatggtttgcaagttctatctaaagacttctgcaagcgtcttaccagcctttaaactggttcagttgcatcaaccacttagtctgatgtgcctgcccttcacccagtgctgggctggagaggcagctgtacaggaaaatctgaccaagtctttccttttgtctgaaattctgcctctctgtccccatcccagatacaattttaggaaagagatgcgttgtaaaacaaaagtttctttggcctccatgcattgtcaatatttggcctgtgaaatgagtatgacttctgtcctcttccctaaagactaaacccaagagaataataaacactcaacaaactaagttattgatttcaccaaagagggagatgcatccattccatacattcattcaacatttgccaaacctaccgtgtgcaggccagtataccagggccttggagtccaaagataatgagatggtttctgtttttgaggagcttcagtctggtaagtgagacagatacagaaataaactgcagttcaggataatatacattgtaatagcagtagctacagggcactgactaatccaggggagagggcaggagatccttccccagaattatctgtgaagtccacaccacagaagtgatggatgagcagggtcttggaaatgactaggagttcctagggaaagtgtgttttgaacaaaggaaagagggtatgcaaagtcaatggcaggtagggaatagcgtgtaataggaattacactgctagactgagaagggtgaactccctcctataggaagccatttttgagtttttaagcagaggaaggatccggtcagatttgtgtttggaaaaagaattattggccagatgggggctggcttagagagatgggaagcagagataattaagacctcagctaagacaatggcagtgggaactgaggaaaaggaatggattttaggaagtagaatcagaagtacttggtgaccaagtgaatgtggtaaaggaggaatgagtgaatagagagtgattataaggtgttgagtgggataggcaggggaaggtaccttgtagagccattaataaaaatcatgtaagctagagaaggagtgggcttgggaagcagattgtggagaaggcagtgatgaacactttaggcatattaaagttgaatatgcccaggaaatgtccagatggagataagcagttgggtatacaggtctggaacataggtggaggtggaaggcagctaaagaggcctgtggtagcaccacattggtgctgaagagtcttgtatttgtcaatagtggcctatagatattttcatatcatatgttgacttccagatgactttctccgaacgctcaaggctttctcaggataccttggaggataattcctaaaataaagaagagaattctgggttcatggcacatagatagtaaagatgcatttaattatcactcctccatgtgaaaaattaatacttagttcagttgtaagatctgtgaagacctttccagaactcacactccaagtctttagttacctacccctgtgtgggagagtcctgacttcataaaaacaagaaggatgacctactctgactaatttcagacccctacagagtagttatttaggtctggctgccagtgctcggctcaggatcttgtgtgacctgcatggaagaaaaaaccttgagcttggagctagagatacatgggttcagttcctggcttaactgcttattagctgaccttgaacaagttcttgaaagcttcatttcccttatatttaaaatggggataattattactcaccagggcaatggttagaatcagaatcaaattgaaaaggaaagtacatttaatgtgctacataaattgtaagactctataaaaatgtaaggggttttattgttatttctaatcttgcctcttgaaactaccaaaattagacggactgtgtaggtgtaagctctgggcagcatcttcagcccagacttgcagctttcctattgtatgacatattttaaggcagtaatgataagtctccttccatgatatcaatcacatgcatctactctggcctcttttgtcctccttagctaaaatggtcagagcccaaagaagtcaatgctctgctattgcttgtgcaggttgtgtactgcacaaggactcctgggagtctttggagctgaaagcaccaatattccacctgctaggccttagacccaccccacttgcagctgagtccacatggaggggatgcttttttctaattctcaccaaggtgctggtttaacccatttaatccaatggccctgaatctgagcattagtcaatgacttgggtatatttgtgatttttccctgtcccaaccagggaatcctgacttattccaaccccatgaagttggaatgttatgccaacgtcaaaaaccttcaagtaaacagagttctaatagaggctaagctgttgatgaaaaagaggaagtaaccacagattcagagacttcaaatggaaaaacacttccgagaagagccagccccaccccttcacttcacagatgagcaaactacagttcagggaggggaagtgtgggcccagtcacagagctggttaatggagggaccagaatccaagttccatctgcctctgcccaggaatacccaatactatccagggtctctatcaccttttgtatctcacacacaaggacacagctaggcattcaaatgcctgtggaaaggtgaaatgaaaattgtacctcaagttccaatcctccccaagtggcctccaggacaaactaggggcagaccctcaagggatgcaggtagttctcaacttttaaggcaacctccataccaccctcgtctcttctgtttcctcagtttcaatccttaaagttttctcaggagttcccaaagacccctcaagaagagaaacaacattgggtgccttaattaactaaaatccttttagtgtttcctcaaacttgtcaggaagagtgtttcacctcagagataagaatgagctagagaccagtggattagttgaaattacatatccaatatcgatatgtaacttaccattcagtgagaagggttccaggtgaataatgggctttcaggagactcgtcacagacacagtaagggagataaagacagtagcatgatagactttttccctccctggacagcaaaaggaaaatcgagtgcaaattctttgaaagacaatccccagggccagagcccaggccaggtttctagcttttccgccacatcagtctgagccatctgaacagagcatcatctggggacatgagtggacatttaatggagaccaggaaagggcagctaagttccaaaacgaacctcacacaaacacaaaatttctttctcagaggcaactcccaagggacatggcggcatccaaacccaatccccacccctgggaagagacttgctcccacgattgtgagcaagccgctccatggagtttgtcactaagaaataaaacaaaacctaaccattgctgtagttcttggtcaaaattgaagagatgattgtatttagaagccactgcagacatgcccttgctcttgactatagctttctcccgatgggatgtttttcagttacattttattctcctcaaatacaaccctaatttcaagctggatagtcttcagaaaagcccatcagcattttttttttagtttcccaggcaagtcataaaaagaaaattggcagaagagaggaaaataacatacaaataataacaataaggatagtcgcatgtgatagtatgtttagtcttcacattgtcctgacagggaaaagagctgtgggccacaggttcagaggtggtgtaggggcagggaaagagggtcaagggcaggggaagggaaaaaggccgtgggaacagggaagacccatgagcttagtgttatgggaacagaatagtatagtggatatgctgtgtattaacttaaatgacatgtgacagtggccaccataaataagagaaaagaatgctgcactctgagtcaagagcttcttgttcctccccaactcaagtaagatattaaatgtgcatccatctgctcatggtttctaacctgtgattcctctgcagccccatgggccaaagtgccagctttcaaaagcccctctgcatgtgattatcatgtaccaaagccctggctgtagcctgcaagttccagacagccactcatgcacactggcctgaaaccacccagaaactaatgctggggtcaaagtgaccttccgagtgatttggaacccacagtaaacaaacgtccatccaaactttcttggctcccacagattttcagtgtgcatgctaggctctcagtaaccgcttgttgaatggtggtgctaagaatttaaggcatacaatcctgcccacccctaccagaaacatatgtagtttcttcaacattatgttagggagatgtgtcaataacaaaagagaataagttactcttaaggccagtcctgcagacttagcttatctatgaaacccctttcttgtaaatgactgatggcttccaccctcctttctctctccctaccttccactcctgacctgaaacttccctcctgcccaaggcccacaatctgctgagtagcagttgccagcacagcataacagtggcctagataaaagcttcccatctcattacatgggtgacccacatcattccataatgaaactccactgggaaaggggaacacacttgcataccaccccaccagatgcagcctgctcagagctttcctagtttccaaattagaaactcagatcttgccctgcaagacacttggaccaaagccttcacaagtacaggaagaaagcagtactttactgggtgccttgccgatttccaaagactgtgcttttcttggttttgcataaggacatcattgacctctttgaggaaagagctgggttttgactattttcagtgggtggatagcacagcttcccaaagctggccatggaaagaacacctcatttccagacagaggcactgcagtcctccacactgtctggaacaagggaggagacacagtcacagagcatgtgccacagaggaagaagttcggatgctcctgactgacattttccaggaataagattttggtggtttataaaatattattccttcaaggtagggcctgagggtaaaaggggaaaagtacttaaactactgggcatgtggtcattcaacacttggcattggaattaatgaataaatacacagtaaagagatcacagacaacattttatatttctcaaacaattaataagggaaactctgccattcttttccatgtgacatctattagttttcaagaaattttgttatttcctcttgcatttttttaattgaggtgaaatttatgttacataaaattaaccattttaaagtgaatagcttagtggcatttagtacattcagaatattgtgcaatcacccctccatctagtttcaaaacattttcatcaccccaaaataaaaacccataaccattaagcaatttcttcttcttgttccctcttcccggtccccagcaaccaccaatctgcatcctacctctatggagttgcttattctagatatttcatattaatggaattatacaatatgtgaccttttgctactggccttttccacttaatgtgttttcagggttgatgtatgttgtagcatgtattggtacttcattcctttttatggctgaatcatattccattgtgtgcatataccataagagtttatctgtttattcgttgaccgacatctgtgttgtttccaccttgtggctattgtgaatagtgtgctgtgaacaaggatttgtttgaatacctgttttcagttcttttgggcataaacctaggaatggaattgctggatcatatggtaattctacctttaccttttttgaggagttgccaaactgctttcctttcccctcatttttatcaacatacttataaagtcattttcctttcttgaagataatacacatattaagtggcataccttttcctgtctggtctcttatttgatgcatttgatcttatgcttttataaaagatattaaatactacctctcgttgccctagagattcgggattatttggatgcttgagatagaaaatatttgggggtaaactaaagccccttcttggtataactgagtaggaagcaacagctaacaacagcaacatttatggtgctctatctgtgctggggataacattaagcactttacctattttcccttacctaaccctcatgtcaactgaacaaaataggtactactacaggttgagtatttcttatccaaaatacttgggattagacatgttttggatttcagattttttttttcagattttagaatatttttattatactggaattaccagttcagcatccctaatttaaaatccaatgtgcatttcagtgtcctatcagcactcaaaaacttttagattttggagcatttgggttttggattttcagattagggatattcaacctgtaacatccctattttatagaagaagaaattgaggtctccacgaagagctaagtgctcttcaccagctcctgcaaaggaaatctgcagctgccaccactgatgaataagaagccattctgtttctcaggggattgcagtcattttggcagacagataggtcaagaggcagttataacacagtgttataaaagctatgataggtgtcatgacagggacacagagatagagcacttatcctggccctaggctgtagacttttcaaaggagatgaaatctaagtctcttattttcttgataaccctgtggggcccttggtaatgtttgaccctccccaggcactctttgacttcactattccatcattgcatttccagtgcacagtgtctggcacacagttgccacttattaaacataggttcataaacatgtgtgcttctgtagaaggaatgcccagccctgtcacactgacatggaactcctatgcctgggtcctatgtttcaactcatagactttctcaaaacagttgtgccctgggatggggaaaggagatgagaaaaggcctccaatggctttggctgtcctctgtctctgaacagacactgtgtatgtgagaagaagacaagggaagagggagaagaagggtagggagtggggcaggaggccttccagtggcaccgtgtgaggtcggccaatgcccagggaggagaccctgtaatgtgacgtgagaccccagagaagaaatgaactgggaaatctctttcctaaactctgatttctcatttcagttaaggtttgttattgcttcaaagactcctagcgtatggctatacagtatctttgccaattcatctcagttggcaggtacaagaagcagtagcttcatggaaggtctagactctctccagttggtaattctcactcctgtctcccaggcactgtcagggtgtatcacttactttcggtcagtcatctgcaactcctctttgcataaagagaattttgaggactcctaggaggcctggcggctttgctttacatggcagaagctgcccggacatgactctggctgcttccatttttttccatacacagttctcaagctcttctatgtgtacctgacactacactagaggctttggggaattttccaaaaacaaaacaatatgcaggcacagattccaccctcaaggacctaccacctaccacccaggagcctgcaagcacctagctgcaagccccgcccctctcattgagagctgtgagaaaagcccattcctgggattagtctgtgctgggatctctgctcgctagtgcggccatctcttcacccactgctcaggctgtggctgtgccattctggaatccctgagtcctgcttcacccttgttcggctggctccccagatgtccgaccaacttacctgagccataagctgctgctttgagctgcaaccccaattgtgaaagctcagcccattgcaaggccttcctgctctgcccaggcccgggtcctggtcccctcaccctgctggagacctaccctgctatcccaacccatcacctggctctgcaggggcctacaagaagcttgcataagtatgagagcttggggtgccagaagtgaatgtgggcttcctggcccatggacatagcatagccctcacagagatactcttcactctggttctttctcatctccccagatcataaccagtcaattacttaatcaaaaagcatttattgtacatctaatatgtgccagcactgaaccagaccctggggatacccagaggagaaagctctgtaatagcttaatgtcaagtgggaaagcagacaggagcagcctctgtactatcagtgagcaagcattgtcagggaggtgaggtggtagagaaggaaagaaattttcaactatgatatctccgcgctacagatgattccagaaaatggcccctgggctaacaaatcctccttttcccacctatttagagggcgctttgcgtcagttttacaggcctgagcattcctcacttgctctgaaataatggaacagtggcgtctttccatcatgcacacaggattcatcactgtcttcccttttgcatactcgagctcctcagcattgggccccagcagaggtcacaagctcagatgcctacagggtgcctgacaggtgaagccaacatgcactgaagatgtgctctgtgccaggcactgtttcacccacatcacacagagtatttaactcatctggttcccacaataatcctacgacagaggttctattcttatcccccttttatagttgaggaaactaaggcacagagagggaaggggactttccatattcagaagccagtgtgtggtgggaccaggctttgacccaggctggtccatctgagagggtcacacaagctgggtgagagcgtagactgaaagctgcagatcaaacacaatccactctctggtggcagctgcctcctgggcttccactgtgcagcctctgaccacggaccgatctaggcttgactcttaggatagaatgtcatttggtttccacaaactttgtgctaaatgttggcaggctgattgtgggtgagggggcagggaaagagggatccctttgaacgtgagccaggtggaactggctttggttacccagggccttgtgacacccagtttgaagtcagaattatcatcaaatgtaaggatatgctgcacaaagagataaaatgtagttggggtgagggtgagggacagggaggaggcagaaaattcactatacactcaagttcccttaacacagtaatctgccttcatagtcaaatgtgaaaacaatttgaaattgtagcccccaatgtccttaagcccaatatgtcatcagtcactcctgcctatggccctatccccggacactcaagtcataacatgttatgatgtatggagggagagaacatcaggagcagcctcctcctacggccagaaccttgaaaaatccccatcaggggctggagtggtccctggaatgccatggcaattaaagcagtggctgcaagaaggccctgggagagggggtcgggtggagcaagctgttttagtgttgaagccttaacatcgggaggttggaggcctctagagctgagttggagcacgggccactttgactggattctttctctgagccagctgggtttcttgagcagcctggaatcacctttctttcccgtccctgctgcctttaaacattctatgcaccttgcaggtgccaactcaaatcacaccctcatcgaagtctgccctggattcctcactggaattaacgtctccctccttgctacttccataagcatttgtttgaatttcccttgggacactgaactaatcatgccttatggtacttcgcctgtgcttgtccagttccccaacaacaaaaaagtaaattccttgactttattcctaaagtgtctatcaaaagaagaaaagttcaattttgatttccttacccagatagctggcaagttttctacttctcactaggcagcattatctgggaaagcgttagaagagagagaagttcttcatgcacatagtaggtactcaacaaatgtgagttgaattgaataatttgctgctgtacagcagagaatggaaatggaagttcctggcttccttggccacaatggtgtcaacaacccagaatcagtgaaggaagaaaaagccagcaaaggaagttcctccctccagaaaaaagcagggaggtctttttacagtaatagcagtgaggtagtgagccagccccccgccccccacaaatacacacatactctactcagttgactttgcaggcagaagttaccaaataaaatcatatcaattgaagagcacaaagaggccaagcacagtgtctcatgcctgtactctcagcactttgggaagctgaggcaggaggataacttcaggccaggagttcaagaccagcctgggcaacataggaagaccctgtctctactaaagtaataataataataaattaggcagatgtggtggtgcatgcctgtagtcccagctatttgggaagctgaggcaggaggattgcctgcgcccaagaaatcaaggttacagtgattgtgccactgcacactagcctgggtgacagagtgagaccctgtatattttttaaaaattaaaaatcaagaacaccaagaagtcagaaacacagccaatcagggctttccaacaagggtagtctcacttccaagtgatgtaatcttgatattcaacatggcaccccatgaaaacaaagcttgatgtccatttgagactggtgttccttggaagtcgagcctcagctgctctcatctctgtttcttagtcctgacagcctcactggagattaaaaagtagccagtctccaaaagagatctactcaggagcacccaagaatacctggtatttgagcatactgcccaagctgaaagagctctccaaacccaaaatattgacatttcaactggcagactttattttcctggatatctctttccagctgaccaacatgatctgtgtgaacctaaagtagtgtggcagagcagaaggaaaactggctatttagagatagaggaattggcacatgatcttttattaggtatgagaccttagatgagtcatttaatttcagtgagcctcagagcttcttcatctataaacatgttcatttgttaattcagcacatatttcccaagggcaaaatatgtcccagatgcagaggatgccatgatgggaatagattccatctagaaaggaagaacaatgattaaacaattaccctactgcagattatgggttgtggtgacaatgtaggtatggtgaagggcacagagcaggggctctgacctgtaatgaggtcaaggaaggtttccccagggcaacaatgttgaatagaggccaggagatggggtagggagcagtggatgggggtggggtgagagagagctacagttgtataaggatccaaagctggaggggaaccccatacctcacagagtttgagaaatgggaggctttgtaaactgcgaaggggattggttgccactgcttgctgccctcattgttgcattttaggagtaactttagcgcagaaagcatctcactggggaagtggaaaactagagccctgtgtgccattggccactaaccagctttacaattttgaacaaatttggaacaaacttttactatgaaaagattattcatctgtgaaatagggcaagaaatccctcccctctacaaattacagtagattgaaggaagaaatgttttcagaagcctttaaaaaactaaactgagttgtaagtgtaggatattcattggactttcaccaatcataaataaacccaagcccatctgggtgccagttcgaaggagggagaactgattgcatcctgtttttatccctcaccccctattcccaagggatcaagagataaatagccatttctttctgattggtttggtgatatttcatttcagtttataattagatttttgtctaagggagaacggatgctattaataaaagtttttttaattgtggtatctgtgattgctctgcctgaccggttggggcagattaccagtgagcccatgggtgggagcttaatcctgcgtaatcccgagctctggtagggtgtactttccatcacaagcaagatcaggtaaaagaatgtggccactgaaagagtgaggctgtcaggtctcctctgctcacaactttcagggcctccttgaggctgttacaccaaccccatgttaggctttcaaagccccctgtgatctcactaatctttcctgtgccacctcagttcccactcttccttagaagccttcttcgctgccatacccatctcgaactctgtacctgttggcctctgtacctctgctctggcttttccaacctatgtagctcaccccaacttgcccttttccccaccagaatgtccagccctccatgtaatcacacacagcccaggagctggcacagcctctatctcctccatgatatccccccccccgccccgtcccccactctgataaaacataaccagcattgatctctctcctttctaatagtacctgcattttgtcactttctggttttcagtttagcatttaattactattatttttgaaaattcaactttgcaggacattttcagtttacaaagaactctcatatatattagtatttgactttcacaaccacactgaatggtgagggcagttgatgttatcatcattgtcttcccgtcttagagaccaggatcctgaggctcatgaagctctgtgacttgccctgccacttggctaagcagagcaggacttcagtgctctaaggttcgtgaagaaactcttttaggataagaaccagttggtacacttctttttcccctccagcactatgtcggttacatagtaaatacttaactaatgcttcttgacatgaaatccacatgcaactacaggaaaaatccttcaaatggcatattttattgatgcaaacaattgttattagtgctattggcctcttcatgtataaagaacaatatgtttgcagcattatttttattatagggactcagtaaacaactaagggagactcacacacattttatacaaagctcttcccagccccagaggccaagaaaaggcagccacaaatgtaggtaccattccttctgctcacactgaaggtgctgcccccctgcctcctggcagtggatggaatgtgcttgtcagaacttgctcagcagagtggacatggcccgctagcccttggaaacctggggtcatttgtacacatggaggattcaagttacccagcagcagcctcagctccactacacaagtaggtgaaggggctggcctggttgtagaggggatttaggagtggtctccatccagccattctgggttggaggcaggaagacctcccaacattggagcaaatttcccaagaatttcaggccactttgactaccaggcagaattgaggagtgacttttgttttttgccacatccctgcaactgctgggaataataccaattatgactctaaatatttgtacagttcctaacagcccagacacacattacattcactatgtgcttttacctaaggaccctgtgagcaggtactcacttccagttgttggtttaatttagaaagtgtatgcatgtgatcagtcattcagaatggtaccaaaggaatgagagaaaagccagtctcccttcctgcactgcccccaatttccctccaaaggggcagtacatgctatcattttcttgtgtattcttctagattgttccccattttggagatgaagaaactgagactcaaagcagctgagtgaccttcccaaggacacacactgagtgagttgtaacttcttctcattcctcaatctattagcttcctctgcactcaaactaccctttagccaagaatttggctcctagggcaagttatgagaatgtaaataagtaaaatcaggtaaaagtcaaagccagaacagggggcctaggccccacagattcttgagaagaatctgcctacccctattaggcacttcaaggacatctactttcttctctggctgctctaggccaactgccatccctatggcatcttctgccttctaactgtcatgggcagggtctaacattcagaatgtcttgctctatcaaagcattcccacctaatgtgttatttcttcaagaccctgatactttgagggttggtctgataaaaaatgtatctgggctgctaatgggagataaagcctaaagtctggtggtcggcctgcagacagctcagccctgaggccacatcatggagagcccagagacaagggctgagttccctggcctctcccaccatcccccctacctcccagtggccttaagtgctttccagagggtctcccacaaagccttgaggtctccaggcatggatggagcagaggtggtggatgggaaagaatgaggggatgaggctaagggaaccctgtgtcgaggggggtgaatatgggatacccccctgcaatccccagcttaagcagtttcttccatacatactcccgattcaggaatttgcaatacttgccatctcttttgggaagggcatttcaaggatggggaggaaaatgtttgggcatgctgagggcatcagggaagagatgacggctattcctagggacaagaatatctgcatggaggcaactaaaactgcacatgatgaggctaagcatatgtcatctatatcaaagaaagaaggtgctgaagcaaaaaaaaaaaaaaaaaaaaaaaaaaaaaaagcatgctacttaacctgacactggatgtgtactcaataagtattttagctcactcatatatgttctctgcattcatcaaccattatttatcaaaaccataaaaaaacactccctgcaacattaggaatgcagatttaagcccatgcagaaaggaagtaaaggtttatcctcagacatatgaactcctctgcacagactgccctctggggtggaagctgccatccaaagcctggcaaatctgaagtccaccacactgaacattccacagaggtgagttattattggaatgagaatatttatgctcactccctctatgatttgatctttgcattttaagacttaatattgcagtaaggtagcttttggcttttaattgccccgaaattttgttaacattaaatgaaaggacaaaatggaaaggaaaatagaaccatatctgtatcacttttgagttgcataatttacatttttgccacttcattagttttcagctattccagcctgtaaatgtctcccccaccaccactaacaaaaagaaatatgtcagtcattctgttattgccccaaagtttgcagaactcttaagttcctgtctctagtattaaagagaattatgcaagttttatttttttatttttattttttattatactttaagttctagggtacatgtgcacaacgtgcaggtttgttacatatgtatacatgtgccatgttgatgtgctgcacccattaactcgtcattacattaagtatatctcctaatgctatcccttccccctcccctgaccccacgatgggccccagtgtgtgatgttccccttcctgtgtccaagtgttctcattgttcaattcccacctatgagtgagaacatgaggtgtttggttttttgtccttgcaatagtctgctgagaatgatggtttccagcttcatccatgtccctgtaaaggacatgaactcatccttttttatggctgcatagtattccatggtatatatgtgccacattttcttaatctagtctatcattgatggacatttgggttagttccaagtctttgctattgtgaatagtgccacaatgaacatacatgtgcatgtgtctttatagcagcatgatttataatcctttcggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcatagaattatgcaacttttaattactacctgtgtgggagaccctgaatgacacaagtgtttggtcgttctcatgctttttcaaaaaacattttttccctccaagaggatatgacatttgaacacttaagcatcagttattggagtcggccagaagcagaggtttccctttatttgtggaacagaaaaggcaacgccccactcaaccgctcctaactcacagatgacctcagagcctcggcttctggctctccaaaaacaaaacttcacctaaacactttaccacacccacaaacattggctccaaaatcctttaccaaactattttgaaaagtgaaaatgagaactatataaccaagatagttcactgtaaccatggctacaggttttattagcactaataccaggatgtggtcagatcatgtatgtatgtgtatatatatatatatatgtatatacagatgacgaatagaagtgtaagtggtattagagttcccctatgaattctccactttggaaatgtagctcctaataaccacagactaggggaaaggcgggggataggagggtggaggactgcatcagtaagagaagctcagtgttctactttgagctttaattcagccttttaatataatcccctaaaataccactactttgcattgagattgcaattttccctgctcagtgttcttccacatgtcttgtctgttcttcacagtaatcttgagagatatccaggatgagtaataacctcatttctcagatgaggaaagggctcagaaagcttaactgattttgcccaaggtcaaaggcctggaggacaactgaactgggactaggagagggtcctctgactccttgcttaattgcacccttgggccagctgtttgtattgtgcccaggggcattttgatatgcattaattcctcttgcaaacatccctcatccttatcatttgtctgattaaccacagatcaggatcagtccatcaaactggaggttaaagctgctatgtgaggcttgccttttgtcctcatttatattttttaagccccctgcatggctcttctctacatagatgacagcacagagaacatgtaccatagttcctactcctgagtgagtttataatccaggggaggtgagcttaaaatgcttccagggaccaggtgggtgaacaggactgggtgaagcaggcaggatggggactggggtgtggggtcggggaatggggagaacacaggcccttttaaagctccagcagattgtggccatgtgggaggttagtgtggccaaatcttaggactagctgaagattgagaatttgatacgaaaccaaaggaagcagaaaaataatacaaagtaaaagtgcctgtgggttggacatagctcccagactgccagtgagtttcatgccttggggccccagcatatatggagttatacatgttatcagtgatgctgtattgcacttctcttcaacgtgtttggtcctattaaaacatgagctccttgaggtcacagaaggcatcgtaatcaagagtgcacccacagggtgtgacgcacgtggcaggcttttacatgttgatagatgaatagttggatgaacaccccatcatcttagaagatccagaaattaaagtcctcagcattctgagaatggtggttacagtaggatctctggactcagagaggactagagtcaaacgtctttctgcgcttgagtagctccatgtctttgggcgaatcacttaaatctctcatagcctcagtttcctcatctgtaggatgggcatagaaaaaaagcctatctcttgagttgttgaatgagaccatgtctgtaaacccttgattccacacacagagttgcacacttagtaagaactcagcaaatgatggctttttgattcaacagatcattccttgttcctgtgaaaggtgataagacttttgccaaccctctgttttgagattttggcctcctgaagtatctaaatcaaaagaggactgtcaaaagaaaacaaatgagcattctagctgaagtgaagaggagaaaattgatagtgatggacaacacaaggctcccctaagaaatgcgatcctggaggtcaggagggccgagagagggagaagcacctgggagtgaatggaaataaagttagcaggaaggcaggggagaggctaaggtggctgccctgattcactaggggctggttaactcactttctacaccaattcagtgaaaagctgatcaaactctaattagagcaaaataattatttcacaaatggatgttttcacctttcacacaatgtgaatagtataataataaatatagtgctttacagttggcaaggcaattttaaggcacccactgtgtgaaatatacttacacaacatgcttcacacacattatctcatttactctgcccagcgatgcattaattcattcatccattcagcaagtacttactgccagtccactttctaccaggccctgtgccagatactgagagtaaaatgatgtaacgcagtgaataaaacacctagccctctgagaaagatggcaatatctttgtttacagaagaataaatggaaaaagcacttaagtgaatgttccccaaaccccacaccatgttagtggtggagacaggtttttttgtttgttttttattttagagacaaagtctcaccctgtcacctggactggagtgcagtggtgcagtcactgtaacctcaaactcccgggctcaagcaatcctcctgcctcagcctcctgagtagctggaactacaggcatgtgctaccacacttggctaatttttttaatttttatttttgtagagataggatcttgctatgttgcccaggctggcaaaattcttggctacaagttttctggcatataagaagaaaaattaggaaatttccttgaccttgaggaggtaaatatgaggaagttgacttgctaacagactggagaaattgtattcactcacatttagtacagctggaattttcagggaatcagacataatttctcatgattaatcctgagggtaacatgaggagaactaactattcttagagtgtatagtctggaccctctggagaaaagataattagggatgaaaagagagaaaaggaaggaaagaagaaagggaaaagagtaaagaagaataaaggaactggagattccagaccttccataatagaaaatcaaagaaagtccacatgaaggctttttaaaattcttttcattgttcttaaatcattctctaattatttccctggtatcatccttgagacaagagaggatgtcttttacctcccccatatttcctagcacgtcttaattaatacttgattgactgaaagattgactcatttgaacccacagtgaaatggagctttttaattttcttttctgctgaacctgaaatagagcatatagtaattaggaaagaatcccttgttatcagaaagtcccagctacaatgggctctttgtaactgagcaaaaggaaggtaggtgattatttaggagctgataaaacactcacccctgcccccactttctattgctctcagtgataggcggttttcttgatcattatttctccctccagtgagttttcgtggctggaagatctggctggagagtgcagtctgcgggtggataattatcattaaagtccagccacagtgtgactgatggtcacttttctatgccctttggttcttctactctttctccccagtgacctggtttgcctgacagatgattattcaagatctcatttttttagaacccttgaattaacttcactcattcattcattcattcagctacatgccagactctgggcatccaaacagaataggacaggcagggccctgctctcatggagcttatgttctaatggaggaagacaggcagtaaaggtggaaaccagcgtgacagcagcattgtaagtgactgagaaatttcaaagtgaggagtatcaccaagccagtagggcaggatggtgagataggggttggctgggggttgggcgacattagataaccatactccattagaaaaaggcctcctgataaggtaacacgggaggaaatttgtatgaaaatgtatttgagctgacgcaaatgttgtgaagcaatcacgccaagatctgaggaaaaccataccaggcaaagggacaaatagggtcctgagcgagtggacggtccagtagtaggcgcggctaggccacagtgaatgggagagaagagagtaccagacaaggtccagaaggaggcaggggccagacgatggcagggcctggggatgtaagaaagagtttagatgtcatacttctagtttagatgtcatacttctagtgacgggaagccatgaggcgtgagcagggcctgggggtgatatgatctggctctggtggggagaacaggccggagggagggaggagcagaaccagagagattggttaggaagctgctgcagtaacccaggtgagagacagcaaaggcctggccatggaaatggtgggaagtggatggagtcaggacatagtcagagagagagcaggtaggaccagctgatgaggtaggggtggggaggtaaagcccaggagagaagcttagtccgagtgttgaaggaattcatttatttgtcccatatttattagcacctattatgtgataaacagctagggcggtgggggtggtggaggaaggtgaggctggggtaataggagagttggattaccagccagtcctccttgctaaggaggtgtgatcatacaggtggtgagcagccaagcgagggttgcgcagggagtgcgcgttacattcagattttagaaagacgaattgaaagaaggaaaaactagaggccatttgaaggcctggacaaatgaggtaacaatggggataaaggggaaggcacctttctgtgcctttccatacccacagggcccaagtgcccctagctcaagccctgctttacttacgatgctcaccacggtccagccacacttggctgccctctctcatggatgtgccatgcgctttcccacttcagagccctcacccttaatgttgctgctaccggaggtcctgcccttagcgctgtgcacgcttggtccttagcaccccgagatctcagttcagagtcaccttttcagaggccactccaattatttcctttattgcactaacatgtatactttctacctggagaagagagataataagtgcacaaacaaaatgtctgtcttatgcatgactatacccatggtgccaggaccggaactgacacatcctaggagctcattaaatacattgagggagggaaaaaagggaaagtaggaaaagacaaaagggcagtttgtcgtcggggtgaggaaggaaggaggcttctatgtcctactccacacaatcttgggagagccctgcagagaggggaaggaagtgtatctaaacccttatgattcagctcctgagtggtgcttatccatattttcattctgaaatggtcgctttgaaagagaatgatgaatgaactaatttagtctaccacaggaaaactagagaaaagagaaaatgccttgtaaaggagacctacataatcaaagtcatgactccagaaccatctcacatttgaaaaagacaaacaaaaccatcattagctaaggagtcaagggctgtttactttggccagcctatttgtttgggatcaaacaatcaggactaacttttattgctaggcaaggctctgaggcactctacttctactgactcatttcattctcacatcctgttattatccatgccattctacaaatgagaaaacagagcgccagagagagaggttaacctgcccaatgtgatacagctagtgagtgggagagccagaattcagacccaggatatctggttcccgaaccactgctcaaaagcactaaggtaaacccctctttggccaaagctgccctataggagagttgttgaacacattgcacatttgttataagcaaatcattctagggattatatatgcaatggtaattaataatcattaccaacattagcttttttgtcacttgtattaggcaggataggctaactgctgtagcagaaaatccccaaatctcagtggcttcacccaacaaaagtttattctaactcatttcatttttcactgtggtcagcaggggtgctctgctccacacagtcattcaggaacacctcccatctctgccatccccagggctcttggagtcctcccctggatgctctgcatctggccagccaatgagcaagcagagagagaacagggagggcccgggagaagatttcaggagccacgtttccttggctggaactcagtcacatagccccacagagacgtaaggggctgagaagtatggtctcactcgtgctcagaaagagaatatggtgggcatcttgcaaagcactgtggaagagtttgtggaagagacctggcaggagggtaacctgggcctcagaagacattggttctggccctggctctattagtcaccagctgggtgatctcccgcaagatgcagtctctttggtcccagatttcccatcaataaagtaaggtaatcaaccagatggcccatttcaggagtcttctaatccagaatgtttacatgataaagcatcattttattaaataaccatggtgccttaatcatttttctattgatgctctatttgtgcttttgttcaaaattgcaaccataattataacatcaattctgggggaaaatactatctattttcctttaatactgaatatctagttatgcatcatatatactctggggggaaaagagagcttccgactttgtattaggactagttatttgaagcaattcattaaattggggaaaatgtagatacctatttcagaatgcctagagctgggtctaagtaataaatgtaatgttctacaagcagatcatttactgtgatcagaccatttttgtacaaaacagtacttacctctattagagggcacctgagcatgccaggttagcaaggtgagaaccatcaagaaaatatatatccagaatagccaagttaataactactgactgaggttccactctgtgccctcgctgccagagagccttggtttctgaagtgtgtgatattatcgtaaccacagggattttgtaaggcagtgtggtttgagagctggggcaaggtttggacaggcagggtggagaggcctggggttgaataaggtgttttaaccccccaagagagatggtgaggagtcaggtagagactgatgattttcctgttttggaaaggaaaaaaaaaaagaatatacatatacattccagactgagagccctcataggagactagggttagaagaaggaaagttgggcacacccagggacacctcctctcatgtccctctgcctgagagttctcccacccatatctgctggaaaacacctgagccacgccatcatcccgccctttccgaccaccatcacccttggcccagctgccactttctggacaactgtgatcatttcctccccctacaccctctcccatctgtcctctcacacgtcagagagagtgttctttatgaaatccacatcaattatgtcccctccttgcttaaaaccccgtggctctcacagcaaactctagccctccacgtggcttacaaggtcctgtggtgtggggctgccattcatgggccctgccatccaccctcaccccaccactgctgctgtcagctaccctgtcccttcaggtccttttcagggacagcaatgggtctaatttgttcatctaataaaaagcacaatacaggtattgtttgcctatgtttccagactttggggggacactttacagtgtattaacaattgaactcattctttaaatgtagagaacttcacctgaaaaggtcttggagggttgaagaaaagcctatcaagcatattacttggaaatgctttaaaataagtttattttgtgtttcaaaacttttcagacaccctagccatgtgtttgctgtttttgtcattcagatcttctctcagtcatccctcatcagagccttcctaacctccctgtttcccctttcatagcatcgtggggtcttgttcgtggcactcaccataattacactttcacacctgcctatatggttctttgatgaatgtttggtttggttcccacactagacttggagcacagaaaggacagggatctggtttgcttgtcctgggtacaaagttcccagcaggagtaggttctctgtaattagtcactgcacgatgcctgctcagacaccagtcatgatggtcgtttcttttcattgccttccctcaaccttctccaggcaggaccgctggctgcttctgccatgctgctcccatgtcccccaacacagaacttgaccacagaactcatcacactatacttctatttttatttctcccccttgctagactgggcggtgatcaggatctgaatgcacagggcgggtgttcagcgattgtttactacgttgaacgtgacctccaggaaagcagttctggccgagatcccctgacaacgcaaagcaagaagtaacgtggaaggaggctccccaagctggctggccattttgctgctgtgtgtggaggtaaacttcatcccccgtctcctcacccatgattcttcccctcatttagcacatggctcctgtgctcataaatgaaggtcggctgctcagcttgcttattcaattattcccaaacctgacaattgtccagaaacactctggctgcttgctacaaacataaattcctgggcccatcctagacccgactgaatcagagtctccaggagcaggctgcaggaatctgtatttttaactccttaaatgactcttcgtagccaacagtccatcctgctgtcacctgggatcctgggcagaggagctaaagcaagcacagtgatcagcgcacccaaggtagaaagctcaatggagctgtttgagcaaaggcccaaggggaggtctttgctcccaactgtcagttataaaatggccccccacacaaatccaggagtcagcagtcgcagaagaggggtctcttaaggttctcatagagaactgaacctcccacctccccctacaagaagggtggtgatttgtaccatttggaggtcactctggagttggtctcagggattctaattgggtgccattgtgatccttattattaacctttccagaaagtatttactgtctcacagacactgttctagagctttacatttattattttgtctaaaaaacaagaacaatgagaggctgatgcagaatagaacgccctgctcccttcttggagagcaccggaaggaacagcagtgtcagggccagccctggacacagcctgcagtagcttttggctctcagagattgaagcagacctccctgtggaatgacccacccctgtaacacttccaagggtcccaaagcctgggagggaggctggggcctgtagatggctagctgctctcctccacctcacctatgaactcagcaatcctccaggcaccttcagatgttccccaagcgaccgctctccatctgatttctggatgccagagtctagagcaacagccacagacctacagaccaaccatattagggagattatttctgaagaccttttcatttcaatgcggtggggacccatggttctttggcaatagggattggcttggaggtgaggaaggaggaagaaaagcccagcactggaattagtccattgttatttcaagataactcactattttatggattatatttgtgtaagtattttacagttacagaatgcattaaatatattgaatcattttgatccccacaatgtcattatgagggaagatcattagcttcattttgtagctgaggtctggttaacttgccaaggtcatgcaggttgacccaaggctcaaaaccaggccttctggctctgggatcactgtttcccatcgtcacctcatacatgggtggatagaagtttgcgacagaaagagtgaatgaatgattctgtctccctagctagatactacagaggatatggaggtaaataatatttggtttcaaaaaaattgaaagaaagttttcccctcttctctgtcctctcgtccacccccacagccacaatcagacagatgaggttggttggcacctattgttggtcttacaaaaatagatgaattacttttcaagcattgtcagtgctattcaaaagctaacaaaaggctagagtgtacttccaggggccgaagtgtgtcttcttttgcattccatggaagttctcacttttaattcatgccactaaggagatatttgattgttttctggaaatgctaataatgcaagactcataaatactaatgaaacactatagattagcagagctcagcaagtaacctggggggtgcctagaaaagaattcttagattaaaaaatataaagaataccttttaatcgaattttccccagactggcttcccaaatgttaatgaatactctttggctgtatggggagcagcctcaaataagtccctttaggaatccagaagagaattattgacttagctttagcttgaaaagaaatctatttattcaaaggccattttaggtgccaagggatggatgagtttaagacaaaggttgggaggggtgggagggccctagatgttgagataaacatataattcaaatgcatgcttctacttcagccaactaagcaatctagtttggaatttgcttattgtacttggcttttatgacttgatctatcaatagtaataactcccctggaatggacgaggcttcccgatgtcagaaaccatatctttgtcattcactattgaattctcaacacccaacagtgcatgaaacatattaggtgctcagtgaatgtttgataaacggataaggagatttaaagaactttcttaacacattttccagagttcttcagatcttgttatcttttcctgaaaggcagctctgatcacaacattctcctgttgtaaagcctccaaataaacgcaaaccctatgacggcccctctaccatggccatgcctacctcctagtgtcccttctcatcctctcttctcccaccctgagctccaggctcaccagaagaccccctgttctcctgctcatgttctagaagtttctctgcctggaatgtttgaacatccttttcacctatatttctctgtcaaaatactacgcatcttcaaggtcgtcccccaggtggctccaccttcatgaaaactgacctgatctccatgagctcgccctccttccttgctggctgaacccagaggggcccctgttacccatctgctccctgtaggaacagcataacccctggcacaaaatagttggtgaacatttgtggtggtggtgttatctaacgtgaatcaggaaagctgtgagtagaatcaaattaaagaaaagcacccaaagcctttccacaacagagcagaaagatcccaacagacaggggcacagacccactcaagactgaggtaaaagcaaaggtcattgcagagggagaaggaaaatccagaagagagatgagtggcctgagatacagcatcaccggggcttagaagcatgccaaaggctgcttttctctacagagagcctggcagcttgatggtgtgtgggcagatccatggcatgggctgttcccaggcctcagaggggcttgagcagagccttggatgagaggacatgactcctcaggatacttttctttgttgcatgttgagtttaagttcaggcagccatatgctttctataaacctgcacttgggcagaactttgtttttattttatgtatcttcatgcatttgggaaggatctaacaatgagaaataaatctctttgcagtctttcctacaatagactgggataagcatttaagttaatctggggaatagccaaatattgtaagattctgtaaatcctgggctgcttgccaaaaatgggttaattccacacaaaggaataggaggccacagagcaacgcctgtgaacagatcactccttgcggatctggagccaaactctccagaatgagtgagaccggctctggcactcactcaccgtgtggcctgagcctccatctcttcagctgcaggatgggggaaccacagtacctacttcataagggtgtcatgaagatgaatgagttaatagagtgcctagaaaagtgcctggtatataattactgcttactaaaagttggctacaattattattgtcatcctataacatttctttgggctccatggaccaaaaggctcagtagtaggtgccaatttgtacgcttgcaaaatctatgtaaataatgccatgagagggtgggattacatgccagcagactaggactgaggacagctggggcttagataggcacatgggcactgggatcatgagacattgatagagcatgctatccaaggaattagacttctgaggacaattgctggggcatcatgtagaaaacatcacccaggagggctgcacatgtatgcaatgaagcctgagctgatcttgaattccaggcccaggtccccagtgttcccatccgtagacacagctcactcaaaagattaaatgcagatgaaaatgattagaaaagtatgaagtgaaatgcaagtataaagtgacatcattgtcatccttagttcctctgcttgcctggcagcctgcggagagtgctgaacccattgtccagaggtctgggtgggtctgggtgggcctgtgtggcctgggtgggtctctatggcctcagacatgtcacctcactgctctggaccccagattctttatccttaagtgagagagttcattgggatgatctctggagtgtccatcctgaaaatcaaccactccttaatatttgggtcctggagaatgtcttacaccaacaggcctcttaaatttccttgaatcatgcctgtccttgaagtcttgtttgtacacaagaacctgtaattccagaatggaaggcagcctctaagaccttatacttgagagctgagctttaagatatatgtggaggggtgaccagggaagaggggcagctctgtacaagcaaccaggagaatggccccagctgtatgctgagttcagaacaggaacagggaggcacccaggaacctcactctggtttccaagcaccatcactaagcagcctgcaaggactcctctcccatagagaagaaagagagcaggagactttggagtatttggtcaaggaatagaaaacatagagaagggtaatgaggaagaggaaggtagaaggtagaaagtggaaagccagcaaatggtcacccctggttctctcagccttgggaggagaggacttctcaggcacaggaatgtgatataaggaggggaggagacatggagcagggaagagatcatgaggggacagcacggaaagcaggcatggggcaggatgaggactgatgacctcttagcccagaggagacccaggttccctactacagacagcaagaagtagacatctcactttgtgcttaagcttcaataagctttgaaaatggcaagttatgttaataaaaggttacatacagacctgtcctgtggggagtgtgtgttcaacatctgtcaggtgagctacagtggaaaaaagattgagaactgctgttgcagaagggtccagggaagcaaccccttatcagaacactgaacacacacattgattcatttatccaacaactactgagaacttcctacgtgccagacctgatatactattcatttttatatcctaagcccaatataatgtgtgtacatagcaagaattagttgatgcttattgattacatgcatgcatttatcttgtttattgagtcaatacaagtttactgaaccctggaaatcttcaattccttcccctttcctaagcctaaaatctatgacactattaaaattgtagaccagtccccctgcatttctcttcagttgtctgttttaatctcttcaggtgctgccagtggcatgcccaaacccaaagctggaagaggaataaattacaagtggtcaaggttgcatccttttgagcccaggacctgcttgtaagccgagagggttctctggccctaatctagccaagcaccatggagagaatcagtgccttcttcagctctatctgggacaccatcttgaccaaacaccaagaaggcatctacaacaccatctgcctgggagtcctcctgggcctgccactcttggtgatcatcacactcctcttcatctgttgccattgctgctggagcccaccaggcaagaggggccagcagccagagaagaacaagaagaagaagaagaagaagaagaagaaggatgaagaagacctctggatctctgctcaacccaagcttctccagatggagaagagaccatcactgcctgtttagttaggcaggaagcagaggtgtttcctttctggggctaagcctccttctgaccacacacagacatttcaggaacccctgaaataatgcactatgtccatgtccacagagtaactactcaaccaaggaacaaacctcagactaagtgtcccagtggagggcagtcccagggaccacgtggacaattcttggatactgtcttggcagctatgtgtccaatagcaatgctccttactgcagacccaggcatgcctcccacctgtctctggcataccccacatgcaaagcacaaagaacatttatccatacatctcaatatggttcccaagtgtgtgcacatgcacgtaacacacacacacacaaattcaggtagcaggtacgtgggcaagtatattctgctcatcaaatggtcattggctatgtactttgtgcagggaagtacattatctacagtcacaaaaatgtctcatgggaaagccttgccagattcagacacatatatacaatttcctaaccagcaaggcccccatacaccatctattccataaaccactcaggttacagatgcatgctttcctatttctaactctacacataaacttttactggaagtactcataattggacattccagcaacctgctacagtccccacccttgtgtgtcttgatacagacacaccaagtttctgtgcctctgacccctcacctgtgccaagatgtttaaagtgtgatggttcaaaattcattgaaagctcttttcttgtaactcatgacaaagtccgtcctcattgccactgagaggtgtttaatgtgatccaagacctctctgtgaaacattacccccgcaaaccactcagcaaagtgcctttctccaagcaagaacaaagagctcttggtggtgactgctagaaaattatggaagcccactcatttatgtcagtggactgcaactgtgtacctgtgcaatgtttacagatggaaagggtgaggagatgctacacctgagctaggtatctcctatataaccaaagtttccagcagggaaggaactagacaatcatcagtgcagtctcacagaaggcaacactggaagtgatgtcataaggttgtgatgtgtgcacggtatggcacaggtgggatgcagaggtaacagagtttaaatgaaagtaggatgaagctataaagaggtttatttatatttatattgaagctcaggcaagtgccttgcacacagtaggtacttataactaactgtggttactgttggatatgtgatgttgttaagggtaagcttgtaatacctcaccagttctccccgagtgatcttctcttctaagtgagcccactaattgctgcaatggatgaaattgggtgtttaatgctggagagcacatgtaggtgacacatgtgccttgaggtatgtgaggacatgtaaattagatccacagtgagctgaggagggctttccccgccagagtgaggttgggaagcagagttaatccacttataggatgaactgcttggtatttttattgtattgtgactgtattacaaagatggacaattcactccttgggagcaagttatgctctagaagtttatttacaaatatgctgggcagctctcttgaaatattttcccaaggaagctattctacacagtggcaaaattgctatctaattaataatgtagctaaactatgatatttatagtagcaaaaaactaaattctataagattgcattaaaggaaagatatattctatttgctcacttgggctgcttggtactcacctgccctccaggtgtactttaggcctgtggagggtgggcatttagtggtgacccttgcaccagggttttctaacagatgaccctgtgaatcataatttaaacctgcatatattttatagccagtcacatttgccctctcaccctatatggccataaactgcctaagcactcaggcctcccactcatcaacccctttgaccagagaaagaagcactctggttctctatccccttgtcacatagagagtttgtcatggggcctctggctgtgcccttcacataacagaatgacttgccatctgcctgcaccaaacccagggatgtggaagacatctccccacaactgccactgctcaccaggacaagctgcccttcctgtctccacctctcagtccccctagaatggatggctggggagaggtggaggctgacagctgagacgtagtgtcagatatgatctaggagggcggatcaccgggatccgggaccatacaagtaacatggtttccatggcaactgcttgctcctttgaattaagacagcagtcagttgtcattgccatgacaaggcctctatctccaggcacaatgtccctgctgtctcctaatccaatggacttgctctcaccccagggatgaaacacccagaaactcacttctcagtcacttccacagccgatgactcagaagagccaaacccagaatggggcctctcttttccccatcacagactcccctgacaacctttcctggcgtaactagaggagtcccagtgcaggataggccctaaacgttttgttaaataaacaggtgcatgaaaggagcctaaggccattgttgatatccactctcttctttccacttccttctcatctttttctccatgttttatgcttctctgattccctcttctgcctgcaccagaccagccccagccctttattcctctccattttcactccttccagcctctgtccctgaactgccactggcaacccatgggacctcaggaccagagactgcttgactcatctggggagggtaagttcacgggggacaaaaaaatgattcctaaagaagaggcttcctagaccagcacaggctcgagaaagacatcccctaggcctggacttctgagcagctttagccaggctccggacggcagccagaggaggcctttccccattgctcctttccccattgctcaatggattccatgtttctttttcttggggggagcagggagggagaaaggtagaaaaatggcagccacctttccaagaaaaatataaagggtccaagctgtatagtatttgtcagtatttttttctgtaaaattcaaacacacacaaaagaaaaatttatttaaataaaatactttgaaaatgaaaagtcttgatgtagtcagatggttactctcttaacattaggtattacccccactcagacatcactcagaaatgatcaatgcagggactctttctgtgacacaaatgtcccagccctccctggtcaccgccttcgccatggtagagtcataggtctgaggatgaggaatgtggctgtctcacccttgcttgcaaaacagatggccttggagaccagactccctcaaaggtgccagctacaggaaaaatatactgatgttccttggcaacacttacagaactttccatcaatgaggtccatcaatggcttcttaaaggaaaaggggggaaatagcaaaaacctaaggaagaatggacctttgagttaaatccagtgtttgttgggaaaggagggatcaaaaacctctatagtagccactagggcaaaaactgtgtgtatgtgtgtgtgtaagtgtgtgtacactgttcaatatggttcaatatggtaccaatagccacatgtgactatttaaattcattgcaatgaaataaaattaaaggtatactagctc

SEQ ID NO: 36348 - DNA, 49915 bp, Homo sapiens
cggaggaggtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcaggtggggacgatggggacggggttcgccgcgcgggagttgggggagccagcccaggcataacggccgaggagggggcgtgcctggccgtggccagtggcgggttacaacctggaaaccaaaggtgccccagagggcgtctaagcggtcgaccgaaagttcagagcgggagcctgagacccaaggaagggcaaaggcgagccaaagccatcagttgagcttcagaaaaggtgggtttaggagtgagaggttgggagcccaggctggtacccagatgtccttgaccgtgtccaccatggccgatccgccacactgccattgggctggaagacagtctgccttttagttaacagaggtacaaactctccctcttaataaacagccctgtgtagctcagaaagccacacagacatctcaggtttacttaatctgcagtccacagaaagggcctgtgaactttgagctgaggacggcctgactgccctgggagcagcctcagctgtcactacctacctcctctcccctccccggccacacagacactcccattcctgctcatagcagccctgggtgagccattattattacagccattttataggccacaagaggaaggctctggaggcaggggcaggccttgaacccaggactccattagccagatgcccccaacagggccattgtcaccgtggaacccttacccatgcataatcctaacagtgccccaggggctctgggctcctgctccagcttcccagctgactttttctgtggcttctctcaaatccttctctctctctgggtttcatgaagcctgggtgaggtaggccctcatgtctgacagctgttgatcctaccacttgtctccaagaagtcttctgtgatgaattcagccccatcgtgagcctttctccggtactgcatgactccagaccaccacactgtgacaaccttggaactccaaggtgaaaaggggatcatgggggacaatccagtggagtcgtgggctcaagacctgtccctgccaccagacccttcctttttttaacgtatgaaatggctgtaattataataatggctccttgaaaaactgttattcagaattaacaaggctgctttccacagatctggctcaagagtctcacccatccatttgtccatccccctacccactacctactgtcaacttgaagtaataagattcagaaaatatgattaagtacagagtttatccaagcctaaagcttgaggatggccaactgggaccatagattcaaatttctgtgactatccactctgattagcagcagttacatataagtttttaaggaaaaaagaagaagcagttcctaaattgtttaccaagaatttacattaaaatgacataagcagtcgggcacagtggctcatgcctgtaatcccagcactttgggaggctgaggcaggaggatcacatgaggccaagggtttgaggcctggccaacatggggaaaccccgtctctattaaaaaatatgaaaatcagccaggtgtggtggtacacatctgtaatcccagctactcaggaggctgaggcatgagaatcgcttgaacctgggagatggaggttgcaatgagccgagatcacgccaccgcactccagcctggatgacagagtgagactttgtcttaaataaataaataaataaataaataaataaataaataaaacagagaatctctatggcagaacaacaccaaacctattccactggggagtcaactaaaaacatcacgaagaaaatcccaagccttctttaaaagccaggaattggcttctaaaactttttctacaaccttccttgttgtagccaggaaataattcaggatttagtccaaattgcaggaaaataaaaactaaaaaacaatggccagggctggaatctaataacaggaataacaggtgtgcataacaggtgtgctaagattttcttctgaaacataatttttctctctctagttccctgtttttaccaaaaatgagtcttgataggacaaatttacttgcaaagtaagttttaatattacacttggcctgataatttgcattattggaactttcataaggaattttggatttgacttttttttttttttttttgagacacagggtctcactctgtcacccagactagagtgcaatggcatgatcgtggctcactgcaacctccacctcccagggtcaagcaatcctcctaccttggcctcccaagtagctgggactataggtatgcaccaccacacctggctaattttttttttgtattttttttgtagagacggggtttcaccatgttgtccaggctggtctagaattcctgggctcaagtgatcctcttgcctcagccttccaaagtgctgggattataggcgtgaaacaccacgcctggcctggatttgacttttaaaagccttacagctaaaaagccaaaccaaggattcaccatcagactatgcctgtgatacccatacacattgggtgaattattctcttctcaaggtcccaaaatatcttgaggttcctagacctgtcggaaagtgacattcttttcttaccacaaggtcgggaaccttgtaagggaactgtgtagacaaggaccaagctagtccagtctttccaaggatttttttttttttttttttttgagacagggtctcactctgttgcccaggctggagtgtggtggtgcaattttggctcactgcagcctccacctcccaggttcaagtgattctcccacttcagcttcctgagtagctggaactacaggtgtgcaccaccactcctggctaatttttgtatttgttggtagagatgtggcttcaccatgttggccagggtggtcttgaaaactccgacctcaagtgaactgcccacctcagtgtcccaaagtgctgggcccccttttattgtattttattttattcttgttaacattttttaatagaggcggggtctcactatgttgcccaggctggtttcaaactcctggactcaagtgatccacctacctcagcctcccaaagtgctgggattacagacctgagccaccaagcctggcccccaagggtcttcttatgggctctgtaaacttgacttcagttcctgaaagcagtctgatcatatatgaagatatatcatttcagtcaaagccttggtaaaattaccagtgtctccaatgtggtctgttatgaaagaaaacatactcttattgaacttatgcaaataactatattgtcataaaataagaatactcacaaatagccaggtgcggtggctcacgcctgtaaacccagcactttgggaggctgtggtgggcggatcagttgaggtcaggagttggagatcagcctggccaacatggtgaaaccccatctttactaaaaatacaaaaattgtgctgggctcagtggctcacgcctgtaatcctagcactttgggaggccaaagtgggtggatcacgaggtcagaagttcgagaccagtatgaccaacatggtgaaacctatctctactaagaatgcaaaaattagctgggcatggtggtgggcacctgtaatcccagctactcgggaggctgaggcaggagaactgcttgaaccccacgaggcagaggttgcagtgagccaagattgtgccactgcactccagcctgggcaacagagaaagactccacctcagaaagaaaaattagccaagcgtggtggcatgtacctgtagtcccagctactcaggaggctgaggcaggaaaatcgcttgaacctaggaggcagaggttgcagtgagccgagatcatgccactgcactccagcctgggtgacagagcaagactctgtctaaaaaaaaaaaattaatttaaaaatgaaaataaaaaaagtaaacacaaatagtttgcaaattttggtgaaatcaggtagagagaaagacaaatgtttcaattttgctcacaaaagtatcttttatccagttgctgtgacaaaagaaaaaattttcttgactgaaaaacaatataaaaagaatcagcaatgtttcaaattttaaaaatcataaaaatcacttttatcctctatcagtttagtcccatgtaaataattcttgctctgcttgatgttgggttagcagtcttcatgaatgcctcaggtttttattagagttctggaagcttttgcttaatccaatggtaagatctctgaagttaccagaaacctgtattcaagagtacttgtcagggtttttttccaaaaatttccttaaagatgaagcaaattttgtagctgattataaacgactttttttaaaagaatcaaagtaaaataaaaattgtcggctgggtgcggtggctcacgcctgtaatcccagcactttgggaggctgaggcgggccgatcacgaggtcaggagatcgagaccatggtgaaaccctgtctctactaaaaatacaaaaaaattagccaggcgtggtggcgggcacctgtagtcccagctacttgggaggctgaggcaggagaatggcatgaacccgggaggtggagcttgcagtgagccgagattacgccactgcactccagcctgggcgacagaatgagactctgtctcaaaaaaaaaacaaattgtctgtggatgataaaaggcttagaatagccacggtcaaagatgaaattgactaggatatgtggttatttgtgtggcacacaccagtttatcataataattatgataatgatatactgataacatataccaagacatatcagacttttaggaatctcatacaattttggaacacattaataatacgcttttataaatataactcaaagaaagttaaacatcatttcttatttgacaatatttcccatatgactttgacatcccaaataagcctaatgtgtctcttttggacttccaggggtcctggttatgcccaagttagcttgggtcaaaaagacttaatttaattttgggaagtatctcaaatattaaaggtttaaaacacttgatatagaaataagaaaggtttaaaacacatgatcaaaatagaatcacaggtcactacaaaataatggtaattactttagccaaaatgattattcaaagatttcaaaaagcaaaaaccactctgatagaggagattcagttctcaatcaagagacctaataaagacagcatgggacaaactctccccagttaccttttctttgccatttatgcaaaagtaaatacatcttttaccgtctcttattaattctacattacatttttattcaaaggagaaaaacaagttttacttttaggccaggcacagtggctcatgcctgtaatcctagccctttgggaggccaaggcaggcagatcacttgagctcaggagttcaaaaccagcctgagcaacatggtgaaaccctgtctctacaaaagatacaaaaattagctgcgtgtggtggtgtgtgcctatagtcccagctacttggggggctgaggcaggaggattgcttgagcctgggaggtcaaggctgcagtgagccaagattgcaccactgaacttcatcttgggtgacaaagtgagaccctgtctcaaaaaaagaaaaaaattacttaggtgttagtatattatctatcatccaatttcagtcagctttgactacacaagataagataatcgataatctctcaccattttctattaaagagcagatcaatgctctgataaaacctggttgttccaacacaggagcccagactctggccttacatgagtgtgcttttgatattaatacttaagttttagaaaaacttataaaaaattccttcttttttttttttttttttttttttgagatggagtttcgctcttgttgcccaggctggagtgcagtggcatgaactgcctcactgcaacctccacctcccaggtacaagcaattttcctgccttagcctcccgagtagctaggactacaggtgcacaacaccatgcccagttaatttttatatttttagtagagacggggtttcaccatgttagccaggctggtctcaaattcctgacctcaggtgatccacctgtctcggcctcctaaagtggtgggattacagccatgaaccaccgcgcctggccatttccttctgattttttttttttttttttttttgagattgagtcttgctctgtcactcaggctggagtgcaatggcgcaatctctgctcactgcaacctccacctcccagattcaagtgatctcctgcctcagcctcctgagtagctgtgattacaggcgtgcaccaccacacctggctaatttttgtatttttagtagagacggggtttctccatgttggtcaggctggtctcaaactcctgacttcgtgatctgcctgcctcggcctcccaaagttctgggattacaggcaggagccaccacaccctgccatttccttctcattttaaccaatttgatcacatacaaaatgtcttttgtgagattaatcttccacagaccttctagaatttgcttaaatcttcagttttgtcctatacttcctttttattttggcattctaccttaggacaaaaatttacttcccttttcccattatcattttgactacacaaagttctctctcatgcaaaagaaaaattactctctttcaacagtctttaccaaaaacacatctgactttatacactctgtaaatagaactgtttcttttatatcaagtagttttaatcacatatgttaactacaattttcactcttagtaacccaaatttccagtgaaaaacctaggaagtaagtaatttttagctgttttctaccagcatttgtagatgaaaataatttcataatttctagaaagatggctcctcaatttttttttgttaacagatcgaaatatatttagcttttctataccatataaatgattcagacgttttataatgacctattacttcatttaacataacatgatattaagttactgaaaacaatttttgtttgtttgtttttgagacggagtttcactcttgttgccctggttggagtgcaatggtgtgatcttggctcactgcaacctctgcctcctgggttcaagtgattctcctgcctcagcctcccgagtagctgggattacaggcatgcgccaccatgcctggctaattttgtatttgtagtagagacggggtttctccacgttggtcaggctgtctcgaacccctgacctcaggttatctgcctgccttggcctcccaaagtgctgggattacaggcgttagccaccgtgtccagcctgaaaacaacttttaaaactatgaaatgttcatttataaactttgatctcatttacatttatttaattttttcattcttaacaattttgcctgaatagttcattaaacaaagctagccaccatcaatttatttctttgctaatcatttctatagcctgtgaatgtcatcctcccaagcagctggaacttgaggcattctccaccatgcccagccaggttttttgttttgttttgtttgttgttttttggtaaaaatggggtctagctatgttgctcaggctggtctcaaactcctggccttaagtgatcctcccacctcagcctcctgagtagctgggattacaggtgcaagccaccatgctcagctcttgaatttcattacgtaaggttgacactatgaatattcattttgcatccacatacccactttcctatccattcacccattattcattcatccatccatcattcaccaaacatctattcagcatatattttgggccatgagtcaaagaacagatcagatccttccctgacctggaagagttctctggctggttgggaaagaagctagcagcacctgataattgtttttttttggggggggggacagggtctcactctgttgcccaggctggagtgcagtggcatagtggcatgatcatggctcactgcaacctcctgggcttaggtgacccgcccctgacctcagcctcccaagtagttaggactacaggtgcatgccaccatgcccagctaattttattttattttattttattttattttattttattttattttattttttgtggtagaggcagagtctcactatgttgcccaggctggtctcgaactccttgggctcaagtgatcctcctacctcagcctcccaaagtgttgggattacagacatgagccaccatgcctgaccagcccctgataattctgttcaattcagcaaacacttctggtcacaccctgctccctgtggggagtgagaacgaagcgagcctgccctcaagaagctcctagtcaatggggcagccagatctgggcccagcagctgagtgtaaggccagctgtaagaaaggctaagatggagacgagatcacacccttggggaaggagagtgcagagcagactttggggaaaaaagcaatttcaaaaagcagagatatggaaggtgggaagagcaggaagcatgaaccccactgacctctcacgtagtccagggccagagggtcacagactccctggaatgtatgtttcatgagggcagcacctggaacagggcccagcacataataggtgctcagttaatactccataagtagatgttctttcccagaccccaagctgtttgccttaaagtcccacttgaaaggctggaaaagcaagtcacaggcaagacttgtcctagataaagtaaagtgtgaggaaggggtgcaaatcaagattagaggcatacctgatgtggacctccgaggatcagagatgtcctagtcccagctcatccaccaacttgccatatgactttgggcaagttacctcaccttcagatgcctccattggaaaagaatacaagggtaagaggaggtgacccctgtggggggcctgttatttggaaagtgacagtattacgacttttttcctaactccctcctgtacagaaactcagccaagaatgtttaaagcagctggcaatcaagaagcagcagcacattgacaacataacccagatagaagatgccaccgagaagctcaaggcaagtggacatttcttcctcatacccatggaaagacccacatttccccccagacaaaagggacccccaatatggagccaatgaaaataaaaaccaactgcgaaggggcagatggtggggcctggagcttctataattcagggttctttagaaaaagaacacaaaattacagacaaaattaggtgcaagaccatgaaggggctctgcaagtgaggggccctgagctccggtttcctttgctttgtggcaaatctctggttccttagtgtcatctgccagtctcttggaggaattagcccattatcccaaattgccttaaacaaagcaaaacacagcttaaggaatatgcagatatctctttaattccactgccatgctgaaagaaagcaagtagggtaagatctgttccacaaataggtactttcttcactctcctttcataatgatgtttgagtggattctctgtggattttgaatgggaacttgaggctgatgttattctaagtaaccattttgacatgacaaagttgttgtgtttttagggcctcaggggctggtcatttccccttgcatcctccgttgctccctccccctttcatcctgttgctccctccccctttcatcctctgttgctccctcctccccttcatcctctgttgctccctcctcgcagtgagggctggggtgggaggccctcctggggcctgccccactgagagctggaagaacccctgctctgcactttgggaggccaaggctggaggatcacttgagcccaggagttcgagaccagcctaggcaagatagtgagactcccatctctactaaaaataaataaaataaaatagccaggtatggtggtgcacgcctgcagtcccagctgtttcagaggctggggtgggaagatcgcttgagccctgaagcttgagactgcagtgacctaggatcacgtcactgtgctccagcctgggcaacagagcaaaaccctatcaaaaaaaaaaaaaaaaaaggaacccctgactgattcacacaagaggaggagtggctgtgaccatgggagaagctggcacccagtttctcctgtgaccaggccaggccacagaattggctcccacatttgcctaaagtccattctctgtcagttgtcttcatgacagtttgccagtaccctgaagacgtttgtagttcacacctgtggtcccagcttaatagtgtctctcatgtcttcacaagcagaactctgggctaggagatagacagtaccaaaggatttagaaagtgaaagctgtcacgttggaagggttgtggggaggcctgaagatcaggctccctgtctgcaaatgcctgagcagatatggtttgagggcccccaagaattaggacccatgtggagggtctagtcttccccaggccacactggaagaattgtcttgggccacacataaaatacactaacactaacaatagctgatgagctaaagaaaaaaaaaatatccaaaaaactcatgatgttttaagaaagtttacaaatttgtgttgtgccacattcaaagctgtgctgggccacatgcggcccacaggctgcaggttggataagcttggcctgagggatggcctggggtaggtttcagcttaatctaagccatggttctctttctcttgaccctttccccaactaactttttaactttttatagatttagaggaagttgcaaaaatagtagagttttgtgtaccttgacctagtttgccccaagggttacttgttacataactatagcacactatccaaaaaaaaaaaaaaaaaggatggtatgtgtgtatagttttatgtcaacttatcacatgtatagatttgcataaccaccactgcaatcaaaatgcaggctattccatcactgccaagttctaccttcttctaggccaagcgaggtggctcatgcctgtaatcccagcactttggtaggctgaggcaggcagatcatttgaggtcaggagttcgagaccagcctggccatcatgttgaaaccccatctctactaaaaaaaaaatacaaaaaaatgccgggaatggtggcgcctataatccaagctactcagaaggctgaggtgggaggatcgcttgaacccaggaggtggaggttgcagtgagccaagatcatgcctctgtactccagcctggatgacagagcgagactccatcttaaaaaaaaaaatctacctacacctttatggtcacctccctacccactgtatccccccgaccaatccctaacccctggcaattattaatttgtttgataattgttgcatttgaaaatgtcataaaaatggaaaatgatcttttgaggtatttttcactcagcagaatgcccttgggatccacccaagttgttgcaagaaccactagttcattcccatgtattgctgagtagtaatattccactaatccgatagtatgcatgtaccatagaggttttttaaaccatttacctattgtaggctgtttggtacagtctagggctattgcaaataaggcttctttgaacagttgtgtccaggtttctgtgcggacataagttttcatttatctgtgttagatgcccaggaatgctattgctgggtcatatggcacctgcctgttttgttttttaagaaactgccaaacgcttttccagagtggttgtgccattttacattcccaccagcaatgcatgagagtgtgtttttctgcatctttgacaacatttggtattgtcacaagtttttatcttaacttgcataatctgtgtgtagtgataccttatcatggttttaatttgcattcccccagtagctagtgatgttgagtatctattcatgtgcttgtttaccatctctacaaaaaactaaaaaatcatccaggtatggtggcacatgcctgtagtcccagctactcaggaggctgaggtgggaggatcgcttgagctcagaaggttgaaattgcagtgagcaatgaccatacccactacactccagcctgggtgacagagcgagaccatgtctcaaaaaaaaaaaaaaaaaagaagaaagaaaagaaaaagagtttgttgggattttgataggaattgtgttaaacctgtttatcaatttggggagaattgacatttttactatgtattcttccaatccatgaatatggtatatctttccatttatttagatctctgttttctttcatcagcattttgtaattttcagcatacaaattctgtatgttttgttagactaacacctaagtggccttcataaggtaataagaaaaatggaattaatagtcagcattttaaacctgagacatatttgtataaaaatttatagttaggaaattagaaagatattgccaccctatgcctgcactctcatgtgggggcagatggagctgagcaatggctactcccatggcatgggatctcccagctccaccctgcccacttccttcagtgttaacaacctggctcctgtgagcatttatattcaattcctgatcaagaaacatatttttaaaaattcatccataatcctgcatcctgccacttcaggccaaccattattcacattttgagatttttttcctgtatatgcatatgcttttaatgtagcttgagttatattgtacatacaattctaatatatccccaatctggaggtgaggcatggtggttcattttcttgtgtggtttgtcacgtgtattatcatcttgtctccagtagctatttaccatagatgtccaatacactgtggattgtgagtgtgccccttcagagcactgtgacatgagcatcttcaggagatgctaagagtttcagtagctccagactcattttcatattatttttcagttttgagtttccgtgaatttggactccaaccctgcttaatgcaaaactgttgttttatttgttttgctggtgattttcttttcacctgtgaccctggatgaatgactagattcctcttcttttccctgggcccgggggtggagtttttctggtgctagttgatggatggagcagctctttgtggatctgacttgatgcaggtcactcctttccactctcagctggaatgtggccaggtactctgtgctccccctggatggccaggccccattgtggctttcgtctgcatgcatgcacctctggctccactccttccaggtcacttagcttcagctcctgccaggtcactcacactgtgtttcctctttggttttggcatcagtgaatttactttgtttgtttgtttttttgtttgtttgtttgttttttgagacagagtctcgatctgttgccaaggctagagcacagtggcgtgatctcagctcactgcaacctccgcctcctgggctcaagcaattctcctgcctcagcctcccgaattgctgggactgcaggtgcccactaccgtgcctggctaatttttgtatttttagtagggatcgggtttcactatgttggccaggctggtctcgaactcctgacgtcaagtgatcctgaaaatgcagtcggcggggctcagcccctctgtcctacagagcagagccggggatgggcaggaaatgggcctgagacacaagggcccagcctggcaccagacccagaacccctgcgggtggaataaggagcctcagttgctggctccatgcctttctctgtgacccgcaggagctgtagggactgagccaaggcttgggatcaaggcaccaatggggggacatgaaccagcctttgccagactgggaacaaaaagatggggaccctgccaggccatgctgctgacaaggccactggtgtccattgcccctgctgggcatggccactccctgcctcttcctgcctgccattgccaccatagcagagtctaaagagtccccatgctaacgtggtctgggcaaggttggacagcatgccttctttccctggtggtgcatcccatgagaggcatccgtgggagggttgttggaagtcatactgagttttcagcaaaacagcgccctcctttcatctcctcactctccacaggacccagaggtggattcacacagcagcccacactctgagtgcaaaatcccccagccttccctgaccggggcttcatggctgttcagcttctttctcttccacagtccttagaccctgctcagctagactctgttaggccctcacccagccaccagctctcttcaaagcccagcccagttcagctgggatcttcactttgaaccagtgggacccaaaccagatggcgtacttccttatttcatgaccatgatattctcttgctctctttctctctctctctctccccttccctctctctctctacccctttctgaccatattgcataatcagcctcatctgcttatacaagaagttttctggtggctgttttccatactggttgccactgtgctgagagttagaacaaggtatagcgtcgtgaagcttcttttgtattttctactttacaaagtggatctataaaaactgcttggagcataacttggttgggaggagatatttgctctcttggtttctctgcaaaggtcctctgtgtacttacgttgcttcaacatgtgttcataaatcaagagtttgaaatacattttattttcttcatttgatcattcagtaaatatatatttgtgtccaggctcattgacccattgcaaccataaaaatgtggactaattcccaggctagcttaaagctataatccataggcctgtgtatgagctagcctctgaacctatccataggcctgtggtatgagctagcctctgaacctatcctctgcctggagcattggataggaaacacagatttagagaactcatctcctgtttgctgccaaaccacatgctgtccccctgagaacacggtatcacgggagcctgcccacccctcgtgactggctgggtgctgggttcattctgctatgtggactgtgcagatgtttgggctgaggaagggagctggcctatgtttaattttttttttttttttttttgagacggagtctcgctctgttgccaggctggagtgcagtagcacaatctcggctcactgcaacctctgcctcccgggttcaggcgattctcctgccttagcctcccgagtagccaggactacaggtgcccaccaccacacctggctaattttttatatctttagtagagacagggtttcaccatgttggccaggatggtctccatctcctgacctcgtgatccattcgcctcagcctcccaaagtgctggaattacaggcgtgagccaccgtgcccagctttagtgtttttttaattgtataaataatacatgaacaaattgtcattttttaaaatttaaacaatggtatagtatggaactacataaggtacaaagtgagagcctctcttttcccttacccccaatcccatgcctcttgccaaatatgaccactactaacaaacattttaattgcacttgcaaatatatagatgtatacatatgtccatatacaggttttgttttattatgttttacataaatttggattatcttgcttatattattctgcagcttgttctttttcacctgttttttttttttctggagaactttccctgccaggacatataggtctactgcattgttttttgttgttgttgtttgtttttggagatggagtctcgttctgttgcccaggctggagtgcagtggcatgatctcggctcactgcaacctccgcctcctgggttcaagcaattctttgccccagcctcctgagtagctgggattacaggcgcccgccacacgcccggctaatttttttgtatttttagtagagacagggtttcaccatcttggccaggctggtcttgaactcctgacctcatgatctgcccgcctcagcctcccaaagtgctgggattgcaggcgtgagccaccgcgcccagcctactgcattgtttttgttgttatattttcttcttctttttttttatggtgataaaatatacataacataaaatttgccattttaaccattttaaagtattcaattcagtggtatgaattatattcacaatgttgtatagccatcacctgtgtctacttccaaaactttttcattatcccaaacagaaactctgaaaccatcaagcaattactccccatttcccctctcccagcccttggtaacgtcgactctactttctgtctctataaatttgcctggtctagatgtttcacataagcggaatgataaattatttgtccttttttgtctggcttaattcactggggatgatgtcttcgaggttcatccatgtttagcatgcatcagcacactgcattctttgtaatcgctataaattatttcattgtacgaatgtaggacaatttatataatgaaccgatatacatatcccatattgaaaattgtgccaaatatgtcatggttaacaactgtctgaggctggtgcacaggggaataaaataatttaccaaaacagcattgagtttagaaaggcagatttatttagagaaaagggggagatacattgaaagggagcaatgggtgagacagcagaaagaagactgtctgcaaagaggcaggagctggaggtggagttttctaaggttgtgctgcttgagctgaatgcttgcagacaggatgcctgggtgcaggtggactgtgagttgagtgcttgtaacaggatgcttgagtgctagtgagctgtttgtggttgaccctatttctcagaacgttcgctccccactgctgttgtttctgtttctgctagtgacgcccatttttcaatgtttttttcttttcttttttttttttttttttgagtcaaagtcttgcattgtcgcccaggctggggtgcagcggcctgatctcagctcactgcaagctccacctcccgggctcaagtgattctcaagcctcagcctcccaagtagctgggattacagacacctaccactacacttgcccaattctattctctatgtgtagaagctatatactgagaatcttggtacacaaatcttcatgcacatgtgaaagcattttctaggatataagtaaagtaagaggaattgctgcatgaaagaataaatgtatttaaaactttgaggccaggtgcagtggctcatgcctgtaatccagcactttgggggaccaaggcaggcagatcacctgaggtcaggagttcaagacccagcctggccaacagtgactccctgtctctgctaaaaatacaaaaattagccaggcatggtgatggccacctgcagtcccagctacacggctgaggcaggagaatcgcttgtacccgggaagcggaggttgcagtgagccgagatcttgccattgcactccagcctaggcgacaagagcaaaacttcgtctgaaaaaaaaaaaaaaattgatagctattgtcgtattgtcctctaaaagcgaagtaccaatagaccctaccacccacagtttatataaatgccctacttcacatacccttacagactgtatttcagtctcttaaaagtcttccaatctaatgatcaaaaactattttctgggctgggcatggtgtctcatgcctgtaatctcagcattttgggaggctgaggcaggtggatcacctgaggtcagaagttcaagaccagcctgaccaacatggtgaaactccgtctctactaaaaatacaaaattacctatgtgtggtggtgcgtgcttgtaatcccagctactcaggaggctgaggcaggagaatcgcttgaacctgggaggcagtggttgctgtgagccaagatcgcaccactgcactcagcctggacaagagtgaaactccttctcaaaaaataaaaataaataaataaataaataaaaattgttttgtatttcatctaattgatttattctttgggctttatgtacagtgttttagtttaactggaccttctcttttgtttgttttccttaacctttcattgtggaaaatctcatattattttaattatttttacttttatatttttagtacaaaaaatacaaaaatttgttctaaaatgccactgttacaccacacatacacatacatacatttccatatataatttgagttcttttaaaagctctttattttgtacttttgacctcttatctatgcttgagccacatggttttagatcctgtagatttattgttttgttatcagataaggcagataaggcagataacctcttatcagttttctctttattgatttttttaaagcaattttggcttttcttatgcttattctctctcctaatgatttaataatttttaatcagcatgttaagattttgattagaatttcatcaaatttatagactaatttagagacaaatagtgactttatagtaatcaaccctcccagtcacgaatatggttttgtattaggtatatttccacatattttgctattttttctcccattttcaaaaggatctttatttctccgtgcattttacgatcggtgatgggctggtgcttaggaaagctttggtttttataagttgatcttgtgtctgactggccactttactgaactcacatttcagacgttatgatttttttcatgttgattattctggatttcctggttggcagacatgtcatctgcaactggtttttctgtttttaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggtaatgctggggtcactgctcttactgctgccacctgccacccacacttcatctcaagtattgtggcattgagcacagtattgacacactaagcaagtacatggactattgtcttgtcaccatgtagactgtcttgcccccacacaggtggtcaagagaatatacattgttaggaagataatacacctcttgggctaattaaataatattaacagccaccaatttcaaaggcccctgtgtcctgagcactgtgtagtttagcactaatattcaccagaactctgcaaagtgggctcaccccattttataaacaagaaattgaggctcagtgaagtgactcacctggtctcacacagcaggtaggtagcagagctggtatcaggtctggctgtctgtctaggtctgtctgactctaaacccacaagggaccctgcctggccctctgactgtacagtcttttttttttttttttttttttgagatggagtttctctcttgttgcccaggccggagtacagtggtgcgatctcagctcaccacaacctctgcctcctgggttcaagcagttctcctggctcagcctcctgagtagctgggattacaggcatgtgccaccatgcgtggctaattttgtatttttagtagagacagggtttctccacgttggtcaggctggtcttgaactcctgacctcaggtgatccgcccacctcagcctcccaaagtgctgggattataggtgtgagccaccgcaatcagcctgcctttatagtcttaaattgagacaccccacctgaaaaggcaggtgtccttgcagctactgagcacatttcaaaggctgagtcacagctggctcaatggtactccttggccactgggctttgttgaggaagagtctaagaaatagcccctgtggcagatcacttgaggccagaagtttgagaccagcctgaccaacatggcaaaaccacctctctactaaaaatacaaatatcagccaggcgtgatggcgtgcacctgtgaggctgaggtgggagaatcacttgaatcggggaggcaaagattgcagtgagtaacgagatcatgccactgcactccaggccgggtaacagagtgagactctgtctcaaaaaaaagaaaagaactagccccagggatagtcattgctacatttagagaaagcatgttgttgaggatggtgttcctgtctacttttttctttttttttgagacggagtcttgctctgtcgcccaggctggagtgcagtggtgtgatctcggcttacagcaagctccacctcccaccattctcctgcctcagcctcccgagtagctgggactacaggcgccccccaccacgcccagctaattttttgtattttttagtagagatggggtttcaccatgttagccaggatggtctccatctcctgacctcgtgatccgcccccctcggcccctcaaagtgctgggattacaggcgtgagccaccgcacccggccgatggtgttcctgtctttagggaaccgtggaagaaactgttgtctggtgtcaatatccctgtgcagtcacttctgcactagaattgcttttccactaatagagctcctcctgtttccttctttgccttgggaagttcagagccaaatctgctttgactaaccagactaaggcttcatggcaaacactttgtgtctaattttctcttagcttcatttttctcgctataaagaaaaatcttgccttattagaggaccttcacaagacactttaaaggctgtgggacaaggcagggtacaactaaaagtggcaccaactctaaccacagattagtatgggctctggctggaaaataagacagacaaataagccagtcaacacaaaacccgccaagccagtctccagctggggatttccactcttgtgtctttatgtggcctcagtcggttcagcctgtgtctcattgtcagctgtttgagccaaattctggatgaagtgttttcctaggcataatgggtgttgtgctttaagagaggcaagatgcacaaagtgttacatgtaattgtctctttttaaataatggtcgtttttaaggctatggaatacaaaggaatccttccatggagaagcatgctattctcacatcagaaaacggtttcagggctttgtcatctttttttttcaaattctcttgggccacagctaatgattttaatcattcaccgttcccaccttctatgtgttcattcgtttattcatcaatatgtactgagccaggtcacttgctggacattaggagctcacagttgggtgggggacttgctcagaaacagttatttacaatacagcttaaacaattttgtaaatatgaagctagcaaaattatgtccaagaaatgtctgacactctctggctgggagaaggatgcagtctgggaagacttctaggaagaggtgatggtagggttgggtgctggacaatgagtaggagcacactgtatatagagaggacgcagagaggacagacaggaactgtgtacatgtgagagcttgacaggctggggaaccagctggggtgcagcctgacttgaggagaggtgagggtataagggtggggggattgagagacacagctggatccataggccatagttagttcatgaaggccttatgtgccatggagttcagactttgtcctgtaatgagataggagacaggaatgtttgtttgtttgtttttgagacagggtctcactctattgcccaggctagaatgcagtggctcaatctcagcttactgcaacctttgcctcccaggttcaagggattctcctgcctcagcccctggaagagctgagacgacaagcacgtgccaccatgcccagctaatttttgtatttttagtagagacagtgtttcaccatgttggccaggctggtctcaaactcttgacctcaagtgatctgcccaccttggcctcccaaagagctgggaggtgtgagccactgcacccagcccaggggagtgttttgaactgagggatgaaagcattcacatggtcagattagtgctttagaaaagtcactttagagatagagtggaagatggacagaggaggccaggatgggaggctggaagagaacttgggaggaggccacaatgtccaggagagagatgatggtggcctggaccaagacaggggcagtggggatggggagaaacaggcaggtcaagagatgccacaggaatggagattggaattggagaatgggtaggaggaatccccagatgatgcctgggtttctggcctgagagatgaagggctgggatttctgttctctgagtctgcaaaggcaaaaaagtggctgtgctcggtttcatgcattgatttattccatcatacatatgttttgagaacctgtgtgtcaggtctggtgctagctgctggagtttggggttaccaggtggtgccatgtgtcctctatcgacccctcatcctaccctactcatctgccctctgagccccctctcgcctccccggagctgctccctgcccaccctggacttcctgctagtgcttggtctcccctggccagctccattccagcgctctgggtgtgaccttaggcctggttccccaccaaaatgaggttggactctatagactcctggcctcctaggctgaatggggcttgcaggccatctcacagccccctcccaatgtacagcatgctgccaggtgggatctgcccctgcccaacagccaagtgctaggccaccctccctccctcctgaggccctcatctgtccaccccttctcgggtgggcagcactgccactgccagccaagcctgatcacctgaggcagtcatcttccttccaactcctggccaggacagagcttcagaaaatgcagccatggttcttacctgcaaacatgagaatccactggaactgttttaagcaagaaaggagtttatggaagagtatgagatagcccataggatctccaggagggccagagagtcgggatggaagatgggcagcaggaatgaagtccagactccagcaggggttggtgccagtataggccccacggcacccctgctgggcaagacatcaccactcacaccactgaccagagcccccaccactgctgtccctcagtgccacatgccaccatcactaccttcaccgtcatttccaaatccacgctttggcttggaggcgtctggtcacactcctgcagcacaggtgcaaagggagctgggagagggggttttctagcttctccttagtgaagccacataccacaggaaagtattgaagaggggctgtccaggtgcaaaacaggacacatgtcccctgcggtggccacaccccctcagtcagcactgcagctgaaccttgctggcctttggcgtccttcttagaacatggtttcctgctccacctttgaataagctccaggtgctccttccccagggagactgacctctcaccctttttgtacccaaggcagacccgtggcgcagtgtgtgtgaggctgaagcctctctgggaagggccccgtgtcagcctgaccctgccttctgcatgcatagctggcacagagtaggtttcaatgaacacgtaaggaaggaaggaaaggaggaaggatggagagggaggaatccccagtgccagcactgaaaaaccgcacctccgcatggctcccacctcagggatgccgtatggtctctccagggctctgctcctgcaggcatggcctgggctgaccataggtgccaggccaacgtggagcctgggcatgctggtgtgggtttgttcctgggtgcagcacaggaggctgggatgctgcctgcatctcccagagccaccctcacccccgtgtgcccacacaggcatacacggccaccgagcaggagatgcagcagcagatgagcctcggggagctgtgccatcccgtgcccctctcctttgagcccgtcaagagcttctttaagggcctcgtggaagccgtggagagtacattacagacgccattggacattcgccttaaggaaagtaagtcgccgagtgaccaactttgtgtccttaactcccctagtgtcctttagcccagagacgaatgcaaagatcatctccctacatcctgtctctcccacactgaggcccttggctgggcggtcaggggctcctgggcctggtgcccaacccaccctcaccacttcacctccaacccttcctgagactgagacctgcccttctccagtcacactgccctgcttctgcccctcagattgctcctgggagcctgccacatctcagccttgctctgggctcccagctggaatgaccaactcttcctccttctcttcctctggctggggccaaggcctggcaccccttcgaggcagactggcacagctgcgcccacctgggaagccctttcctgccagcccagccctgactcactctctcctttagccatctcccctctcccttcccgctccagggcctgcccatgtcctgctagagggtgctcatgaagtggatacatggacccccctccttgccccttgtaagcacgtgaagggcagaaaccagctttaggtccaactctgaggtccccccagggcctggcacaaaacatgtactcaaaaatatctgttctttgattcatttatgcattcattcattcattcacctctgctatcatgattcattcagaacatttatcaagcccctcttatatgccaggcatagcagggcacaaaacaaagctccttctcctcttttggtgctcacagtcttcgtaggggaagacagaccgtacacaaacatgtcaggtgacaggaactgctatactgctataaagaataataaaggccgggcgtggtggctcacgcctgtaatcccagcactttgggaggccgaggtgggtggatgatgaggtcaggagtttgagaccagcctggccaacatggtgaaaccccatctctactacaaatacaaaaattagccaggcatggtggcatgcacctgtaatcccagctactcgggaagctgaggcaggagaattgcttgaacccgggaggtggaggttgcagtgagttgagatcatgccactgtacttcaacctgggtgacagagcaagactctgtctcaaaaataacaataataataataataataaaccagggcaggatggaagacaggaaagtgacaaggaggaggagctgttttatataagcagttgggatggcctctgagaaggggacactcaaggtggcccaaaggaagcattcattctgcaggttctgtgggtctgaagggccagagagcacagtggtcataggcacggcctctggagctaggcctcctgggttcctatccgaggtctaccacttggaaccctgctgaaccctgccatcttagacacggctcctcccttttccatgcctctgtttctgcatctgtaaagtggagaccataatgcagtcgcctctcctgggctgctgtgaggattaaatgagctcttacacatatagcgctcaggcatattaagcaccacgtatgtcttggcgattatgattgctgctgctgttacgtctgggggaggtattctagacagagggaaaagcaagggtggaggtcctgaggcgcgatgggagtgagctggccatatcgaaggagcagcaatggggacaacaggagtggacgtagggtcacaggggagagaggaaagagatcagaatccaaggatttggacgtgggcaactcgcagaaggaaactgtcattttctgaagtgagaaagagtatttaggactggagggaatgaagtgaacctgttagatttgagaagttggacttcccatgtggtggtatcgcctcggcagtaggacctatgattctagagttctggggagaggggagaggcttttgccttgatgaaagaacaacttcagccaaattaaatttaaaggagtttaaatgagcaatgaacgattcatgaatccggcagccctctgagccacagtgcactcagagactccagcacagccacgtggtggaagaagatttagggacagaaaaaggaaagcgacgtacagaaaacagaagtgaggtacagaagcagctggattggttacagctcggcgttcgcctaatttgaacacaatttgaacagttggctacatctgattggccaaaacttggtgattggcacaagtgcaggctacggtctgtttacacctccacttgttattgttcatgacgtacagaaaaatatgtaggccgaacttaaaagatgtaaggaggagctttaggcaaaacttgatttaaacagcctgcaggtgggcttcccacagatctctacaggcccctgtgatgagtgctgggagtgatgggggcggaaggcacttctgcggaggtgctgagtgagctgcggccccaatagctgggaaggaggcaacctgggcaaggggggaagggtgtgggggggctgtccaggcagagggcacagcaagtgccaagggccctgggtgcccctgctgtgcccgcttgttgggatagactcccctccttctttctttctgagcactcagaccttcctgaggactcagctctactttcttgttttccatctttaccctggaatctgcacatcttccctgagtcgccgcccatccttgagtgttggatccagtagttgttcgcgcctcagctcctcctcctatttaggactctcccacaccagccttgtcatcctggggttttcctgtccctgtgaattcacataaatcccttaaatctgcctggctcttgggcgagattatgcgaatctccagttgtgtggtatttttagcacgtcttatttgtctgcttgcataagctccgggcgctcatttctcaacaattccttacaggcataaactgccagctctcagacccttccagcaccaagccaggtaccttgttgaaaaccagcccctcaccagagcgatcgctattgctgaaatgtaagacccccgggagtggggatagggtggagacggtggagatggtgggatgttgggtggaggaggatcatggaaatggaggtccctctttttttctcattagaatttatttatttatttattttaagaacttgttttttaaaaaatgtttattattaaaggcaataaaacaatacatgttcattgtagaaaaattagaaaatgaaagaaaaaagttactcataatccctcttctgtgaataactgctattattatttgtccttttagcttttttagcacatctaatatgcatataatgatatatttaatatatctttttatgttacaaacgtggtgtcatactatacatactgttttgtcatctgttttcatttactgatatattatgaacatatatatatttgggatttatacagtgagccactgtgcccagctaatattatcactatgtgtgtgtgtgtgtgtgaccgagtcttgctctggagtgcagtggtgcagtcatggctcactgcagcctcgacctcttgggcacaaatgattttcccacctcagcctccctcatagctgggactatcagtgtgtgccaccatgcccagctaattttttatttttatcattgtttttagaggttgcatggcattgcattgaatggatgtgtcatatttagccaatctcataatgttggatgtttacattttcatttctaaaacaatgctgtaataaacatccattcttgtacacatttgttgaattgaattaatgaatgagagaatgaacacaccatacctcattttcagattattttttaggagtaatttctcaagtggaattactgggtgtcaacctaaaaaagactcaatctaaagaaggctcagtatccagttagcagagtttattcaagtgcaaagtaaccatcaggagacagagggaaaccaaagaatggtgatcactgcccctggtgttgggagggggacagtgaatatcaaaacagaggcactgaataaatttacattttccatacaaaggctaacatactgatttaaaggccgagcacggtggctcacacctgtaatcccagcactttgggaacccaaggcaggtggatcacttgaggtcagcagttcgagaccagcctgcacaacatggtgaaaccctgtctccactaaaaatacaaaaattagctgggcatggtggcatgcaccagtagtcctagctgctcaggagactgaggcaggagaatcgcttgaacccgggaggcgaaggttgcagtgagccgaggtcgcactactgcactccagcctggcaacagagcaagactccgtcttaaaaaaaaaaaaaaaaaaaaaagtgcacaaatcaaaaatgtgcagatcaatcagctcaatgattttttaaaaaggaaacatattttgtaaccaccttcagatcaagaaatggaaatttccactccccagaagtcttcctcatgtgccttcttgtttactatccccaaaggggatccactctccagacttctaggactataggttagttttacctgtttttgaactttcagtagatcattcacactatacccttctgtgttttgcttctttcactcaatatgagatttatccatttttgtatattgacatactgagtggctgttataaattcacttagtacttctaagctatctacagattatttgggtttttgtgtaaataagcatgtcacctatgaataataatctttcatttccccgatctttattctttcctttcacttctttttcgtgccttgagttactgtctactacatttagaacattgttgaatagaagtggttataatgagcagcattttctcccaccttagacatatatccaacagaaatgcatacatatgtgaatcaaaagacctgcacaagaatgttatgtgaccgaaacacaggttcagttgctcaacgctttgcagagttcaattaacaagagcgaggtctggtataaagaaagtggttttattctaaagattagcttaggggaagaggtacaggctcctcctgcccttaacggtaccgcctcacttttggggcagaaagcagaggcttttaaatggggactttgtatgaatggcatgcagggaaggagcaagcagatgggggtctatatgactcattttgatgcgttttctaccaagtggttgagctggtgccattgagggcagaactaggttgtaatgtggccgttgtcttgagatgctgtccgggtggaagagttctgttgaaggcatactttatgttgtaaattgactgttgtctcttaaggcaatctcctggtgggagaaagttctggttctagaccctctaagtaggtagataagtttgccctgtagggactatctggtgaagggaaggtaatggttataattacatttctaaagagctaagtagaggcagggcacagtggctcacacctgtaaccacagcactttgggaggctgaggcaggcggatcaccggaggtcaggagatcaagaccagcctggccaacatgatgaaaccctgtctctactgaaaatacaaaaattagccaggcgtggtggcaggtgcctgtaatcctagttactagggagccttaggtaggagaatcgcttgaacccaggaggccgaggttgcagtgagtcgagatcacaccactgcactccagcccgggcaacaagagtgaaactccatcttaaaaaaaataaaaataaagagctaagtaggaagtgggagacaggagaaaaagggggaaaatcttaaaaataattcattctctttctcttagaaaaatgctctttttcttagaaaactcagtctctgttacacgtttacagttatagcaacattagtcacaataggcaacacggaaacaatccaaatgtccatggaaaactgtttggccttgtttatgaaagctgaatatccacataccctgtgatccagacttaaaaaacaacaacaacaacaacaaaaaaaacttcatgtgtacatacatggtgtaatgcaaagagaaatgttaatgagagtttaaatcactacaaactttggggaggatagttttgcaatatgtatcaaagaccttaaaaaaatacccattgacccagcaattcctgttttaggagtatattctacagaagcaatcagatacgtaaaaatgtaattgtattagtggtttcaaaagctttttaaacggaggactaagttatgcgtccaaacatcaaaattttagaatctccactaaaatgctcttgtgaaaggatattatgatgtgtcaaaatgcctcacaagtagatcaatcaattttaaaaagcagattacctaacgtcatgtatggtgtgacaccaatattaagaaaagctataaaaattagccgggcgtggtggtgggcgcctgtagtcccagctactcgggaggctgaggcaggagaatggcctgaacctgggaggcggagcttgcagtgagcggagatcgcgccactgcactccagcctgggcaacagagcgagactccgtttcaaaaaaagaaaaaaaagaaaaagaaaagctataaagcagcaaggggaggggaaagataggaagtacacacaccctaatgttaacagtgataggattagttttaattaaatttgtattaattggcaacaaatttcacggcacaaaatacagacagtataagggatgtgcagcagagtgatctcttcttcccctttccccaagaccccgccccaggggcagtcgcggtttaaaggggtctgtcaccccttccttgggccatttccgcgcttcgcattttgtgatttgcacgtgcgttggtgggttcccgggggcggggcgccgcgctggccccgcccaccaggtgcgtcccttgtctcgccccctgcagacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttacactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggggtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccctactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtcccttttaaccatggtcttcactgggagttcatgttgcttcaagtccctagcacccagtgatacccccacaggtaagccctcagcatcctgaatacatcatccgcagcctgggaaccttctccctcgtacagcacaggaacctgacacatagtaggcacacagtaaacatttgtgaatgaatgggagtcatccagtcctgactcttctgtctcttgaggtcccttgaatcttccgcttcctccccaccgatttcagcgtgtccacatcacagctccctccagttcatgttgcttcaagtccctagcacccagacccagaagggcctttactcatatcttattccttacgcagccttctggtagtagtcagctgctccctgattaactatctccagggatggggcattcactgcttctgaagataactcattaaagttctcacttacgtgtaaacaaaccctgactcccacctgttcccatccaagatcgtattatagcttgaactcctggtctcaagcaatcctcccacctcagcctcctaagtagttgggattacaggctcacacaagcacgcctggctcacataccaccttctaacatattgtgtgactgaatcactatgctatggatttttatgcatctgcccccatctgaatggaagttctctgaggaagggattggggcttgttcatggccatatactctgtgcctaaagcagtgcctggcacaaagatggccctcaatatttgttcagagaaggaacacatgccatttccctctctttgctctgaaaggagtgctttcagcattttctgcctacaagatcctttgaccagtcctttctctgatgtggagtgactgctatacaatgccaactaaacacagaggccaagggcaggaaagggataaagacaatggagaagtaaagggctgtaaggaagtgagaatgaaggcttaaaggaaaggacatgtgcagccagctctcacccctctctgcagccacccagcaactggaggatatggactttgtttggaaccaccccttcttctggtgctctgtttataatgcactgttggccagtgcactaagctggccaacttgaaggagagattgcatcactggatctttttctgtctccagtgggctgacacagggcctagcccagaaacatctgctgtctaaggagcaggtggaggtggatgacagccaggtccctggagaccgccattcctgccctcgcctcactcaaacacacctgacagcatcagcaagggaactgagaattcagagaatggcactttatttttaagacttgatttttttgccatgattatctaccaattcttccatgatggtgtcatcctcttcaacagtgaccaggaccttcttgcccactagattaaagatgtcttcaggaggatagcctttgggctcacccaccttcacggtgagcatgtccattgttagaatggtgccttccggaattttcactttggccaccacagacttgcccagctgtggacaaaatgaacattcagtgccagcttcacagaagtaactagtgcacactactttactttacactcaaggtccctgatcagtcttccccaggcagtaccttgggagcaggcactctgttgccccctacactgctcagaatatctcatacatggcaggaattcaaccagtatagattgaattcagagactcagaggaggagcctttacaacaaagtgcaaaggaaagggctgaggctatgtaggcggagccaggttcaaatcccagtctgtggggtataggccacgttttagtttctctgtcaaatggaaacttatcctgtcagatgactgtaaggattggtgatattacagaatgtacgtggaacatagaatgctctcaatacatgcaaactctgattcttttggttaccattcagctcagtatctcattgtaaacatggggaaactgaggcccatacagggtgggtgacttggccagggttgcagacagccaagatgaaacataacatagggatgagattcttaactcctgacacaccgttctccagggcacacaccttaccgccactttgtttggtaaaatagaaatatgaaggactcataagatggtgaatgtggctgttatgcagatggcaagaaaaggagcccccgaggaaggggcagataatacaggcagatgagggaatgaagggtacctgaagctcatgaccagtgtttgtcttctctataaatgctttcaaataaattacgtgttttattactctatatcctccacgtaagagtacaaggaatcaattctgcttggaatgtggtgccaggaaaaaatgtcaagtgataatcatgcatcctgttatgttttactgtctgctcagagagccaaattaagtgctcagctgttataaatcttactctggtttctggtctaattctctcctgtttcctctataaagaaactatttctttttactttattttaatttcctggtatagatgcatctttgatttggggaagcaggtaggccccactagaataaaaggtgacaacagtcccaggcatgcctggtgtttggtctttgccttgaccccgacagcctacaggttaggtgtgtgtgtgcctggcagccccaggatgcctgcctggctctatgactcagaaggcaagaaggtccaggccacggcttccaggaagccctgatagtcagcatgccaggcagtgcttctaggcccaccagttcctctgtctgaaggtcactgttgcacaaggaatagctgcatcatcacccacccacctctgcaacgactcactgcccttcccaccagtgccaccctggcttaggaaatgccacaggctcttctggtacctcagggaacaccgtgcctaaatgtttctcagggcttacctgctccaagggagcccagacttgacttattccagggcctcactcctgttacatattctggagtctaggagtactggggccatgggcttcagagaattagtggaagactctaatgtgaccctaggtggccagagaaactgctaaagttagataacatgtgtctcctgctgctgctacaggccagagtgacatgcattactgaagagaagcctgaagaagctgacacgggtgggagcacattcactgatcatttcatcagcctggctcagggagggctggtcctgaccatccctctcaggccagcctatcctttttccacacacggcagcagaaccgagtagagtccggcaggacacaccttctcattgcaggccatctcacagggcagcagctgcttggttggggagcccagggcacgctccacaagacgcactgaccgcaccagctcggccagttctccaggctccagcgaggccgagtggtcactccccttccaggtcttgtccaaagttatgtgacgttccaacaccttggcccccagagccactgcggccacagatatcgctatgcctgtttcatgcccagaataccctatgggaatgtcaggaaagagcttctgatattcctttaaaatggaaaaagaaaaataacattaaatatcatgctgctttatgcatattctccaggtgaagcgtatctggttgagccccggtttagccactcactagctgtgcagccaggggcaagatactgaggctctctgagcctctctttcctagggatgataataatacctgctgagtgttgctgtaaatgcatgagaagcactcagcacattgtaaatgctctaaaaatggttactgttattctaaagaatgcattttaagaatgtttcacattgcacaatacaccaagagtaacaacagaactataaatgaatgtctaacctcattcaaaaaccatctgtcacatttaattagcctgagctgctgaaagcaagtgtgctatatgcacaaatatcatcaataatatacacagcccaatctcaaaacaatcctttggtgaaaatgataaataattaatccgttatctataattcactgaatgcaacaaaagacactctaagatgggtgagtcttgttggtgagggtgaccagaaagctgagtacagtagaaagactcaggtagcgtgtattattattttattgttatttattatttctttttgaaacagagtcttgctctgtcaccaaggctggagtgcaatggcgtgatctcagctcactgcaacctctgcctcctgggttcaagcgattctcctgcctcagcctcctgagcagctgggactatgggtgcccgccaccacgcccagctaatttttgtatttttagtagagacagggtttcgccacattggccaggctggtctcaagctcctggcctcaagcggtccacctgcctcagcctcccaaagtgctgggactactggcatgagccacggtgtctggcctcaggtgggatttaacaaaagattaggagggttaggtggcaaaggccttgaaaaccaggcttaagggtgtgtgatggagtgcgggttgctacaagtttgaaaattcaaaccactgtactatgtgcaggcccaagatgggataggctggcagaataactcctgcaatgtgtagtgtcaagagagaggacatgacagcaccttgagtggggacggagatacactgaaaaggaaaatagctggggtcacgtctactaaactgttaattatcggaatctctgtgggatgggagtgcaggggatgtttactttcgacattacatatttcacagaaatcatttttaaattttaaaaataacgtgatttagataagctgtaagtgaagcaaaaacaggattgggagggacagaaagtttaggtaaaaagagagtaatgtcagttttcaaaaaggctaactttttaagttaatggctgtataacaacatgtaagaaagcttatattatggggaaaacaatgtcaaatactatactgaaaggaaaatataaaaggaaaacaactgcaatatcaggattctagtatgtgtggatagatagatagaattccattaatgttactataatagttttaatgataattacatacatattttcgaataaagttaaatttccagtgctacaggaagaactgagagagatggcgtgagacagtaagagacaaaggcctagggggacatgcccaggttctagttccagctttgccaccaagctgctgtgggatctcaggcttcccgacttgggactggatttcaccatctgtgaaatgactgagtaggcaaaatcgtgggagagagtaatttccatcaaggctgtcactataactagtatgagcctcagggatgctcagcattagaaaataagagagtcagcaaataaagcagaaaaagccaggaagtttcaagaaggcctcctataactcagtatgaaaaaagatgaatatttatctgtacgctagtgttcatagcagcatcattcacaatagccaaaaggtaaaatcatcccaaatgtctgttgacagacagacttttttttttttttttttccccctgagagtctcactctgtcacccaggcttgagtgcagtggtgcaatctcggctcactgcaacctctgcctcctgaattcaagcgattctcctgcctcagcctcctgagtagctgggaccacaggcacgcatcaccatgcctgactaatttttatatttttaataagaaggggtttcaccatgttggccaggctagtctcgaactcctgacctcaggtgatctgcccacctcgacctcccaaagtgctgggattacaggcatgacccaccgcgcctggccaagaaaatttcatttacagtcaccctctttagaatgtatgtgcttcctcaactgcttagctcgaatttgatttggtaacagcaagactgtcaaaggatgttcaaattataaagtatgccatgtttgttagaattttggttataaaaaagactacgccttccccatagtaaatggcccaagaagggaaccccctccctcctgctcaccgagatgacccgcaggttgacgtcctcaggctggagcgggtatgcgctggtacactgcaagaagcagaagttggggttgaggggcttcacgatctgataaacttgcttcatggtgtccattgactgcatcccactggagatcaccattgggcgacctgagtaatccagcaccaacaccatcagcactttctctttagaggttctgactctccccaacacatcccaactgctggtctcatcattcaactgaactccacagacatctcttaaaacactgtgccagcccctgtgggggaacagagaggagcttgttgggttcctgccctcggccacaggaaaggtgggctcccctctgccccccgacagtgttcttgagcaaaaggaactgaattaaagaggcagaggaatttcacactgccaagaggaaaatgagtatcttatctgattaataggttgtataccatggcagtacagtagaatgagtgctgattcaagagtgtgaatgaatgtgaggtgtggagctgccacttctagctgtgcctgggcagagtactgtccgtctctgagtctcagaggcctcccctgtgaaataagtatcaagcatcataatcatgacctgtttcagtcctaggagtgttatgaggatcaaatgaaattgttcatgttgtaaaaccactttacacgatcatgtcccactgcggtctcaaactcaagcaatcctcctacctcagcctcccgagtagctggggccacagtaatgcaccaccatacccagctaggttttatatatactgtcatatccttaatttcttataaattttagttaaaaaattttctaggacaggtgcagtggctcacacctgtaatcccaacactttgggaggctgaagtaggaggatcacttgaatccaggagttcaagaccaacctgggcaacatagacagaccttgtctctattaaaaaaaaaaaaaaattcttaaaaagaatttctaaatgtcttataaaaactgtcatattcttaattcattttctttcaaattagcttacaaaaaatggaagtacaggctgattgaaaagaggtttctggcagggcacagtggctcatgcctgtaatcctagcactttgggaggtcgagatgggaggattgctttaggccaggagttcaagaccaacctggccaacacagcgagaccctatctctatttaaaaaaatgaaaagaggctaaaatttgtcttcatgaaatctgctgaaagtgggccaccatgaggggagtaaaaatatgaaggtttggactcccttcgattttaagtcaaaaattagacacttaccttttttggctgtcttttccagataaggaaaattattagtgtctccagatccaactttgaaaaatggaacattcagttcatgcaggaattcaactgccatctacaaaaatcaaagagggagctccttttcaccattgtccaaaaacactgttgttatgacaggcaaggaataacatacaagtagaaaaacccctcatcttaggcagtagagggacgctcagcaacttgaaagcaggcaaagatttgttctcagtcatttcattcaaatgcaaacattcatttgcatccacccatccattagcccaacaaacgtttggtgctggtctttgctggctacaggaatctggaaaagggctgggcgtggtggctcatgcctgcactttgggaggccgaggcgggcagatcacctgaggtcaggagtttgagactagcctgaccaacatggtgaaaccccgtctctactaaaaatataaaaattagccgggtgtggtggcgggcacctgtgatcccagctactcagaaggctgaggcaggagaatcacttgaacctgggaggcggaggttgcagtgagctgagatcatgccactgcactccagcctgggccacagagcgagactccatctcaaaaaaaaaaaagaatctggaaaagaacctttcccctggccagaccctacctgccccaggggcccaaggccaaatgaacaaacatgaaacggtcatgacctaatcctgacccagaaaaccaggcagtgaaaacatgaatagcctcaaaggctttcccttctactcggccaaacgagcaggaaaaggggctatttcaattcttggcgaaagggggaaaatggagcatttttttgcccagcctctacataaggatccatggctggcagggcccattcaacccgagccctttcaggcctcaaagcacgctgcctacttaaaagtgaacctcagtcacttttttcagatataacgtcactgcttgaggttacctatttagtgctcttcaacatccttctctagtattcatcaacaagactcaggaaattggtaaatgtcagcaaatgcttgctgaaggaatcagtggatcacaagttataagagtaaaatctcagtttgctgtcaaattataagaactcaaaaactttttattatcatttctttccagcttcagtaaggtgtaattgatatactaaaaactgcacataatgtaatttggtgagttgggacttaagtatacactactgctaccatcagcacaagagtaataaacatacacatcaccttcaaaagttttcttgagtccctttgttttgttttgaagttggaaatcaaaagtcgaaaaaatcaatgtctctgaatggtgactcagaaataagttagggcttagtgagttgctcacacttgatcacatgggcacaaatctttccctctcccagggaagttgctgaaatgaaatgcaaactctgattggtctaggaccgacggaccgacggaccaaccaacctacctcccttcctgtctccttccctccctcccttccttcctccctccctccctttcctccctttccttcctccctttccttccctccctctctccctttccttcctccctccctcccaccgtttccttcctttcctcccttccttcacctttctcactgctcttcctctgctttatttttaactcttctcttttccccttccatctttttcttttcttttgtggtagagacggggtcttgctatgttgcccagactggtctcaaactcctggggtcaagcaatcctcctgcctcagtctcccaagtagctgggaccacaagcacgtgccaccacatgtggctaatttttttttttttttaatttgctgtggagatggggtcttgctatgttgcccgggctgttctcaaactcctgacctcaagcagttgtcccaccctggcctcccacagtgctggggttgcaagcttcagctgccatgcccagtaccttccatacctttccacctcactccttcctgtttgtgtctcataacactgctaactagccctaagacagaactgaaaaaacatcagttttaaatatattttttcaataaaatctaattttcctacccttctcacttcatttggcagatgaagagagtgctttctgtttaaagaaggaaccttccactgagttttcttttgtataatgttcatcttgtgggagtgtggtgtggcccaccagggcataaacagaagcagaaacccccccaagagaggggcagagcgatcggggcaaggaggggggacaagtgcagaaaaacaccttgtgaaagcttacctacagaggctgtaaaatctgcatggaattctgtaattttcaagtaaagaaaaaggccaattcctgctggaaagggaaggggcgcctcattttgccgcctcctggggagccagcgccacccagtggacatttagaaaactgccactcagagccatcgggcaaagggaatctgagtaatctggaagatcctaactttcagccctaagacagtatcgctgtgcctaggggctactacaggctgggtcagcaactggtgacccctttctcttcagggactccttgacttcccctagcctgccgaccgtgctatcgggttccctctatctggggttccatgcagcccggcagcctcagcactcctctctccctcctgccccatagcacaaagtctgtgggagtctgaagggagctcaggcatgtacaactctcctcgggctcccagctgagttcaacatgcagaaatgggtcccatggatagcctcgtttgggagaaacactaccctgccttaatgccttcttagagggtcccagtaaatcaacttagctgagttccaaacccagtgtttcccaaacttattcgactcagaactttattaattctggccaggcatggtagcccatgcctgtaatcccagcactttgggaggccaaggcaggaggatcattttagcccaggagtttgacaccagcctaggcaacatggcgaaatcccgtttctacaaaacatataaaaattagccgggtgtgtggtgtgtgcctgcagtcccagctactcaggaggctgaagtgggaggattgcttgaacccaggaggttgaggctgcactgagctgaggtcgtgtcactgcactccagcctgggtgacaaaacaaaaaataaaccaaaaaaccctttattgattctaaatcaattaatgaatgagggtggacaacacgtgcccacagaaccccatttctgtactgtgtcctgtgggacactctgggaactgctgatctgagtcaggggtaaggaaagagaggagtggagctgagatttttctaaagtcccttcctctcccctcaggttttggatccttcaggattggaaaaaaaaaaaaagaagcccaggccaggcgcggtggctcacgcctgtaatcccagcactttgggaggccgtggcgggcagatcacgaggtcaggagtttgacaccagcctggccaacatggtgaaaccccgcctctactaaaaatacaaaaattagcccggcgtgttggtgtgtgtctgtaatcccagctactcgggaggctaaggcaggacaattacttgaacctgggaggtggaggttgcagtgagccaagagcatgccattgcactccagcctgggtgacagagcaagactccgtctcaaaaaaaaaaaaaaaaaaaaaaaaaaaaaaagcccatggtgatgagctggggagaacagggagtcaggggaagggtgtagccacaaataggctgggccagcctcagggcagcagcctgtcagagggcaccgtgcctaggacagaggcaggtgctggagggaagggcggctttgctgggatggccactgtgtgtgaggagagcatgtccctcaggagtcacctttttggtcatggcttccatttgccttctcaatagaactttccttttagactaaagacattctgctgtttcacctgagttccacagccttggtgcaactttcaaccagaagccctgacggttttcttggccttaataaaattctgccacaccttaacctttcctcagcacacagagaacgccctagaacagcatacagtgtggagaaaatatgcattcaataaatgcctgtttctataaggaagttagggtaggtaaacactgggagccacttgctaggtaaatacagaacaaggaaccaatctacctccaacagtttgacagagggcaaggtaaattaactctcgtaaaggctcttaaagaatgcactttcctgccgggcacggtggctcccgcctataatcccagcactttgggaggccgaggtgggtggatcatgaggtcaggagttcaagaccaccctggccaacatggtgaaactctgtctctactaaaaatacaaaaattagctgggcatggtagcgggcacctgtagtcccagctactcgggaggctgaggcagagaactgcttgaacccgtgaggtggaggttgcagtgagcagagattgcgcaactgcactccagcttgggcgacacagcgagactccgtctcaaaaaaaaaaaaaaaatgcactttccctcactgcctgtgccctaggtcaggcaggggactagctggggacaaaaggcattcctcatccagaggaacctacctgcccaaataggctgaggcagaaaaactccaaagggttctgagtcacagaacagccatcgctgggtgagtgtagacctggccctgtgctggcaccccacgggtttagctccctgaatcctccagatagccccaggagcatcttaacaatcctgtttttacagacgggggccactgcggctccaaggttacatgaggagcccaagccacacagagtgtgagcaccaggagctgagctcagagagcctgactctaaaacacccatcacagacaccaagcaaatgggctgcctggggagcagagggaaggaaaaccaaggaggaagccccgctgcaaacaccagactcctccctatcacccaactgctccgggttctcaaccgatgccacctgcagggcacggcctaaagaagtgactccgccttggcagcctcacgggcaaggaggcacctttctcctaggtcagatccaggagctcagggagcttgcatttccaggaaacgtggacggaagcagaaaagtccccaatccaggtgcaagtcaccttgatgacatcttccctggttctgcgctgactcaggacatcagaatagagagaaccactggatggtagcttggtcacacacggaaaatgaaatggtggcccaggcagggaaggggctcaccaaggtcacactgagagttaaggacaaagccaggacaagtacccagatgtcccagcctgcaagtacccagatgtcctagcccttagcccaggttgctttccttaattgtaactgatattcactgaatactgattgtgtactatgctttatattaacgatcacatttaatcttcactttccctcccagatgggttctgctaggaagcccactttacaactgaagaaaacaggcacaaaaaggttaaataacctccacatggatataccaaaaataacaggcagagccatattcaaacttaaaatctgaccctagagtccattcacttggccactgggccatatagcccgggtatgggccacacagcagggtgtgtaccacagagctggggtgtgcatcatacagtcgggggtatgtaccatacagctgaggtgtgtaccatacagtcgtgccatcatatagccaggtacacaccacacagctggggtatgtgtatacagcattcagcatggagtcccaaatgttttcatcttcaaattcttaaaaattactaaggaggccaagtgcagtggctcacacctgtaatcctagcactttgggaggccgaggtgggagactgtttgaggcccagagtttaagaccagcctgggcaacatagggagaccccatctctacaaaaaaatttagaaattagctggttgtggtggcatggacctgtagtcccagctactaagaaggctgaggtgggaggatcgcttgagcctgggccgtcaaggctgcggtgagctatgagctatgattgtgctgctactctccagcctgggcaacagagtgagaccctgtctcaaaaaaaaaaaaaaattactaaagagtctgcagatcttttttatttttattttttgatgtggttttatttattcgtatttgctgaattaaaaattaaaattgtgaccaggcgcgatggctcatgcctgtaatcccagcactttgggaggacaaggtgggcggatcacctgaggtcgggagtttgagaccagcctggccaaatggtaaaacctcatctctactaaaaatacaaaaattagtcgggtgtggtggcgggtacctataatcctagctactcaggaggctgaggcacaagaatctcttgaacccaggaggcagaagttgcagtgagccaagatcacgccattgcactccggcctggccaacagagtgaaataaataaataaaataaaaatttaaaatgaaagctgggcacggtggctcacacctgcaatcccagcactttgggaggctgaggcaggcagatcacctgaggtcaggagttcaagaccagcctggtcaacatggtgaaaccccgtctctactaaaaatacaaaaattagctgggcatggtggcatacacctgtagtcccagctacttgggaggctgaagcaggagaactgcttgaacctgggaggcgaaggttacagtgagccacaatcgtgccactgcactccagcctgcgtgacagcaagactctgtctcaaaaaataaaatataaaataaaatagaggaatcttttcttaattttaaactttgaattttgagataatggtagattcaggtgcaactgtaagaaagaacacagagagatactatatactcttcccccagtttcccccaatggtaatgtcttgtaaaactatagtacaataccacaactgggtgaatgacattgacaaagtcaaccaatcttattcagatttcaccatttctacaagtattcatttctgtgtgcctatatttaattatatgcaattttaccccatgcacagactcatgtgagcactgccacggtcaccatacagaaggtaccatgatgccactgctacaaggatctttcatgtcacccctttataaccacatccccttccccttactaacctttggcaactactcatctgttctccactgtcataattctgttatttccagaatgtcatggaagcagaatcgtacagtatgttcccttctgcatatgctgctttctcactcagcatcatttccttgagatgcatccaggctgctgcacgcatcaatagttcattcctggctgggcgcggtggctcacgcctgtaatcccagcgctttgggaggccgatgtgggtggatcacaaggtcaggagtttgagactagcctggccaagatggtgaaaccccatctctgcaaaaaatacaaaaattagccgggcaccatggcatgtgcctgtaatccctgctactcaggaggctgaggaaggagaatcacttgaacccgggcagcggaggttgcagtgagccgagatcacaccactgcactccagcctgggcaatagagtgagactccgtttc

SEQ ID NO: 36349 - DNA, 33620 bp, Homo sapiens
ggtggagtcacggctcgcgactggcctaagtcgccgcaggtattgcagtccggggctggagggtaggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtgagatttatccattcatctctcaatctattttctttcttcattcactagccactcccccacttctactccatgccaggtccattggtaggttctcggaatggatctgacaggcccagccctctaggaacttagtctagtggaatttaatctagaatctagtctagaagccttaaatagataaacattccaaatgattcctgcaatggtgatggctaataccttcagagcccagtgggtggaagaaggaagtaacttggatgtgggtggaagagaaaagggcaaatcagggaaggtttcaccagggaagggacttttgaactgggctttgaaggttaactaggagtttgcaaatttcccagaagggaagcgacattccaaataggggaagcagaacaggctgcaaaattatgaaaaggcctgccatattacaagaacagcaaaaaaaccaataatgcaagagattgtggaggtgagttcacgggaaaaaagctcaacagcagaaggccttactttctatgctatgttgaggccaagatttatcccagagctcagtatttctcagcttctttaaatattttgtcctttgagcggagagcagtggctcacacctgtaatcccagctttttaggaggctgaggtggaagaattgcctgaggctaggagttcgagaccagcctggacaacaaagcgaaacctccatttctatttttttttctttttttgaggaggagtcttgctctgtcgccaggctggagtgcaagtggcgcaatttcggctcactgcaacctccgcctcttgggttcaagcaattctcacgcctcagcctcctgagtagctgggactacaggcgtgggccacaacgcccagctaattttttttgtatttttagtaaagacagggtttcaccatgttggccaggatggtatcgatctgacctcatgatccgcctgcctcggcctcccaaagtgctgggattacaggcgtgagccactgctcccagccccgtttctatttttaattaaaaaataaataaatggccgggctcagtggctcacgcctgtaatcccagcactttgggaggccgaggcgagccaagttcaagaccagcctggcgaacatagtgaaaccccatccctacgaaaaatacaaaaaaaattagccaggtgtggtggcacttgcctgtagtcccagcttactctggaggctgaggcaggagaatagcttgaacccgggaggcagaggttgcagtgagctgagatcctgccactgcactccagcctgggtgacagagtgagactccatctcagaaaaaataaaaataaaaaataaagccaggcacggtggctcatgcctgtaatcccagcactttgggaggctgaggcgggcaaatcacctgaggtcaggagttagtgaccagcctggccagtgtggtaaaaccccgtctctactagaaaagctagaaaaatgagctgggcgtgggtgggcacctgtaatctcagctactcaggaggctgagaaaggagaatcatttaaacctgggaggggaaggttgcagtgagtggagattgcaccactgcactccaacctgtgcaacagagtgagactctatctaaaaataataataaagataaatacataggccaggcacggtggctcacacctgtaatcccagcactttgggaggctgaggcgggtggatcagctgaggtcaggagttcgagaccagcctgaccaacatggtgaaactccatctctactaaaaatagaaaaattagctgggcgtagtggcacatgcctgtaatccaagctactcgggaggctgagggaggagaatcgtttgaacctgggaggcagaggttgccatgagctgagatcttgccattgcactccagcctgggcaacgagagctaaactccatctcaaataaataaataaataaataaataataaaaataaagatgaaaagttggtgattcttattcaaatcaatcaggcctagaaattagtacattcaacaggaaaggtttaaaaaggaggttgaattgattaagatgataatcataagtgtctaaaaagtgcctttctttcttatgcataggacaccatgaagcaactgccagtcttggaacctggagacaagcccaggaaagcaacatggtctgtaaggaaggatccagacacagaaaagcatgagtttttgtttcatttataagtagtttatttacatatttgatcatcaacaaaaaggggtagagatgaaactgtctgcagtttctggtaattagactcaaactgtctgagaaagtcttcagaggaaagataggggggcagtaattatcacagagcagatgttaattttattaaaatccatttaccagaaagagtaaggcactgaccatctggcatcctcagctccaatgctgtgtcttcccccgagctctgactcatttttaagatttttaggaaattagatttggattaaactggcttcactgtttcttggctgtttgttcaaacaaccctttattcaacaactaacattggcctgatgggggcagctgctctgtgggtgctggaggtagaattgtaaatagtctctgtgtactggggactacagactaagcaggtgatggtgataaaatgtgatctgctctgagtcagggcccacagaaggttgtagagaggtggcagttcttcaacaggaccttgaaggagagactccagactggcttccatgcatctgtcttgctctgtacccagaatacagccaatcatggcatttcctagtttaaaacccttttgtgcctccctgttggtgttgggataaaaatcagactcctgggctgggcacggtggctcatgcctgtaatcccagcactttgggaggccaaggcgggtggatctcctgaggtcaggagtttgagaccagcctgaccaatatggtgaaaccccatctctactaaaaatacaaaaattagctggcatggtgttgtgcaactgtagtcccagctactagggaggctaagacaggagaattgcttgaatctgggaggcagaggttgcagtgagctgagatcatgccactgtactccagcatgggccacagagcaagaatccgtttcaaaaaaaaaaaaaaaaaaaaaggccgggcacggtggctcatgcctgtaatcccagcactttgggaggccgaggtgggcggatcacgaggtcaggagatcgagaccactctggctaacatggtgaaaccctgtctctactaaaaatacaaaaaattagccgggcgtggtggcgggcatctgtagtcccagctactctggaggctgaggcactccagcctgggcgacagagcgagactccatctcaaaaaaaaagaaaaatcagactcctgaccgggcgcaatagctcatgcctataatcctagcactttgggaggctgaggtgggtggatcacttgaagccaggagtttgagaccagtctggccaacatggcaaaaccccgtctctactaaaaatacaaaaattaaccgggagtggtggtgcatgcctgtaatcctggccactcgggaggctgaggcaggacaattcttgaacctgggaggtggaggttgcagcaagccgagatggtgccactgcactccagcctgggcgcaacagagggagactccgtctcaaacaaacaaacaaacaaattagacttcttaaactggcccaatggtccctgcaaaatgtttctgcctgtatttccaacctcaaatcccatgacttgttcctttgttctctttctcttctttattgtgccctttgcactgttccactcaggagctgttcatgctggtctctttgcctggactgctctttctgcctggagtgctctttccctccactttttgtccctctcttttcccagcttattttattttatttttgagacaagttcttcctctgtggctggccacccaggctggaatgcggtggtacaattgtggctcattatagcctcgacctcctggcctcaagtaaccttcccatctccatctcccaagtaactgggactgttggtgtgtactaccatgcccagctaatttttttttttagagacccagtctcgctatgttgcccaggctggtctcaaactcctgggctcaggcgatcctcccactctagcctcccaaagtgctgagattacaggtgtgagccaccacacctggcctacccagctaatttctactcatacttcagatctctctccaaatggtgcttcttcaggaagccttctctgaccaccctatctccctggctccttacagggtgagaccctcctaagacatgcatgtcctcatactatatattctgtactcctttctaccacaattgaagtgaaacagatagttgtgaaactgttgaatgtttcttttcccaactagtctgtaagggctatcaaggcagggacttttttttgttatatccaccatctctggatggctgtgtgcttttggtaaattacttaacctttcttagcttcagttcctccgttgtagaactcagatgatggtaacagctgttatcctcaaagcgtttttttagtttttgtttgtctttgaaacggagtctcactctgttggcaggttggagtgcagtggcacaatctcggctcactgcaacttccgcctcccgggttcaagcgatcctgcctcagcctcccaagtagctgggactataggtgcatgccaccacacccaggtaatttttgtatttttagtagagacggggtttcatcatgttgcccaggatggtctcaatctcttgacctcatgatctgcctgcctcggcctcccaatgtgctgggattacaggcgtgagccactgcgcccggccctcaaaggggttttatgtagattaagtgacatcagaatagagctctgaatgggaaacaaatttggcaaccactgatgaatatatagatgagtgataattgaagttatcactacagataacattaatcaggtaagcaaatgtaaagtgaggaaaagagaattgagaatgacggagagtcaggaggtggctggtaggaaaggagtcggagaaggaagcagaaaggacaaccagaaaagtgagtgcagaaccaaaggaagggatgtgggaaagcctggctgggagaaaggcacaagaagcgaggagaggtcaggagtctcaaacaccagagaggtcaaataagacagggcctgaaaaacagctacagaattttcttttccaatcaggaagcttcaagtgtgttttctcagtcagcattcagaatcactgtggagagtggaatgggctgggcgtggtgggcgcgtccctagcacttagggagaccagggcagaaggattgcttgaggctgggagttcaaggctggccaacatagtgaaaccccatctctactaaaaatacaaaaattagccaggcatggtggtgcgcgcctgtagtcccagctactcgggaggctgaggcaggagaatcacttgaagcctggaagtggaggttatggtgagccaagattgcaccactgcactccagcctgggcaacagagcgagactccgtctcaaaaaaaaaaaagagagagagagatagtggaatgaccgaattctgtatgtgatttttcagagtgctagctttggcttccatcagattgagctttgggggtaatctggaaaagctctgaaatcagtaaattctggataatttttttgatggagaggaatcactggctagtggcaagagccccagggctgttgattaccatgtggtggcacataaagctctcgccaccatttattgagtccttccctgccctgttttgacgtcttgtctcagtcttcacaatcatcttttgcagtaagaactgttgctgtccagccaggcacggtggctcacgcctgtaatcccagcaatttgggaagccgaggcgggcggatcacctgaggtcgggagttcgagaccagcctgaccaacatggagaaatcccatctctactaaaaatataaaattagccaggtgtggtggcacatgcctgtaatcccagctgctagggaggctgaggcaggagaatcgcttgaacccgggaggcggaggttgtagtgagccgagatcacgccattgcactccagcctgggcaacaagagcaaaactccatcttaaaaaaaaaaaaaaaagaaccattgctgtcctcatttcacaaatgagtaaactaaagttcagaaaggttaagtgacttccaaaaggtcacacatctaggaagtacctgagctcgaatttgaaccagatctgtctgaattcatacaccatgctcacagccaccatcctgtgccaagacccatcactgaacatttctggaggtcagtttccctatctaccaaatggggaaaaataagcccagtgcattcctaccagattactgtgagatgaagacagtgacaaaattgaaaagccaaagactgtgtgcaaaggggaggtactattattaatcagagaagtgctgctttattgggtacaatttaaagtgtctgcataaggctcttcattctggtgaatatttcatgaggaatggaaagagcacactactgcatttattctctgctcaggcctcctgaatacatccttcctttggcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggtaagatcagcagctgcagagtacatgccctatggccagagaacagggctgtgtgctgctagccatgagcagggcattcctaaaaacaccagcagggttttcctataagaaaacatggccaggaccaggtgtggtggctcacgcctctaatcccagcactttgggaggccaaggcaggtggatcacctgaggttagagttcgagaccagcctgaccaatatgatgaaaccctgtctctactaaaaatacaaaaaaattagccgggtgtggtagtgggcacctgtagtcccagctactcgggaggctgagacaggagaattactttgaactggggagatggaagttaaagtaagccaggatcatgccactgtactccggcctgggtgacagagcaagactctgtctcaaaaaaaaagaaaaaagaaaaagtcagcatcactgacagatccctcaggtttcttagtaggcccctggcacacattcatctgaccagtacctccttgtttagcgggagagaacccttatggagccctggttgtccagccatttattcatcaaatatttctgtaggatacattgatgactaccaccactcattctattcacatatccaatatatcactaagccctacatatctcttttctttgttttttgtttttgtttttttgagatggagtttcgctcttattgcccaggctggagtgcaatggcgcgatcttcactcattgcaacctctgcctcccaggttcaagagattctcctgcctcagcctccccaagtacttgggattacaggcatgtgccaccatgcccagctaattttttttttttttagacggagtcccactctgttgccaaggctggagtgcagtggcacgacctcagctgaccgcaacctgtgccttccaggttcaagcgattctcctgcctcagcctcctgagaagctgggattacaggcgcccaccactacacccagctaatcttttgtatttttagtagagactgagtttcaccatgttggccaggatggtctcgaactccagacctcatgattcacccttcttggcctcccaaagtgctgggattacaggtatgagccaccacgcccagcctacatatctcttatctttatccatgtctgtccatttccactactactactgtagtccaagccactgttatctctcaactagacttacaagagcctcctcaccagcctccctgcttccaagtttaccccctatacagtgcattttctctacctagccagcgaatatcatctaaaatacaaatctaaccatgtcactccctatttcagacttttctcaacctcccttttttttttttttttttgagaccaagtcttgctctgttgcccaggctggagtgcagtggtgctgcaaactcggcttactgcaacctctgcctcctgggttcaagcaattctcctgcctcagcctcctaaatagctgggattacaggtgtgcgccaccatgccctgctaatttttgtatttttagtagagatggggtttcacgatgttgatcaggctggtcttcaaatcctgacctggtgatcctcccgcctcatcctcccaaagtgctgggattatgcatgtgagtcaccacaccagccttttttttttgaggcagcgtgtcgctctgtcacccaggctggagtgcagtggcacaatcttggctcactgcaacctctgcctactgggttcaagcgattctcctgcctcagcctcctgaatagctgggattacaggcgcgtgccaccagcctggctaatttttgtatttttagtagagatgggggtttcaccatgttggccaggctggtctcaaacttctgacctcaagtgatctgcttgcatcagtctcccaaagtgctgggattacaggcgtgagccaccgagcccggccccaacctcatttcttggctctctccaacccacatttgctgcactggatatccttcagttccttgaacacagcttgagctctctggcctccatgcctttgcacacacagatccctctgctaggaatgtttttcccttttcttatcatctggcttctctatatctttcagatttcagattaaatgtcacttctaccaggaacctttcctgttacctctggactcgttcaggcactacatgactctgtatgtccgtagtctcatgtgctcttccatcctgtctgccttcacagccctatcacatgtgattgtttcttgtccgtctgccccacaagaacataagctcctcagaaacagatagcatattttcctcatcattgtatcccagacactaccacagggcttagtacagagtgggtgctctataagtatttaaatgaatgaatgaatgaacctgctaataagaaacaattggatctgggcgcagtggctcacgcctctaatcccagcactttgggaggctgaggcgggcggatcgctaggtcaagagatcgagaccatcctggctaacacggtgaaaccctgtctctactaaaaatacaaaaaattagccaggcgtggtggcgggcacctatagtcccagctactcggggaggctgaggcaggagaatggcgtgaatccgggaggcggagcttgcagtgagtggagatcgtgccactgcactccagcctgggtgacagagcaagtctccgtctcaaaaaaaaaaaaaaaaaaaaaggaaatgattattagctgggcgtggtgactcacgcctgtaatcccagcactttgggaggccgaggcaggcaaatcacaaggtcaggagatcgagaccatcctggccaacatggtgaaaccctgtctctactaaaaatacaaaaaaattagctgggcatgatggcttgtgcccgtagtcccagctgaggcaggagaattgcttgcatctgggaggcagaggttgcagtgagccaagattatgccactgcactccagtctggcaacagagcaagactccgtctcaaaaaaaaaaaaaaaagaaaataaaagaaacgattattctttgctctacacaagggcagaagttgaacaatggtgacccacttacgtattttgttaggtccatgtaacatttccctattgttttaatcttaagttttgtttttttttttgaaatggagtctcaaactgtcacccaggctggagtgcagaggcacgatcttggctcactgcaacctctgcctcctgggttaaagtgattctcctgggccgggcatggtggctcaccatgctgtaatcccagcactttgggaggccgaggtgggcggatcacgaggtcaggagattgagaccatcctggctaacacggtgaaaacccatctctactaaaaataaaaaaaaaaattagccaggcgtggtggcgggcgcctgtagtcccagctactcgggaggctgaggcaggagaatggcatgaacccgggaggcagagcttgcagtgagccgagatcgcgccactgcactccagcctgggtgatagggcgagacgccatctcaaaaaaaaaagaaagtgattctcctgcctcatactcccaagtagctggaactacaggcacgtgccaccatgccccgctaatttttgtatttttagtagagatgggttttcaccatgttggccaggagggtcttgaactcctaacctcaagtgatccacccacctcggcctccccaagtgctgggattacatgcgtgagccaccacgcccagcataatcttaaattgtttaccaaccaattatgcagaaatctacatataaaaatttaaatggtttggcttctcttgataatgttggaaaatctaatgtcagtaggcctccctgtctacatggcaacaattatttggaactgagctgccacctatcaagagggctcttattctccagtttgccacagtttttgttactcccacctaggcatttgaatttctactccctgcactaaaaaaatcaaaggtaggctggacgaggtgtaatcccccagcaccttgggaggccaaggcgggtgggtcacttgaggtcaggagtttgaggccagcccggccaatatggtgaaacccccatctctactaaaaatacaaaaattagccaggcatagtagctcacacttttaatcccagctacttgggaggctgaggcaggagaattgcttgaacctgggaggcagaggttgcagtgagccgagatcgcgccagtgcgctccagcctgggcaacagagcaagactccatctcaaaaaaaaaaaaaattcaaaggtaaattaaatcacttctagccctcaattacattaaattagttcaacttacatctttattgcaacctattaatagctttgtgaccctggctacaccatctcaaccatctggacctcagtgctctataaagtagggataataacttgcttcagatctaacaagataatgcctgtaaaggtcttgtgtaattggttaaccaagtaaaataattgttaataataaaggttagggttttttgtttgtttgtttgttttttgagacggagtcttactgtgtcacccaggctggagcgcaatctcagctcactgcaagctccacctcccgggttaatgccattctcctgcctcagcctcccaagcagctgggactacaggcgcctgccatcgcgcccagctaattttttgtatttttagtagagacagggtttcaccatgttagccaggatggtcttgatctcctgacctcatgatccgcccacctcggcctcccaaagtgctgggattacaggcatgagccacagcgcctgaccaaggttaggtattactattctgtgaacttgtcttagccagccatcatttatttgcaagtaacagaatctcacttaaaccagaggaaaaagggggaatttatttagtcagatacaggcgtgtttctttctttctttcttttttttttttttgagacagagtgttgctgtgttcccagactggagtacagtggcacaatcttggcttgctgcaacctccgcttggtttaccaagtaaaataaccctgggttcaagcgagtcccctacctcagcctcccgagtagctgggactacaggcacgtgccactatgcttggctaattttttgtattttagtagagatgaggtttcaccatgttggccaggatggattcgatctcctgacctcgtgatccgcccacctgggcctcccaaagtgctcggattacaggcgtgagccactgcacctggccaatacaggcgtgtttcaaagaattcaaggacaggaagtagagcccaggatcatgagaaagtggaagcacttgatctggttggctcattctggtttcattggctaccttcaacccaatcagctaaagctacaaagtcaaagcatagtacaaacatgtcatctgggatctatccttgtggttgacaaagtggggacagtttccatagaacggggtctatggactaggcagacagccccctaagtatctattatagaattttctggaggttgacaacatgccctttaagtgattcagtggttttcatttatgtttatggccctcttctcatgaccctcctcaagtgtgccaaccaatataataattggcagccccaatctaggaactgggtgaaatgttttccaggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctggtaagtagccaaaggttattttatttacgtacatacaaataaactttcatgcacacacacacacatatatataaatccaattataattccagtacatttggattatactaattaccatttaactttgctgacatagaaaataggaattttaacttgtagcataatctgaaaacaacagaataaaaacaattgttggtaacacatacaatttttaacttgttaaatgtcaaagctggaagggacttcagagaacagctatatcaagtgggctactcaggtttatcaagggcaaagtgactttcctaaagtcacaagaggccgggcatggtggcccatgcctgtaatcccagtactttgggaggctgaagaaggcagatcacttgaggtcaggagtttgagattggcctggccagcatggtaaaacccccatctctattaaaaatagaaaaattagctgggtgtagtggtgggcgcctataatcccagctactcaagaggctgaggcaggagaatcgcttgaacccgggaggcggagattgcagtgagctgggatcatgccactgcactccagcctgggcgacagagtgagactctgtctcaaaaaaaaaagaaaaagaaaaaaaaatttttttaaaaataaagtcacaagagagtcagtgactgagccaggcttagaacccaagtcacctagattagtagtcctccagtaaaggcgattgtgcccccgggggacatttggccatatctggaaacattttgggttatcacaactgggggtagcgtgggctactggcttctagggggtagaggccagatatgctgtatatatatcctgtcgtgcctaagacagccatcacagggaagaattgtctggtctaaaatgtcagtagtgccaaagttaagaaacactgacctggatcctcctagtatgtttcttttagccaaaagtacaaagttcctaacttgtctcactggcaagacattttgtttgttcgttttgtttgtttgtttttgtttttcatatcttgctgtttccatcactggcagttttattatagaggaagcagtttgggaacgtcgctactgagaggaggttgctaaaccacctgtggggaagtggacttgtctttttgccttttgtttgtttgtttttgtttttctctttacaaatattatttatgttcattgtaaaatatttgaaaagtacaaataagtggaaaaagtcatccacaatccattattatattaaggctattaccaattttctgtctttttttttttttttgtgacggagtttcactcttgttgcacaggctggagtgcagtggtgtgatctcggctcaccacaacctctgcctcccgggttcaagtgattctcctgcctcagcctcccaagtagctgggattacaggcatgcgccaccatgcctggctaattttgtatttttagcagagatggggtttctccatgttagccaggctggtctcaaattcttgatctcaggtgatccgcccacctcagcctcccaaaatgctgggattacaggcatcagccaatgtgaccggcccagctttctgtctttttcctgtcttttctctgtttttacaagcctgagatcatactatatttacacattcataactttttccttttaatttcataatcccaggagaaataggtgggttttttttttttggctttagcaaaaataattgatttgttattaataacaatgctttgttaatataatatcatttgtttgttttttttgggtttttttattgttggtaacttttttttttttcgaggcagggtctcactctgttgcccaggctgggatgcagtggtatgatcacagctcactgcagcctcgaccacccaggctcaggtgaacctcctacctcagcctcccaggtagctgggactacaggcgcttgccaccatgcctagctaatttttttgtattttttgtagagacagagttttgccatgttgcccaaggtggtctcaaactcctgggctcaagcaattttcctgcctcggcctcctgaagtgttgggattacagacatgagccactgcacctggccaacatcatttttaatggctgtatcatactccattatatataaaatactccataatatcataacttctccatttatgaacatttagttcttttcaggtttttaccattataattaacaaagcagtgaacatcttcattcagaagtcatagactgtatttcaaattattttcttagggttcctgccaagaaataaaaaggctaggtaaaatactgtgaaccttttcaaggttttgatacatactaccaaattgctctccagaaagatttttccggtttatcctctctccaactgtgtttaacagtgtttctttcattactgaccagcactgaatttatcagttttaaacattgctaatttgataggcaaaaaaacttgtacatagtttaaatatgcattttgggccggtgcggtggctcacacctgtaatcccagcactttgggaggctgaggtgtacagatcacctgaggtcaggagttccagagcagcctggccaacatggtgaaaccctgtcactactaaaaatacaaaaattagccaggcatggtggtgcatgcctgtagtcccagctgctgaggagggcgaggcaggaggatcgcttgaaccctggaggcagaggttgcaatgtgccgagatcatgccacagcctgagcaatgagtgagactctctctcaaaaaagcattttttgacctggacatttttcacatgtcagccaactcttgctcagttccctctatcaacaatatatttggggtgttgcccacctactacatttgttgagtattgcccgataaaaaaattaaaattaaaaaaaaaaactattgtacaatagttggtcagagttcaggaactaggaccaaattttcttatatgtcaagtatttaaattccttcagcacatttagacagtatgttatcttttaatttgatttatttgtttgggtatttatttcctgtcttccctcctcttccatgccctccctctgtggaacataagcgctttgaagggaagagtttgtttattgttgaatactcagggtacagaacactgtccgaaataaagtagacacggccgggcatggtggctcatgcctataatcccaacactttgggaggacgaggagggcggatcaaaaggtcaggagttccagaccagcctggccaacatactgaaagcccgtctctactaaaaatacaaaagaaaaaattagctgggcttggtggcaggtgcctgtggtcccagctacttgggaggctgaggcaggagaatcgcttgaacctgggaggtggaggttgcagtgagccgagatcgcgccactgcactccagcctgggtgacagagtgagacaccgtctcaaaaaaaaaaaaaaaagaagaaagtgatagagtagacacttggcagaccatttggctaattgtgaagccaatttgcttggaggactagcagtataatatggtgcttaagggcacagatgagggtctctgttttgctatgcactaactatgaccttggactagtgatttaacctctctctgcctctgttttctgtcacattggatagtaatagtttctaccttgttaatttgtcaaggatttaaataaactcagtatctggcacataattaatgctcagtaattgttgtggtagttgatgtagttaaggtttggcaaagggaaatcagttctggaaccctggccttttgattttcaacaatggtatccattgaaataaaataaagtgagaatttggaaagctgtcaaagagggtgattttattttatttatttatttatttatttttatttttgagacagtgtctcactgtgttgccaaggctggagtgcagtggcgcaatctcagctcactgcatcctccacctcttgggttcaaatgattctccagcctcagcctctcgagtagctgggattacaggcacatgccaccatgcccagctaatttttatattaaagagggtgattttctatcatatcccttttctctcctagaaaatataatttgacatcatgcccaagaaatatgaaatatgtacttagttgcatttgttaccaaggcaagtccctcaaatgctcaggactcctttgtgattctttgtgctggtgtttgagttggcaggaatacagccctagggtcttctgggcctggaggtgacatgtatacctttctagctccctctaagatccaaaagctctccaacatctgtaactatagagacagctacattttgctttggatataggctgagactttttcagtctccaggtccccatttgagtcccacacatattacagatgtttcctgtagcattttatatattggatgtagaccttttacaaaagacagaatttcttggtgtgttatggtagagcaagtgtgggactctgatagaactgagttcaggcccggcgcggtagctcacgcctgtaatctcagcactttgggaggccgaggcgggcagatcaggaggtcaggagctcgagaccatcctggctaacacggtgaaactccgtctctactaaaaaaaaaaaaaatacaaaaaattagccgggcatggtggcggatgcctgtagtcccagctgctcgggaggctgaagcaggagaatggcgtgaacccgggaggcggagcttgcaaagtgagccgagatcgcgccactgcactctgggctgggagccacagcgagactccgtctcaaaaaaaaaaaaaaaaaaaaaaaaaaagaactgagttcaaactcctgctctgctacgcacatatgctataacctgcaggaaaggatttaaatgtgcagagcttcagtttcctcatctaaaagtagagatacttccgctcacttcccaagcttgagtgaagacaccagggatggcagtgcccagggcaatgatgctgcccattgagggtgctcaattaatgcatctgcttctataaaacccaggttcatccttaaaagaaataagcttctatacatctatctaggtggtgaaattttattctccagtcagaggagtgggaattagaaagatcttggtgttactgaaagagtttaaattccaactcagccatttcttaggcatgtcactttatctgtctctctctctctctctttctctctctctttctttgccttattctgtaacccaggctggagttgcagtggtgtgatcttgactcactgcaacctcaaccgctgcaggctcagtatatcctcccacctaagcttctcaggtagctgggactataggcatacgccaccacacccgactaatttttttttgtatttttttgtagagacagggttttgccatgttgcccaggctggtctcaaactcctgggctcaagcaatccacctgccccagcctgctaaagtgttgggattacaggcatgagccaccgagcctggctagccatgtctcttttaaaaagttacttaatccatccctacttcaattctcttacctgtaaaatgcggaaattaatatttgtttagcatttactgtttagtagggactgttattactgctactgaaatgtaatagtattgtctttttttttttttcatttctttctttcttttttttttttttcaagatatggtcttactcttttacccaggctagagtgcaatggcacgatcatagttcattgcagcctcaaactcctgggctcaagcaatcctcctgccttggcttcccaaagtgctagggttacaggccttacagccactgtgctcagcctaattttttttaatttttaatttattttattttattattattattttttaagatgaagtctcgctttgtcaaccaggctggagtgcagtggcatgatctcagctcactgcatcctccgcctcctggttcaagtgattctcctgtctcagcctcctgagtagctgggattataggtccccaccacgacacctggctttatttatttatttatttatttttagtagagatgggatttcaccatgttggccaggctggtctagaactcctaccctcaagtgatccacccaccttggtctcccaaagtgctgggattacaagcgtgagccactgcacccctggctgattttttgtagagacaggatattgctttgtttcccagtctggtcacaaactcctgggctcaagcaatcctcctacctcgatttcccaaactgctgaggttacaggtgttagctgctgcacatggcctgcctactttcttttattggccacattttctgggaaatctggcacacctggactctggcatctagtgggaatgaatgttagcagatgttagggggagcgatagtgagcaaagtagaagagggttcagagaggatatttgaaggcctccaaaacaaattgacctcttttttttcttctttttttttaatatggagccttgctctgtcacccaggctggagtgcagtggtgcaatctcagctcactgcaaccttcacctcctgggttcaagcgattctcctgcctcaacctcctgaggagctgggattacaggtccccaccaccatacccggctaatttttcagatttttagtagagatggggttttaccccatgttggccaggctggtttcgaactcctgacctcaagtgatccgcccgccttggcctcccaaagtgctgggattacaggcatgagccacactgcacccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctcagtgtattatcaatcttttttttttaagaacagagataattcaaaccagatgtggtggctcacgcctgtaatgccaggactttgggaggctgaggagggcagattacttgaggtcaggagttcaagagcagcctgaccaacatagtgaaacctcgttgctactaaaaatacaaaaaattaactgggcgtggtgacgcacacctgtaatcccagctacttgggaggctgaggcatgagaatcacttgaaccccggaggcggaggttgcaatgagccgagatcttgccactgcactccagcctgggtgagggagcaagactctgtatcaaaaaaaaaaaaaaaaaaaaaaaaggacagagataattctatatgttacatttgcatcctatatttttcacttaagcattgttccatgcaatcagaaagtcttcaccagcattttgaaatgatgattattatataaatattagagtcagggtctcactgcattgccaaggctggtctcaaactcctagcctcaagtgatccttcagctttggtccctcaaagtgctgggattacaggcattgagccacaccacccggccttcaccatcatttttaataagtgcttaggccaggcgcggtggctcacgcctgtaatcccagcactttgggaggcagaggcgggtggatcatgaggtcaggagttcgagaccagcctggccaagatggtgaaaccctgtctctactaaaaatacaaaaatcagccaggaatggtggcgggcgcctataatcccagctactcaggaggctgaggcagcagaattgcttgaacccaggaggcagaggtgggtggattacctgaggtcaggtaatcctgggcaacatggtgaaaccctgtctctactaaaaatacaaaaaattagctggacgtggtggcaggtgcctgcctgccaccctctgctgcaatcccagctactagggaggctgaggcaggagaatcccttgaacctgggaggtggaggtagcagtgagctaagatcacgccactgcactctagcctgggtgacagagcaaggctctgtctcaaaaaaataaataaattttttaaaaagtgtgtaatatttcctcatggctatactaataattaaacctgctcatggacacttaggctatttccaatttttgtctattataaacaatactgtaatgaacaagccaggtatgctgactcatgcctataatcccatcggctcaggaggctggaggaccgcttgggcccaggagtttgaggatgtagtgagccataattgcaccactgcactccagcctttgcagtagagcgagaccctgactctaaaaaaaaaaaaaaaaaaaaaatgctataaggaacatatttatgcagaaaccatttcaggtaattttaaattaaattccttgggacactggggactccttgaacaaccagcaggcataccataaacagtaattcaaagacaaattgtttggcagacctttgtttcaaagagtttttgcaggctgggcgcagtggctcatgcccgtaatcctttgggaggccactttgggacaccaaagcaggtggatcccttgaggtcaggagttcaaaactagccttgacaacatgatgaaaccctgtttcaactgaaaatacaaaaaattatccaggcatggcggcaggtgcctataatcccagctactcgggaggctgaggcaggagaatcgcttctcctggaggaggcagaggttgcagtgagccaagatcgcaccactgcactccagcctgggcaacagagcaacactctatctcaaaaaacaaaaacaaaacaaaaaaaaaaaacaacagagtttttgcagtactcctttaagacttttctggtatatagaaatgattaattttccagaattctatatatgtacagctttgaagataagaagggttgcctgtagtaaaacgtaataatcatcatattcataactctcatgtattgggtacttttttttccttcatgctttatgtatattatctcatttaattcatacctcagctcttaaaagtaggtattgtcttttttttttttttttgagatgaagtcacgctctgttgcccaggctggagtgcaatgacacaatcttggctcactgcaacctccacctcccgggttcaagcaattctcctgcctcagcctcccgagtagcttggactgcaggcacatgccaccacgcctggctaatttttaaaatattcttagtagagatggggttttactgtgttagtcaggatggtctcgatctcctgacctcgtgatccgcccatcttggcctcccaaagtgctgggattacagtcataagccactgcgcccggccagtattgtctgtatccttattttacagccatagaaactgcagcttagagaagtaattggtgaaaggccacatagttatatagtgagataacctggtttcagctccaaatcccatattctaaccattatcctatactgccacatcaggagtccctgctaacttttatttaagactagtctgtttttttccccaaccccttcagcaaatcaattaagtctagcaggatgcagtggtgtgtgcctatagtcccagctacttgggaggctgaggtgggaggaccacttgagcctaggagttccagtccagcctggacaacatagcaagaccccatctctaaaaataataataagactgggtgtggtggctgacacctgcaatcccagcactttgggaggctgaggtgggtggatcacttgagcccaggagttcaagaccagcctgggcaacatggtcaatccctatctctactaaaaatacaaaaattagccaggcatgatggtgtgcacctataatcccagctatttgaaaggctgaggcaggagaattgcttgaacctgcgaggcagaggttgcagtgagagccaagatcgtgccattgcactccagcctaggcaacaagagcacaactccatctcaaaaaaaaaaaaatggctggatgcagtggctcatgcctgtaatcccagcactttgggaggcccaggggggtggatctcttatggtcaggagtttgagactagcctagccaacatggcaaaacctcagctttactacaaatatgaaaaaatttaggatgggcgcagtggctcatgcctataatcccaacactttgggaggctgagacaggtggatcattttaggtcaagagtttgagaccaggttggccaacatggtgaaaccccgtctctactaaaaatacaaaaattaagggccaggagtggtggctaacgcctgtaatcccagcactttgggaggccgaggcgggcagatcacgaggtcaggagatcgagaccatcctggctaacacggtgaaaccccgtatctactaaaaaacatacaaaaaattagccgggcttggtggtaggcacctgtaatcccagctacttgggaggctgaggcagttgactcacttgaacctgggaggcggaggttgcagtgagctgagattgcaccattacactccagcctgggtgacagaggaagactctgtttcaaaaaaaaaaaagaaaaagaaaaagaaaaaaaaaaaatttagctgggcgtggtggtgcacacttgtaatcccagctactcaggaggctgaggcaggagaatcgcttgaacctggaaggcagaggttgcagcaagccaagatcgcaccactgcactccagcctgggtaagagagtaagactttgtctcaaaaaaaaaaaaaaaaaattagctgggtgtggttttgggtgcctgtaatcccacctactcaggaggctgaggcaggagaatcacttgaacctgggaggtggaggttgcagtgggcgaagatcgcacttgtgcatcctagcctgagcaacagagcaaaactctgtcccccgaccccctgcaaaaaaaaaaaaaaagttgagtgccactgacatagacaagtaacttgtccaaatattagtcattaagggatgaaattgttattgaaacattacttataaaataaataaataacaaggctgggcacagtggctcacacctatatcctagcactttgggatgccgaggtgggcagattgcctgagctcaggagtttgagaccagtctgggcaacatggtgaaaccccgtctctatgaaaatacaaaatattagatggggccgggcacggtggctcacgtctgtaatcccagcactttgggaggccaaggtgggcgaatcacgaggtcaagagatcaagaccagtctggccaacatggtgataccgcgtctcaattaaaaatagaaaaattagctgggggtggtggcatgtggctgtagtcccagctactcgggaggctgaggcaggagaattgcttgaaccggggaggcggaggttacagtaagccgagattgtgccactgcactccagcctgggcgacagagcgagactctgtctgcaaaaaataataataataaatagaagccaggcgtggtgactcacgcctgtaatcccagcactttgggaggccaaggtgggcagatcacctaaagtcaggagttcgagaccagcctgaccaacatggagaaaccctgtctctactaaaaatacaaaaattagctgcatgtggtgttgcatgcctgtaatcccagctactctggaggctgaggcaggagaatcgcttgaacctgggaggcagaggttgcagtaagctgagatcatgccattgcactccagcctgggcgacaagaccgaaactttgtctcaaataataataataataatgataataataatacattaaataaatgaataacaagaagatgactctgaagggctgtcacagaaacagactcattcattttgactttgtggcagttttagtttgaagctaaagaggagatcgtttttatttcatagcgagaaatggcttccgggtgctgagtagaaggggcaggcatgtttggtagtgggctctccagccctagaagcatgcacgcagagcctctgtaggacttttttttttcttttttttaagacagagtcttgctctgtcgcccaggctggaatgcaatggcgcaatctcggctcacttcaacctccacctctcgggttcaagcaattctcctgcctcagcctcccaagtagctgggattactaggcacctgccaccacacctggctaatttttttttttttgtatttttagtagagacagtgtttcaccatgttggccaggctggcctcgaactcctgacctcaggtgatccacctgtctcggcctcccaaagtgctgggattacaactgtgagccaccgcagcagcctataggatgtaaaaggagggatgcctggattggctgggggagttggagtgaatgaccccagggttgcttcctgcatgggacagctccgcttgctaggaggtgctacagaggcttgggcctgtttctcgtgttcttttttaatagttttgccatttgatgttattgaatttacttttctagacactctgacctggtcacagccagagacacttggaaatcctccatctccccggcatggtcatgtgatggtggcagcagggacaaagctcttcatccacggaggcttggcgggggacagattctatgatgacctccactgcattgatataagtaagcagggcatgggggcttgtctgtttaaaattgttatttttatttatttatttatttttagacaggatctctgtctgtcactcaggctggagtgcggtggcatgatctcagtagcctcagcctccaggactcaagtaatcctcctacctcatcctccgcagtagctggagctacaggtgtgtgccaccatgcttggctaatataaaattttattttggtagagatggggtctcaccatgttgcccaggctgatctcaaacttctgtgctcaagtgattttttagtgtgctttgaaagaatatggccttgcttggccaggtgcaatggctcatgcctgtaatcttagcaccttgggaggctgaggcaggcatatcacctgagatcaggagtttgagaccagcctggccaacatggtgaaaccccgtgtctactaaaaatacaaaaattagcctattgtcatggcacatgtgcctgtaatcccagctacgttggtgcctgagtcaggagaatcgcttgaacccaggaggtggaggttgtggtgagctaagattacgccactgcactccagcctgggccacagagcaagactccatctccaaaaaaaagaaaaaaaaaaaaaagccgggcttggtgactcacacctgtaatcccagcactttgggaggctgaggctgggggatcatgaggtaaggaggtcgagaccagcctggccaacatagtgaaaccccatctctactaaaaataaaaaaaattagccaagtgtggtggcactcgcctctagtcctagctacttgggaggctgaggcaggagaattgcttgaacccgggaggcagaggttgcagtgagccgagaccacaccattgcactccagcctgggtgacagagtgagactccatctcagaaaaaagagctgggcacagtggctcatgcctgtaatcccagcactttgggaggccaaggcaggtggatcatctgaggtcaggagttcgagaccagcctggccaacatggtgaaaccccatctctactaaaaatataaaaattagccaggcgtggtggtgcatgcctgtaatcccagctactcgggaggctgaggcaggagaattgcttgagcccaggaggcagaggttgcagtgatccaagatcatgccactgcacttcatcctgggcgacacagcaagactccgtctccaaaaaaaaaagaaaaaaagaaaaaaaaaatcagccaggcttggtgacaggcacctgtagtcctggctacgtgggaggctgaggcaggagaatcgctggaacctgggaggtggaggttgccgtgagctgattgcacccctgcactccagcctagacgacagagtgagactccgtctcaaagaaaagaaaaaagaaaaagaaaatatagccttgctcttatgtgtaggtaacttgaccagctggcagaatcttcatcagattctgttacctctggacagaatactaataataaaaaatcatagcactaaataatctcctgagtgcttactatggacccagccatttattgtctcttaaccttccaacagtgctctcctttcattacaacccattatgctttgtgttggcctactggatttctttctggtgttagccattaacccatgaaggatctggataatgtggatgtagatgactagagtttcatgcttttcatgttaaatggttgaaaacagtgggaagaggaaggttagagagaacatgagaaatatcctttaagtatctgaagggctgatatgctgtggagagaccctggactcattctgggcaattccttcaagctgtgaggtccattatggtagggaacttgtctattttgttctccagtacatttctagcacttagcacagtgtctggcagatagtgggtgacaggtactttcttttttttgagatagtgtctcacttggttgcccaggctggaatgcactgatgcgatcttagctcatggcagcctctgcctctcaggtcaagtgattctcctgcctcagcctcccgggtagctgggacaacaggcacgtgctacaacacccagataatttttttattttctgtagagatgaggtttcaccatgttgcccaggctggtctccaactccaggactcaagggatccacccgccttggcctctcaaagtgctgggattataggcgtgaaccactgctcccggctcatacctgttattgagtggagggatgaagaaatgaacatgttctgcattgctccagactacaagaactggaacaatgggcagaaggcatgggaagtcctgtgtagtgtatcgggctgacttcccaagccctgaattatctggctccatgacagctgaggccaggggacactggctttgtattcttgcattggctagaattttggccacaccgggtgattctcccttcttactctgagatgctgggcccctgccttgcattgacagatggaaactatttttttttttttttgagatggagtctcgctctgttgcccaggctggagtgcagtggtgcaatcttggctcactgcaagctctgcctcccgggttcatgccattctcctgcctcagcctcctgagtagttgggactacaggtgtccaccaccacgcccggctaattttttgtatttttagtagagacagggtttcaccgtgttagccaggatggtctcaatctcctgaccttgtgatccgcccacctcggcctcccaaagtgctgggattacaggtgtgagccactgcgcccggccgacagatggaaactatttacacaaaaccattccttgcgggcagtcagatggggtcttaatgcttatttttaaaaagagcctttttctggtgttaggaactacttgttgactatttttcctgcctacccaagtagttctctaaatctaaaatccagtgatagcttgccttatttaaatgcttgttttggctgggagcagtggctcacccctgtaatcccagcactttgggaggccgaggtggacggatcacctgaggtcaggagtttgagactagcctggccaacatggtgaaaccctgtctctactaaaaatgcaaaaattagccgggtgtggcggcacgtgccagctactctggaggctgaggcaggagcatcgcttgaatccgggaggtggaggttgcagtgagctgagatcgcgccactgcactccagcctgggtaacagagtgagactctgtctcaaaagaaaaaaaaatgcttgtttgaaaagatgcaagtttccctgcaaaaataggtgggaagtaggcgctaaggcagcacattatcgtgtagagattttggagacacaggctttggagccacacctaagtgcagtcttgctgtgccacttacaagctatagggtctcggacaagtctctttccttctctattcttgtttgctcatttgtaagaagaaaggggaggccaggcaccaggccatggctcccgcctgtaatcccagcactctgggaggccgaggtgggtggatcacgaggtcaggagttcaagaccagcctggccaagatggtgaaacaccgtctctactaaaaatacaaaaaattagccagacccggtggcaggtgcctgtaatcccagctactcgggaggctgaggcagagaattgcttgaacctgggagtcaagatcaagccactgcactccaggctgggcaacagagcggaaaaaaaaagaataagaaaggggataggcagaagtaatagaaatttcatagggctgttatgaaaattaagtgagcaaaatttgttgtttagccagcacttacaaaatcgctaaggaactgtattttttttttttttttttttttgagacggagcttcgctcttgttgcccaggctggagtgcaatggtgtgatctcagctcagcgcaacctccgcctcccaggttcaagcgattctcatgcctcagcctcctgagtagctgggattacaggcatgcaccaccatgcctggctaattttgtatttttagtagagacggggtttctccatgttggtcaggctggtctcgaactcccgacctcaggtgatccgcccgcctcggcctcccaaagtgctgggattacaggcgtgagccaccgtgcccggcccaggaactgtatttaaagtacacacacacacacacacacacacacacagagacagagagagagagagagagaaactgagctaattcgaggcagttaatagtgaatggttgaaggtgactgttattataaaggttgtatcacatttctgtgtgatccaaagactgcctacatcagaatcgcctgagattctgggaatcactgagcccctccctgccttcctccctggactacccaatcataatgtcagagttccccaaataattcttatgtgcactaaacctctcagagctcttggtgaatgactttcagtgattggtgtgcaaactacagtagatagataagtttgaaagcacatcttagcccatgctgcgccaaagctctttctttctcttggcaggtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacaggtgagcaggtgtccatgggggatctttaaacaaatctaaacattctttgaaacgtgatgcggtggctcacgcctgtaatcccagcactttgggaggccgaggcaggcagatcacgaggtcaggagatcgagaccatcctgaccaacatggtgaaaccccatctctactaaaatacaaaaaattagccaggcgtggtggcgggcgcctgtagtcccagctactcgggaggctgaggcaggggaattgcttgaacccaggaggcagagaggttgcagtgagctgagatcacaccactgcactccagcctggtgacagagcgagactctgtctcaaaaaaaaaaaaaaaagaaagaaagaaaaaagtgatgcagtgcttccaatttggttcctctatatctaaatccaaaagaatgaaaactctgtaggggatgacatcaggaaagcagcaatgctgccataaggtttttttccttttactcctgtttgttaggactcggctgctacagtaaatcactgagcatttctagaaatttcattactttttaaattttattcagattttggctttcactatctggaaattgtttttttttttttttttttttttgtctgagatggagtctcactctgtcgcccaggctgtagtgcggtgacgtgatcttggctcactgcaagttccacctcctgggttcacgccattctcctgcctcagcctcccgagtagctgggactacaggtgcccgccaccatgcccagctaattttttttttgtatttttggtagagacggggtttcaccgtgttagccaggatggtctccatctcctgacctcgtgatccacccgcttcggcctcccaaagtgctgggattacaggcgtgagccaccgtgcccggcctatctggaaatttcttaacatgaagccttttccctccccaacatagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctc

SEQ ID NO: 36350 - DNA, 13977 bp, Homo sapiens
gctgccggctgaggccggagctgccgcctccatgagaggcttcctcctacaccccagggtaagaaccgaaccaaagggcttggcatgtgggggtacactgtgatagggaggtgggatgggggtcatggaaagggtgctggtacctaatctggcacatctagaactagcccagtggcagtaggcaggatggggaaatggagagagaagatgaacgttactggctgtgggcccagcctggacccagaaccagaggccaccaggggctgtgacagtccacctctccagctgggcggggatgggagaaatcagcctgggacagcagcagagggtggtgccactggctctgcctgacagcccaggatgctggaggagtttgggggctatgtttctggtcagaggcagaagaatctgagagaaagggggatgttatgggaatgtgcctaataggagggcccctgggtgtcagctgctggattgctcagctgctcctatgctgggggtgagcagggcagtgagtttttgccaagtaagggaaggtgggggacactatggaaaagaagggaggaaagggtcactaagacgtggcacgcgcctccttacagaccaaccggtttgcagtgggctcccccaccctattccctgcggctagctttagaatgggactctaaacccccctttctggccctgccgaggccactctggagacggagaactccctccccagcggctgccctgcatttccagtcgtgtcaaccccacaggttcccagtctcagccctacccccacctcatctctgcttctcttcccaagatgggggctcttgaacagaggagccagtttcttctctctctctgcatccccccatccccaccccccatgcagaagcagccaagaaaatgacttgtcatgctggggtggggggtgggggcggagctggagccggagctcagcgcgcacactcacacactgcggcaaactgcagctgcccaaacggtccccctccccttctgcctcactgcggagacacctgccctcctgcctgctcagcctctgcaccgcagcccacccccccccgcaactccagcactggctgagcactgtgtgtccctgcctcacaagatggtcctctctaaagaaaaaggaaaaaacgagtcagttcccttcagtgagagagccaggggagcagaagaaacggctttctcccaggcctgaaaaagagaggcacaggatataaaccatgtaatttcaagtcagaaccactcccagggatagagtgaggaacaggaccttatgccaggacaggaactgggatcatagaagtcttgtggtgataaatggggaccgtgaggaatggttgggggcagggaggggtagatagaaagcaaatcagtgtgtgctatagatatttgtctttctgaccctcctacctcaaatttatgaccttatttgtgtggagggagctcttgtctttctaaatctgaacgacttaaggctggcagcttcccgaaccttgatatccctcacctgccccaagccctgcccttgcctacatctgaggtggctcttgtcctctgaatttatctcaaatgttccctcaattctcaagtaaatagaagggaacccttgaattcccctttggcccaacccacgctgtatggggtttggtcttctgacaccatcgttcatttcccccacagctgcatctgcagccctgtgctgccagatctgcctgatcctggcaccatggctctgcctcttaacaaaggccctggccccaggcttctcttgtccaagcaccagaaagaagagagagctgggtcacagaagagggtctaagggacaaattatggaccctcccaccagtatcctccagacagcccactgccatctgttggatgctctgtgaggttaatgccactatgtactgcaattggaaaggggatttggcaaggaagggcgggtgcaggggatggcagcattcttcttcagcatcttctgtctcatttgccactttctttctttgctgaattgtttggtgtttcatgtgaggctggagaagggaaataggggatttggggatgccttatctttctccatggcctggggaacaccctgaatctctccttccttattaatgtgtttcttgttcaagaacctttcactccccatgcccgtggtagaggcccctaggagcggggcaaagatgagagaagaaactgttcacaatgaataggttgtggggtagtgaatctggcctctctgaaactttgggacatgaagatcaggttggagagggtgttgtgaaaacttccgagcaggaacaatatgattgtgtgcatgtgtattagtgcgggcttggcctctgaggaaccagaggacagaaaatgaagttatagtcctatgtccattctttgaatcataaaaccccaaaaatttagatagcacaggcttctccgggtcttctggaacaggaattctggccttggatggcaagaagggtggggagtctgtaccacacagaagctcctatttccttatttctagacactctgcgggcaggaaagcccagggcagaggcaagccaggaaggagaaagggaagtgagggtcatcatcccaggggccctctctccagctgagccccccatccccaggcagcaccaggagcttagtgctcgagaaggacaaaagcttcttgtcaatagggcagtctgaggccatagttccaggcagagggatgggggcacaggcagcagagggtgtggtagatgaagggaaggagaggacagccagtgtgggagaggggaggtggaaaccctctaagggaagggctggatgagccagttcctagaccttactcagcagtatccaaggtggcagggcctaaggataccttctctttcgtctaagccccatttcctgatagcacattctttcctctcctgcaccacaatttctatacctattctcaatataaattcctacatctctccctcaggccagaggaccctttgccaccagagtgagatcctagagaccatcatcctggtaaatcccagtgcagacagcatcagctctgaggtaaggccagggcctgtgccttgccaaacaggcctggtgcaagtgctatacccacccttgccagtgctaccactattaggccaagaattcctctctctgccatctaagctgacgtattgtctccagcccactctggaggtgttatgagggacataagttgggagcatgttcttgaggtactgaggggccattcattgcctttccctggatttcctatatctgtgaccactccccttcttccattccaggttcatcatcttcttagcagctcatcagcttataaactactaatcttgagtgggcaaagtttagagcctgggggagacctcatcctacagagtggcacctactcatatgaaaactttgcccaggtccttcacaaccccgaggtaagttccatgccagagtgtctgggagaaagggtagcactagagctgtgggagggatctaagggaaagtctcatattgcatgaccatggggggccctggcagaaaggtaagagtccaccttggaaagaggtgaagattagggtactgaatctaagtcagaccaaaacaactctagtgacctgatcaggtttctatctcctattcttctagatttcccaattgctcagcaatagagaccctgggatacaggccttccttaccgtgtcctgcttaggggaaggtgattggagccacctgggattatccagttcccaagagaccctgcacctccggctaaaccctgagcccactctgcccaccatggacggcgtggctgagttctccgagtatgtctctgagactgtggacgtgccatccccatttgacctactagagccccccacctcagggggcttcctcaagctctccaagccttgttgctacatcttcccaggtggtcgtggggactctgccctctttgctgtcaatggtttcaacatcctggtggatggtggctctgatcgcaagtcctgtttttggaagctggtacggcacttggaccgcattgactcggtgctactcacacacattggggcagacaacctgccaggcatcaatggactactgcagcgcaaagtggcagagctagaggaggagcagtcccagggctctagcagttacagcgactgggtgaagaaccttatctctcctgagcttggagttgtctttttcaacgtgcctgagaagctgcggcttcctgatgcctcccggaaagccaagcgtagcattgaggaggcctgcctcactctgcagcacttaaaccgcctgggcatccaggctgagcctctatatcgtgtggtcagcaataccattgagccactgaccctcttccacaaaatgggtgtgggccggctggacatgtatgtcctcaaccctgtcaaggacagcaaggagatgcagttcctcatgcaaaagtgggcaggcaatagtaaagccaagacaggcatcgtgctgcccaatgggaaggaggctgagatctccgtgccctaccttacctctatcactgctctggtggtctggctaccagccaatcccactgagaagattgtgcgtgtgctttttccaggaaatgctccccaaaacaagatcttggagggcctagaaaagcttcggcatctggacttcctgcgttaccctgtggccacgcagaaggacctggcttctggggctgtgcctaccaacctcaagcccagcaaaatcaaacagcgggctgatagcaaggagagcctcaaagccactaccaagacggccgtgagcaagttggccaaacgggaggaggtggtagaagagggagccaaggaggcacgttcagagctggccaaggagttagccaagacagagaagaaggcaaaagagtcatctgagaagcccccagagaagcctgccaagcctgagagggtgaagacagagtcaagtgaggcactgaaggcagagaagcgaaagctgatcaaagacaaggtagggaaaaagcaccttaaagaaaagatatcaaagctggaagaaaaaaaagacaaggagaaaaaagagatcaaaaaggagaggaaagagctcaagaaggatgaaggaaggaaggaggagaagaaggatgccaagaaggaggagaagaggaaagataccaaacctgagctcaagaagatttccaagccagacctaaagccctttactcctgaggtacgtaagaccctctataaagccaaggtccctggaagagtcaaaatagacaggagccgtgctatccgtggggagaaggagctgtcttctgagccccagacacccccagcccagaagggaactgtaccactcccaaccatcagtgggcacagggagctggtcctatcctcaccagaggacctcacacaggactttgaggagatgaagcgtgaggagagggctttgctggctgaacaaagggacacaggactaggagataagccattccctctagacactgcagaggagggacccccaagtacagctatccagggaacaccaccctctgttccagggctgggacaagaagaacatgtgatgaaggagaaagagcttgtcccagaggtccctgaggaacaaggcagcaaggacagaggcctagactctggggctgaaacagaggaagagaaagatacctgggaggaaaagaagcagagggaagcagagaggctcccagacagaacagaagccagagaggaaagtgaacctgaagtaaaggaggatgtgatagaaaaggctgagttagaagaaatggaggaggtacacccttcagatgaggaggaagaggacgcgacaaaagctgagggtttttaccaaaaacatatgcaggaacccttgaaggtaactccaaggagccgggaggcttttgggggtcgggaattgggactccagggcaaggcccctgagaaggagacctcgttattcctaagcagcctgaccacacctgcaggagccactgagcatgtctcttacatccaggatgagacaatccctggctactcagagactgagcagaccatctcagatgaggagatccatgatgagccggaggagcgcccagctccacccagatttcatacaagtacatatgacctgcccgggcctgaaggtgctggcccattcgaagccagccaacctgccgatagtgctgttcctgctacctctggcaaagtctatggaacgccagagactgaactcacctaccccactaacatagtggctgcccctttggctgaagaggaacatgtgtcctcggccacttcaatcactgagtgtgacaaactttcttcctttgccacatcagtggctgaggaccaatctgtggcctcacttacagctccccagacagaggagacaggcaagagctccctgctgcttgacacagtcacaagcatcccttcctcccgtactgaagctacgcagggcttggactatgtgccatcagctggtaccatctcacccacctcctcactggaagaagacaagggcttcaaatcaccaccctgtgaggacttctctgtgactggggagtcagagaagagaggagagatcatagggaaaggcttgtctggagagagagctgtggaagaggaagaggaggagacagcaaacgtagagatgtctgagaaactttgcagtcaatatggaactccagtgtttagtgcccctgggcatgccctacatccaggagaaccagcccttggagaagcagaggagcggtgccttagcccagatgacagcacagtgaagatggcttctcctccaccatctggcccacccagtgccacccacacaccctttcatcagtccccagtggaagaaaagtctgagccccaagactttcaggaggcagactcctggggagacactaagcgcacaccaggtgtgggcaaagaagatgctgctgaggagacagtcaagccagggcctgaagagggcacactagagaaggaagagaaagttcctcctcccaggagcccccaggcccaggaagcacctgtcaacattgatgaggggcttacaggctgtaccattcaactgttgccagcacaggataaagcaatagtctttgagattatggaggcaggagagcccacaggcccaattctgggagcagaagcccttcccggaggtttgaggactttaccccaagaacctggcaaacctcagaaagatgaggtgctcagatatcctgaccgaagcctctctcctgaagatgcagaatccctctctgtcctcagcgtgccctccccagacactgccaaccaagagcctacccccaagtctccctgtggcctgacagaacagtacctacacaaagaccgttggccagaggtatctccagaagacacccagtcactttctctgtcagaagagagtcccagcaaggagacctccctggatgtctcttctaagcagctctctccagaaagccttggcaccctccagtttggggaactaaaccttgggaaggaagaaatggggcatctgatgcaggccgaggatacctctcaccacacagctcccatgtctgttccagagccccatgcagccacagcgtcacctcccacagatgggacaactcgatactctgcacagacagacatcacagatgacagccttgacaggaagtcacctgccagctcattctctcactctacaccttcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaagaaggaacctgagccaaaggatgaagttttacagcagaaagacaaaactctggagcacaaggaggtggtagagccgaaggatacagccatctatcagaaagatgaggctctgcatgtaaagaatgaggctgtgaaacagcaggataaggctttagaacaaaagggcagagacttagagcaaaaagacacagccctagaacagaaggacaaggccctggaaccaaaagacaaagacttagaagaaaaagacaaggccctggaacagaaggataagattccagaagagaaagacaaagccttagaacaaaaggatacagccctggaacagaaggacaaggccctggaaccaaaagataaagacttggaacaaaaggacagggtcctagaacagaaggagaagatcccagaagagaaagacaaagccttagatcaaaaagtcagaagtgttgaacataaggctccggaggacacggtcgctgaaatgaaggacagagacctagaacagacagacaaagcccctgaacagaaacaccaggcccaggaacaaaaggataaagtctcagaaaagaaggatcaggccttagaacaaaaatactgggctttgggacagaaggatgaagccctggaacaaaacattcaggctctggaagagaaccaccaaactcaggagcaggagagcctagtgcaggaggataaaaccaggaaaccaaagatgctagaggaaaaatccccagaaaaggtcaaggccatggaagagaagttagaagctcttctggagaagaccaaagctctgggcctggaagagagcctagtgcaggagggcagggccagagagcaggaagaaaagtactggagggggcaggatgtggtccaggagtggcaagaaacatctcctaccagagaggagccggctggagaacagaaagagcttgccccggcatgggaggacacatctcctgagcaggacaataggtattggaggggcagagaggatgtggccttggaacaggacacatactggagggagctaagctgtgagcggaaggtctggttccctcacgagctggatggccagggggcccgcccacactacactgaggaacgggaaagcactttcctagatgagggcccagatgatgagcaagaagtacccctgcgggaacacgcaacccggagcccctgggcctcagacttcaaggatttccaggaatcctcaccacagaaggggctagaggtggagcgctggcttgctgaatcaccagttgggttgccaccagaggaagaggacaaactgacccgctctccctttgagatcatctcccctccagcttccccacctgagatggttggacaaagggttccttcagccccaggacaagagagtcctatcccagaccctaagctcatgccacacatgaagaatgaacccactactccctcatggctggctgacatcccaccctgggtgcccaaggacagacccctcccccctgcacccctctccccagctcctggtccccccacacctgccccggaatcccatactcctgcacccttctcttggggcacagccgagtatgacagtgtggtggctgcagtgcaggagggggcagctgagttggaaggtgggccatactcccccctggggaaggactaccgcaaggctgaaggggaaagggaagaagaaggtagggctgaggctcctgacaaaagctcacacagctcaaaggtaccagaggccagcaaaagccatgccaccacggagcctgagcagactgagccggagcagagagagcccacaccctatcctgatgagagaagctttcagtatgcagacatctatgagcagatgatgcttactgggcttggccctgcatgccccactagagagcctccacttggagcagctggggattggcccccatgcctctcaaccaaggaggcagctgccggccgaaacacatctgcagagaaggagctttcatctcctatctcacccaagagcctccagtctgacactccaaccttcagctatgcagccctggcaggacccactgtacccccaaggccagagccagggccaagtatggagcccagcctcaccccacctgcagttcccccccgtgctcctatcctgagcaaaggcccaagcccccctcttaatggtaacatcctgagctgcagcccagataggaggtccccatcccccaaggaatcaggccggagtcactgggatgacagcactagtgactcagaactggagaagggggctcgggaacagccagaaaaagaggcccaatccccaagtcctcctcaccccattcctatggggtcccccacattatggccagaaactgaggcacatgttagccctcccttggactcacacctggggcctgcccgacccagtctggacttccctgcttcagcctttggcttctcctcattgcagccagctcccccacagctgccctctccagctgaaccccgctcggcaccctgtggctcccttgccttctctggggatcgagctctggctctggctccaggaccccccaccagaacccggcatgatgaatacctggaagtgaccaaggcccccagcctggattcctcactgccccagctcccatcacccagttctcctggggcccctctcctctccaatctgccacgacctgcctcaccagccctgtctgagggctcctcctctgaggctaccacgcctgtgatttcaagtgtggcggagcgcttctctccaagccttgaggctgcagaacaggagtctggagagctggacccaggaatggaaccagctgcccacagcctctgggacctcactcctctgagcccagcacccccagcttcactggacttggccctagctccagctccaagcctgcctggagacatgggtgatggcatcctgccgtgccacctggagtgctcagaggcagccacggagaagccaagccccttccaggttccctctgaggattgtgcagccaatggcccaactgaaaccagccctaaccccccaggccctgccccagccaaggctgaaaatgaagaggctgcggcttgccctgcctgggaacgtggggcctggcctgaaggagctgagaggagctcccggcctgacacattgctctcccctgagcagccagtgtgtcctgcagggggctccgggggcccacccagcagtgcctctcctgaggtcgaagctgggccccagggatgtgccactgagcctcggccccatcgtggggagctctccccatccttcctgaacccacctctgcccccatccatagatgatagggacctctcaactgaggaagttcggctagtaggaagaggggggcggcgccgggtaggggggccagggaccactgggggcccatgccctgtgactgatgagacaccccctacatcagccagtgactcaggctcctcacagtcagattctgatgtcccgccagaaactgaggagtgtccgtccatcacagctgaggcagccctcgactcagatgaagatggagacttcctacctgtggacaaagctgggggtgtcagtggtactcaccaccccaggcctggccatgacccacctcctctcccacagccagacccccgcccatcccctccccgccctgatgtgtgcatggctgaccccgaggggctcagctcagagtctgggagagtagagaggctacgggagaaggaaaaggttcaggggcgagtagggcgcagggccccaggcaaggccaagccagcgtcccctgcacggcgtctggatcttcggggaaaacgctcacccacccctggtaaagggcctgcagatcgagcatcccgggccccacctcgaccacgcagcaccacaagccaggtcaccccagcagaggaaaaggatggacacagccccatgtccaaaggcctagtcaatggactcaaggcaggaccaagtaagtatatcatgaaacttggcagagagtgtgggttagggctgggtgtgggctggtcagacttcaggagtgggacagaggggaaggttgccaaaagggttctacttttcctctacaatgaatcctggcttgtctctacagtggccttgagttccaagggcagctctggtgcccctgtatatgtggatctcgcctacatcccgaatcattgcagtggcaagactgctgaccttgacttcttccgtcgagtgcgtgcatcctactatgtggtcagtgggaatgaccctgccaatggcgagccaagccgggctgtgctggatgccctgctggagggcaaggcccagtggggggagaatcttcaggtgagtagcaaaggacaccaaggaagtagtctggtcaacgctcactcagaggcagtagtggaacacagtccctatttattaaaggatgggccttttctaagggcagcagagctgcttctgagaccatgaggtgccccttccccctcacctaccttccctttatgttctcacatcagacatatcttatctcccttctaggtgactctgatccctactcatgacacggaggtgactcgtgagtggtaccaacaaactcatgagcagcagcaacaactgaatgtcctggtcctggctagcagcagcaccgtggtgatgcaggatgagtccttccctgcctgcaagattgagttctgaaagagccgccctcccttccccaaggatccactcccccagctcctttagagaatggctactgctgagtcctttggggttgagggagatgggagctagggggaggggagggagatgtcttgttgtggggacttgggctgggctaaatgggaggggttgtccctccccatcatccattcctgtgaggtgtctcaaaccaaagttaacagggagaggatgggggaggggacaaattagaataggatagcatctgatgcctgagaaccctctcctagcactgtcaaatgctggtattgaatggggactgaggatgggtctcagagagcaacctcctccctcgtagagggagattatatccccaactccagggacctctttatctcaatctatttatttggcatcctgggagggatttccaatagtaatttatgtgacctggggcaggataccgtcagtgaggtgcccagagctgcaccctttcctccatttcccatcccccatctcctcaaccaccagggtctgagttctagcagggtcctgggggtatcccactgctatactgttctactgcttccctcagtatctgaatgtctcaatttaaaacttgaagctctttagaccaatagactggtgagaggagaaaggagcttatcccccagaccctgctttataccattcacatcccagggctgtgtccagacagcacaaaacggcaaggagagcccaagccccaatgccagaattcttccaaactccctgactctttgaagtttttactcaccccatttcaattatcctgatcccttctcatcccctgcttggcttctctgcatgtggtcatctgctgtggcttggtgtttaatgggttaaaaataagccactgcctgacatcccaacatttgacaccccagcaatgtgtgactcccccaacattccactatgccatcctgcagctgaaatgggaacactggctgcctctccaaacccgctcttggacagaggatctgggaggtggaagccaggccagaggacttggggaaaatgagatggaggaaggaaaaagggagaagctgagccacagcttaactcctacagagtgaaatgaaaacgggctgaaaataccaccccaggagaggacctcgccccaagcaagccagtgagcagccctgccagactactgccagactgagaaacccagaagctggtagtcatgtgggcttgccttctctgccaaacgactgggaaaccaaaatgagcccaccttgtgttcttcctagctccaccctccccgtgctgctgtgttctgctcctccccacgcttccctgctatagttcccagctgctgtaacggagccacctccaactctaacaataaaccaagttcattgcagatagtgt

SEQ ID NO: 36351 - DNA, 51114 bp, Homo sapiens
gcttgcttgcccggctcgctcacgggtcgttgaggccggtgacatgtctgtgagctgcggaggctgcggcccccaggtgagccgggcgccgacgtgctcgccgcggaggctgcgtttagatggggtggcggcgggtgtgcggccggcatggatggagcggcccggctccggcgctccagcccctccgcctgccgctggtcccccttctggcttcggggccgcccgagagctgcgccttcgcatggcggagggaggagggcgggaggagcgcggccgaaggaggaaactcaccgcaccgggcccagagtagagggaggtgctgggtctcgagacgcgtcttcctggggtcccaagtgtggcggtggagctgccgccccttttaatgacaggctgtttccatccccggggtggtcttcagagacggccccccgggtgcgtggtgcgcgtgcttagtgtgtgttcgtggtgtgcgcacaggaacatttgcagcggttgggaggacgttgcactttgttcccgaacagcatccttcactgtcagacccccggagccttggaagcaggcgctgctcagatcttgtaaacggaaggcgtcaaggggctcctcagagtattgatatttggatttgctgtcaaatactctcctaggctgttaatggcttaaggctggccataaagtaccccgaatggattgagtatactgctgttaatccaggcatctaagctgctttataaaaaatatgtagatgtaaccgaagtattaaaaagtgacaatgacagtaaaagctaacattttttctcttccccatattaccagctttcattttttttctctgctttgtctgtcttctaaaaccatataaagttggatgtggtttagctttagatgttaaggagtttcatggtgagaaagactgctgagatacatacctaatagctttagtacaaactggagttaattcctgttctcttttcagcttttcaatcgcttgcaaaatgctcgttttgcttagctgcttcccactgttttagaaatgtcatgtcgattgttattttgttatgtctgaaaatactcaaaatatggagtactaagaaaaaatggggtatcagtaatgcacagatatattttttttaatgtcatcattttaggatggcagcccagtgcctggcatgattggtgtcagttaaaatagtgcaattgaatgattttttttttttttgaaaaacacatttactttttcaaacggtaccctgattattcattttttcttgtcgttgttcctcctgacaaaactgacccaggggtggacagtgaatgtcactattgtagctgtaacagtaatttatgaaaggtcaaagaatgtaaggaaatcagggaagaagtgggttcccaagctgagctagagactaatgtatgtacccacataactgcagtatcgacaatattgataagggcctagcagtggactcctaggccagtgatattttgcagttgttgaggatatgggaagttgcctaagacatggaaccatagtgagaaattctctagccttctctagccccctgaactccagggataagtctagaagctgaagaagtcctcttttgcctttagaggctggaaaaaatacggtacttttaatttttttattttttaattttaggaacttactgtctggaaaaggaactcaaaccaatttggacaatatattaaaggccgttttaagagaaaatgccagttgtaaataggtagaggaattctgtctatacgtgacaaaaatgtgaaagacttagaaaatatctctttgtgaatgggcagaggagaccagtgttgattagaaaaaattccttcttactccatcttagcaaactaattttcagaagtagaaaaataaattttttggctggtcttcataaccttttggcaagggtttcaaacttgtagggcgtgtggtgtttggtttttcaaaagtaattgaagtaactttggatagggtaactgattttgttttttttcctgtcttgtggtctgcattttattaatcaactacctggaaggattgaagggtgaggacaggtcgagaaaagctttaagttaagcctgggcatgagttaagggtcaatgagctggtaatatggggaagagaaagaaaaatgctttatcagtttaaaaacagcctggaaagatccaagtgtctcgattctcccagtcatccttacatataaaagtttattaaaaaaatacttctgggccaggcttggtgccttacacttgtaatcccaggactttaggaggctgaggcgggtggatcacttgagaccaggagttcaagaccagcctggccaacatggaaaaaccctgtctttactaaaaaataaaaaattagccacgtgttatggcacatgcctgtaatcccatctagtcgagaggctgaggcacaagaatcgcttgagcctgagagatgggagattgcagtgagccgagatcgtgccactgcactccaccctgggcgactgagtgagactctgcctcaaaaaacaacaacaaaaaacttctggagtaaaggcatttgaaatttgtagattagagactggacatggtaaaaggagaaaagttatcatttttagaataatctgagaatgtttcttgggaaataaatggggtagaggcctggaacagagaggatgttacttgactgaaaatgaggtatattgtaaagagtttcggtttgggagtcaggtctattaattaaatgagcctcattttcttcatacccacctcaaaaagttagtgcgaagcacatagtagctgcttactcagtgtttttatttttacctcccgtaatggtttgaggattctttgattgcaaggaagaaaaagccaatttaattagcctacttaaaaaaaaagcatttgtcatacagtgctgctgaagtccattgcatgattccaattcagcgttttgggaaccagaaagtcttcaggcagttactcttccagtttttctctggaagcacatggtcttatgtctctgctactcacgcaggtctgttccagtttctttcagattggccttctctttaaagctcttggtttccacttccccaaaactttgatttgcatgagactttggtttgccatgatgccaacatcagactcactgactatgcaacatggttctcagcaaacatctccaagtctcagttatgtttctagagagagaatccaattggtcaggtttctgcttctagcacagttggctggagagtgaggaaagataggaatgggaaaaatggatgaggaagagacttagatttgtctcacagtttgcagggctgctccttttaaactggccatgccaacatatttaacaaaaggagagtggacagggaggaagtgatggatacctcaggtgtgctttaacatcctgcaatttgagttcttcctctggcattgcattgaacttgctctcagcttggtaatgttctaaccagatctaaccagtagtctctttacaggacagattctcctgggtgtgggagttcaggcaaattactgaaatgcttgatgactcagttttcctatgcgtagaatgggcataatagcaccttctgtggtgagaattatgaattcatgtatgtaaagcaattaaacagtgtctggcatatggcaggcacaatgcaagggtacggtattagtatttgttgagagcataccgtgtggcaggtactgtgatacaggcttctggtcgtgttcagagaggaaggaatttctgccctcaagaagtctagaagtccagtgctgaccactcatgcttaaaaccatttcttgacttcagtgacactaaattcttctaaatctctacctcacctacctttctgactgccatttatttgtggttccttttatgccggtcctggaaccctttatcatggttgtcttcatagatgctctcttgaatttctgttctttcccagtcgctgagaccagctttcaggttctctatatgtggattattcttagagtaacatctccatctctgaccccaagtaaatctcttaatttttagttctttttttgggtattattatttatataatttatatgttttgagacatggtcttgctctgtcacccaggctagggtgcagtggcgcaatcttggctcactgcaacctcctcctcccagggctcaagcgattctcccttctcagcttcccgagtagctggaaccacaggtgtgtgctaccacgcctagctaatttttatatttttttagaggtggggtttcaccgtgttggccaggctggtctcaaactcctgggctcaagccgtccacctgccttggcctcccaatgtgctgggattacaggtatgcgcccactgtacctagcctcttggatattcctatgttgatataaaatactgtcttccagttaccttctaatttgcaaagccttctgatttaccttctgatttgcaaagaaaaaaattttctttcagcatcccaggcttaaaaccttaaagttatttttcacattcttctttttttatgctgtaatataccctgttagttaataggttctgtgtgggcttttgggtgcttcctatgactggcccatctgcaaagtagatctgttgacttatttcggctactggcagcttaggatagatccttatatctgtaagagctacttaaatgccttttcagcaatatactcttagagtcatggcgtcatagatgtcactgataaaaagaaatgtgttcctgggttaaaattctgaacatattttctgttagaaatagtcttgtggatagggctacgtacaagattaagaatgttactccattttctagggagcatattcatgttgaaagcacaatctcaagattttagttttttgttgttgcatttttttgtaggtattcaattacatagcattttaattatagcatatcatccttataatattgccatacacatatacaaagttttattataaatcagttgttgaaaatatttttgaaagtcaaatatattacagatgcacactcaatagtgaaactaagataatcatttgagggcatatatcctttacagtgatttcttaaaactgtattcaaatgtaggtctaatgagttttttattatgaaaatgttaactgttttatcctcctgccttcatctgattattctaattaacttctaacaatggaccgttgcatgtttaaaagttgtgtttattgttgctgaataagtagttttgaagtcagtagccattcacacttagtactttgtcaactagacccatgttattcctttcaataccagtggctagttgggctcaaacataccttataagtagatctcaatctggaatgcagttgaaaaatcaataatttttctctgtgactgtttgggaaaacaaaagtgacagaacaaatattcttggattaattttgtaaaaagtcattaggtaagtggccctattttctatttggtgatgttgcttttgccaccaaatgcctgtctgcattcacgtcattgatgaaatttctcttcaccgtacagctcgttcacttcagtaaatctatagttgcttattatgagtaaggcctttggggaatgcagagatgagtaaggcatggcgatggaatgaaattcactgttgtatcccaatcactgttacttagacgcttggtgaatgtatgtgttgaacgttggtagtacttacagtccagtgcagggcatagacatgtagacatttaactgttacataaggcactgtagtctaaagtgctaaaatagggtaagtggtgattttgctccccaaggaaatgtttggtaatatttggagacagttttggttactgcaactgagtgctactggcatctagtgggtagaggccaaggaagctgctaagtgtcctaccatgcatacacagcctcctacaacaaagacttatctgacccaaaatgttagtaatgctgagattgagaaactctgtagcggtaagaacatatatattgtgaatgcaggaatgaggttgaggattaaaaaggaaaaaggcagaaactataaagaagcaaatatcttaatagatattaagacatactaaaatcattttatacgattgactgttgttttgaaaaacaaaatagtatctgatagctgtagtagttttagattttgtaagtcaaataacaggtctgtacccaagaaaggaacttagcttccttatttgcaaaaagggggataacatcacttttattctgctgttcacctattaggtattattctgttttatttttctagtgtttgtgttagggtttacaagataacttattacaggttttcttcaaataacatcacttcatgtttaatgtagaaatctatgacagtctttttttgtctccatctcccctgccacattttttatcctattttgtcatacattttatcaatatgtctgtcttaaaccctctaattaattgttactatttttaaacagttatattttaactgtttaaaagggattgaaaaatgaagaataacttctgttaccctcatatttaccatttcagatgttctttattccttcgtgtaagattcagatttccatctggtattgttttactttgcctgaagaatttctttccatagttactctagtggtggtcaactggtggtgaattttcacggcccttattcatgtgaataaatttattttgccttaatttttgaaatacattttcattgagtatatctgggttgatgcttttttttttttcttcttcttagtactttgaagatagtgctccattgtcttgttttccggttcatatagatgtgaagtctgttgtccttggttcctctgtatataatgtgtactttttttctggtcaattaatattttttctttatcactggttttcagccatttggttatgatttgccttggctttctttatgtttattcttagggtttgctgagcttccttggtactgtcagtttacggttttcatcaaatttgggaagttctctgctattttgtcttcaaatttttttttcttctgcacccacttccccagtgcacgcacgtgcacacccacacacacacacacacactctctctctctcactcactcactcgcttactcactatgtctcttcgtggaactccagttattcaccttttatggtgcttaaaaagtcacttacactctacgtttgtttttaagttttgtctctccatgtttcattttggatagcttctattacattgtctacaagttcactgagcttttcttctctagtttaatctgttaattgtatccagtatggttttcgtttcagtatatttaattttcatctctaaaagttcaattttggtgtcttttgtatcttctccttctctccttatggtgatgttttcctctcacttcttgagtatatggaacatatttgtactatagttttacaatccttttctgttcctgccatcatcactgtcatttctaggtcttcatttattgcctttttttctcttggttatggttcatatttttctcttcctttgcatgcttggtaatttttattgtatgccagccattgagtttatactgttgcttgcttgatttattatattactgaagtgtgttggatttagttggggtgcacagttacttggaatctgttgggttgtttcagggcttgcttttagaatttattagtgtgggtccagaacagtttttaacgtagtgctgaattattgtctctactaaggctgcttctactaaggctgctacttcttctgaggagtctatcattacctgatacattacaaggtttttctattctggtggaatatattatggtttatctctagggctctcacttactttcagctctccctccagcttaataccctgtaaattctagccatcttggtctctccaaactgatctgtgtttaaaactcagtgaaaccaccagactgcttggctttcctgtccctgtattgtgacctggaagtagctggcagccagtgtttcccttctctcagggatcacaatcccgtgttccctgttgtctgatgtttaaaaccaatgtttcatatatattctgtcctgttttcttgtagttatattcaacagaatattaatttttaacacttggccatttggcatttggtcaaaatgtgtatttggagtgtttactctaaatgtgatctcagatactataaagtagaaattattggaaacacaaatgtattttcacaaactcattaaatgtagacatactcatttaaatatttgaaggcatactttgctctttattctgttttatatttttcagcctacatcatgctttgaactttgttctttaaatatgttactttttatttattagttcagcagatgtttgaatgcctactatgtaaaaatacataaaacacttttgtcctcatggaacttacaacaggagggaagtatgcaaacagtggcaccagaggattaaattataaaccacttagagagcacaaaggaggtggttactatttgggcaaggagggataaaggagagatatgagccaagcctattttagggagggaagtttttgaactggtgcgtgaatagtaagtagcagttcagctggtggaagagagagggtagatttgagagaagtttaggagaatgacaagtcaggatttggcaatttactaggcgaggtagtctgtaggaattgaggggaagaccagtttccagcttggcctactggttgggtttggtttaatggctcttactgagatagagaatacaggaggagatcgtttagggagaaagttttatttaccttttgaacatacaaattttggagtaactgggatatttagttggaagtgtctaataggaaattagatatacagaactgaagaataaattagggagttatttgcatagttaaaaccagaggtaaggataaaatgtccttgaaaaactaaataaaatgagacaagaggataaggatgaagactaagaaatattagtatttgagtaacaagttatgaaataatttaggaaaggaaacttacatacagagagacaagtttttctcaaccagaaattacatgtggcagttgttaaaagtacagattcctatgttccatgtagacctgttgaatttggatcttctggtgggggagttgtgtgtgttagaaataagctgatgtgtacaggtactgaggtttgagaactagtgcagtaggaagagagtcaagatatggcaatattgttgacaggcgcttcacagactggcatagttaattctcctgatacaaaaaaggtcaagtaataggtgatgtcaacttgaacatttcttaggtcagaggagataaggaaagacttggagaatatatattttttaattataaaagaatttatgttcattcagaaaagtacaaaactcaacatacatagacacaaaatgaaacacccatgattgtatctacccagatgaaaccaatgtctgtactcatctagtgtatgtcttcttttatattacatatatagatacacacatgtagttatacagatttttcacaaaatgggataatgctaatatgccagaacctgtcttattttacttaatgatctaccatcttctcatattgtagatagatgacattttataaaatttaaaagtcccacttgcatgggtgaccactggcatcagtttagtgtacctccttcaagtcatttcctgtggatgcacaaatatttacatatgtgtgtcagagttgtgtctgtatataattttttctttcttttttttttttttttgagactctgtggcccaggttggagtgcagtggtacaatcttggctcactgcaacctccgtctcttgggttcaagcaattcttgtgcctcagcctcccgagtggccgggattacaggcatataccaccacacccagctaatttttgtatttttagtagagtctgggttttgccatgttgcccaggctgttcttgaactcctggcctcaagtgatcttcctgccttggcctcccaaagtgctgggagccactgtgctaggccagtcttttttttttttttttttttttaaattacaagtgagagcatcctattaacaccattctgcaacttgctctttcacgccagtatggatcactctaactcattatttccaatagctgagtaataatcatgtgaatttatttgaattgatgaacttctagattattttcagttttttcattttatttcagtgaatagtctttcacatatctttgtgaattttgtgcaagtatatatgtaggataaattttaagaagtgaaatagcaggactaaaggatatgtgtatttatttaaagtgccctatatctctgttctctgtattctttataattgtttctgtaattgctttcatttgtttacttttgcattctgtgatttttcttaaaatcttcttggttttccattgtttttagcaatgtctgttctgcttttttgttatttctaaggggatttcatttgtttagtgatagttttctgtgtgtttcctgagctatagtggttcacttcgtagttgtttgccttgtctgcctctttcttgtctctcatctgcttttttccaagccatgtaggttcactttaatttctttgactatagataacgcacttagttattctttgcttaggactcttgtttcttcatccagaatagggcacaaagcagtaaagcactaaatgaaaagtttatcataatacaaatgtattttaggtgaatatactgtatttttgttcttcttgtgaaatctgtcaaaaacgatgtgctctctaattatataagatgctaaagaaatcctgctctagtagctgttatcctttcttcccccatcaatctttgcatcatttccaaagatgatttttttctttgctttacaaaagtatgtcatatcatctcatattggattcacttttatgttgcacagatattctctaatagatttctttcttcctgagacagtattttatttatgtttaaatgaaaaagtggtggagtaaggcagtaagttgtttttcttccatgagtgaaacagagtgtaaatatagaattaaactgtttctctttcattaatttcaaacaatgatttgaattctgagataatgtgagtctcaggggcatgattatatttgtctggattttttctttttatgtatattgtatgttgtttgtttttcagtgttccttcgcagatcccatactgaattccatttgctttattattcaatcttgaataagggtgttttatctggatctgctattcaggaaaattgtgggtaaagtgaactggggtagccagccctgtcaaatcccggatgttgtttcagagcactcccacctctccctgcccaactttgaaactgtttcttctaccttaggtgcttgttgcacctgagggtgagcagctcatttagatagttggtcccatttatttgatggtgaagtctcctgggagttaatgtttatctttgctcagttgactttagtcagcagctgcaaaggtaattgttgtttcctatctcttttccctacttcccttttaggcaaggttaggagcagactcagagaaagtgatgtaaggcgtgccattcctttgtcctgcagtattgtttttaatggctgccatggcgtcattgtgggaatgaacctaagatcatttaattactctcttgtttctggcatctagattgcttcgtatttctattgtgagttgtaatgaaccagactataaaacctttatgcactgtagaggagtggtgaagagccccagtgctggagttagaaaatttggacttgaatcccacctgtgccatttatttactctgtgggcctgggcaaattgctaagcttcctcttgcctcagtttttctcatcgtcaaaccggggtcctattctgtagtcttaaggacaacatgagatgtttacataaacctcttagcaaaacagaacacttggtgcattatgagcccttgttaataaactagatgctctaggatcattatttgctttgatgcattcccaaaagcagaaatgctgagtcaaagaagtatttccagggttttgacacgcattacaaaactgccctgcaggtgccactttacttaggagccttctttgacagtctctggtttcttggaacccttatgttggcttctatgttttatgttacatttgagaaaagcccacttgcctctgaggctttctggcagttgaggagaacactgtggagaagaaaggagagtgaagtggcctgggacaaataaaaggattatctttttgctttggccactatacatttttatacttaaactttgttttgataatttttggtccacttgatcattttggtccttaggtaaatatttaagtcttcttttgcctgtgttttatagttttcaaagtacctcccataaattatttttcatttgagtctcacagtaaacttctctggtaaatacggtatcatatacattgaggaaaaagttccagagacattgcagtttacccagaggaaacaaagctaataagaggcagcacagggagacgcatgatcgtcttctggattctggggtatcaccctttaccttgtgctgttgggaactccttgtgttaggctgagcctttctcatgctgctgcttcaatttcagtaattaatcagattttattgttatagagaccactagggcttatcttagttcagaatagaatacaatcatacttctttgtctaaaaattaaaatgtagaaatctctaaagaagtgtgtgtgtttgtgcactcacgctatagtcttatctgcatagcaaaagaatatacaatttgaacttcactaaaatttagttttttaaaagttctgacggtggggggctagattgaagtttgtttttgcgtataaatctcctcatagtataaatttatgttaaccaaatgtcttggaaacctcagctaagcaattcattttttgtctttttgtttttttcagaaactgggtcttacaatattgtctagactggctttgaactcctgggctcaagcagtcctcccacatcagcctctcgagtagctgagactgcaggcatgcaccactgtgcctggcttcaactaggcagttcttgataagaccagattgattttctgaaaatacttgaaactaagaatttcttaaatatttatttgactttttaaaaaaagtatttagttccccacttctactctttattgtgatgaaactttttcctttgaaggctttgaatgcaggagggccatatctatcttgtttctcttgtatccatagcatctagcacaagtagattttaaatgaatggacaagatactgtggtcaaatgcagataccgagtggttaatgcctggagtggatttaagttctcaaagatgttaaagcatctttaaaaagttgagacttagttttgagtgtttcacctggcaggtgttgtgtgtgttaagtactggtaatcatttgacttggatgtcttctgaaattttgtcaatggtatgctcttaagcttcctatacaaagaatgtatctaatttgatatgtacagatttctcattcgtctattatcaaacccttctgcccaagaaataagaatgtcaagagcattcactgttgccatagagataagagtgtcttgggaggcagggaagttggaattctttttgtaatattctctacttaagcttctatttttaaaatgttttttaaaaaacttgtttttcagatctttctctttgacactttgcaataaaaaagggcagtgagattgaataggtaagggtgtaaactattttataattttgaaccaaaatataagatttttataataattttctatctcattaaggtaccaatattcatatatttttcaaatattcttgctggattgcaagtaaattggggggggtgctcagattatttttgttttcatttttatttttcttttaatgactgagttaaaataaattaatttagcacaaaatgcttgcctgaattgttaagatcaataaataagttgttttaatatgttttctttaggtgttttgtggattaactcttcattgattatatacaacaaaaaatagttatggcgactttcagaaacaatcacatgaagactaaagcatctgtcagaaaagtaagttcactctattaggtttcttttagtgaaagttttaattaaaatgttgatttttttttaagtcctacagctatgatgttttgtttaaatgaatcttattatttgaattagtaacattgaactactgcaaagattggcatgtatgaaaatagtgatacaaaatcatgattacagtgattttatttcctaaagatcacagtgctttctccccattttttctctacacatagatatccatgtgcttttttgcaatataggctgtcaggtgtaagctttcttatatacctttagctttaccattcattcattccttcattcagcaaatacacacttgagttcttataagccagaccatatgttagatgttgggtaatcagtaacaagcaaacaaaatatgattcttaatcctttcttccttctagtctaaggaggaacctcctcacttcctttcttaaaacaatttggttaaccttccatttcttgacatttttgtctttgctaaaactttggaggcactacccatgaacaaagaagggaagaatggagcctggaagataattaacagtctttgttatttctttttctggacttcatcttctgcattatatgacaccattgaccaatccttacacattaagacaatatttgattttcattataggtttttcttggtttccttctcttttatggtaactcttgtctcctttgctaatctttccaaattctaattatcagtgttcctatgagcttctgggcctgccattcatttatgtagagagctaaaagatgtataggtttgactgctaagtctaagaggatggcttccaaatctacaggatgcctgcaaaatagaaagtaaacttatccttaaacagtatgttaattacttttttttttttgggacacagtttcgctctgttgcccaggctggagtgcagtggcgtgatcttggcttactgcaagctctgactcctgggttcatgccattctcctgcctcagcctcccgagtagctgggactacaggtgcccgccaccacacctggctaatttttttgtatttttagtagagacggggtttcaccgtgttagccaggatgatcgcgatctcctgacctcgtgatctgcctgcctcggcctcccaaagtgctgggattacaggtgtgagccactgcgtctggccaattacattttaaagtaatatgctccatatgttttgaggtaaattacctttaaatttaataggtccactttttaatttgaaaaaagtacaataaaaactattttctgtttctactctttgtaaactatagtgtatttattatactttttcagattagcaactagacccatagctttaaattgattatactgctggctttaaactaataactaataatatatacaaaatataatagcaaactgataaccatggtcttcaagaatgatgctacctgacttgaatatttaccccatacattgccagagattcagggattagacagcagctgaaatttcatactattattaccaggttagtgtcttttgttattcaacgtattgtccatattaggcactcagtaaagatttaatttgaattcaacttgaattattggaatcccttttagataaaagtatgtgaatccagatattacatactgtttatataaacagttatgcacacacatacaccaccttctacatcttggtgcatcttaatgtcagacacttccctattggctactgtggaaattgaaagatatacttgaattctttagatttcactttaatttgcattaaatatagagatacattaaatatttattgggaattaatgttgcaaaattaaaaatagctatagtttctaccccagtaattttttctaacattttattatgaaaaatttcaaacacatagaaaagttaaaagcataatacacacacaaacccacgtacctaccacccatattcaacagtagttaataatttgtcttgtttgctttgtgtctgtgtatgtgtgtatttactttcaggcagtaccatttgcaagttatgatcataatgtttcttcaccctgaacacttcagcatgcttctcccaggaataacaacatcttcccacataacactaataccatgaacacatccaagaaaaataaattcccatatatctaatactcagccatactcagatttcctgtattacccccaaaatatcttttatagttcactctgcccctgtttggatccagtctagcctcttagtctctgttgcctttggcagttaggacttagcatttcttttggtttgaaagaatttttcctttttttctttatattcaattctgacatcttgaataggccaggctagttttattttcttgtaccatgtttcacatctggatttctctggttgttttctcatattgctatttaatttgatcctctcccttgtatatttcacataaagtagaagttatgtttaaaggtttaattggatcaggttaagcatttatggcaagaatactttatagggtgatgtgaggacagaatttcaggttttcccatgatcagtgatgctatgattgatcagttgactaaggtgataaccctgctagcatttccattgtaaaagtacattttctgttttttggttagcacataatctgtgatgatacttggctgtgtgcaaatatcctttttttcccccaacaaccattgagctaatgtttttggcatcccttgcttactctttcctgaattcattatttcatgggagttgcaaaatggtgattttcctaattctaccattcctttcacatttatttgctggtattaaagaaaagcttccctcattcaccttagatgaactatataatatctcctatagaggcagggcaaatgccctttaattaccagttttcagattaatgacagggcatcatagttaacaccagtggtagcaagtgagtttatttccccacattaattcactaatttatttgtaatgctctggactcatggatttttgcagttctatattttataaccttttatttctttacagtcattaattcatctatgtaagttgctcaaatttttccaaaattgatacctgagagcccctccaagtaggtacctatatccttttgtctcaggctcataactttgattgctttttcactttcgggttgtatccttttggtacaggatgacctaatttcacctactttaccttcctcagacctgaaattggctattttttttttaaagaaccctgaatagtatttaaaacccaagatctggatactaggagttgcctttgcacttaccatgtcatgagtttatattgacagttcacgttcagatttcacatattttttcctgttttgatttcctgtttctaaattagtgtgaaaatccccgtttattaaggaaaacaaaattgtttaaaatattgaatattttcaagcccacagaaaagttgagaaaaaaacctagtacaatgagcacctcatatagtcttcactcagattcaccctcggttagcatcatacctttaagtatgtcagtatcattaccacctctttgaaaatcattaattcagtaacatcatctagcatgcattccaaacacagatttccctgtgtctcaagtatccttgtaactttttccttgcttctcttctaggatccacactgtatttggtcaaggttcacacactgtatttggggattgtatctctttggtcttccccattctagaccattccaatagtctaaattcttttctcatgcagcaaatcttctgaagagtctaggccagttgtgttgtagaatatttttatatttgggttcatttgtttttccctgtaattagattcaacacaacacctgaaaggtgatgttgtgttcattccggtctatcagatctgaagtccatattgttgatgttaggcttgactaggtggttaaggtaataaccaccagatatctccaatataaatgcacataatctctttatgattaatacacttaataaactataaggtgatcctctgagacagtatgagtgtccttttccccagcttttaacccagtagatttaggatacatggataatcctttcctaaatcagtaattgcattgggagtttacaaatggggttttctaactttgtcattctgtccatactagccagcatttttaggtaaaggagctcctctgactttgtctcttttaatggactcacagattttttttaatccagtagtcataattcattaccattttcattcttcttgattccacattgtcccatatttggccagtgggaattctttcaagctggcttctgtgttttttgaaattaccctattagtctttgagcatttccttgcattctggcacagttagatgttccaggctcgcttcatacattctcagcctcagacctggaaccagccatttccccagggaaatctagttctttttattggtgatagatatttacagaccaaaagctgggtgctgactatgctcattgccactgaaggtcattgtttctaagacttttcagtggaaaaaaggtagtacatgtattcaaagaattacgaatttgtaatgacaggtcagattcaaatgtaacagtacagctttttatcataaattctttgagtttatatttgtacctcttagactaaagatttccatttattttaatttattaagattgcagctgtttgagttaatctagtgtgaggttctgaaatatggggaaacaaagtgagtgaaacacagtctgtgacttccataatttgttttaatgggtaggaaagaatctgattatagtaattatatgttttttgttttcgagacggaatctcactctgtcgcccaggctggagtgcagtggcgcagtctcagctaactgcaacccccacctcccaggttcaagcaattcttctgcctcagccttccgagcagctgggattacaggcacgtggcaccatgccaggctaatttgtgtatttttagtaaagacgggctttcgctatgttggccaggctggtctcgaactccttacctcaagtgatccacccgcctcccaaagtgctgggattacacacgtgagccactgtgcccagccaataattataatatgttttggtgtggattaaatgatcttagtgcacaacatacagcaggaactttgagagagatttattaggactaaggaatggaaaaatcttcacaggtcttgggatgggtaggatttctacatgggaagactgggaagtaaggacatttctgattgaagagcagattgacaagtcagtggaagggggcataaggtagaaggaaataagtgttctatttatgcctgactataatactcattattttctttatgtaactttttccttgtacttgtgacaaacatctcaccctgaaatttggaatcccctctcattttcatcagacagcttccttaagatccatggaaaaccttattttggattattatcttatttttctgtctccaactttgttaatggagtaatcactgttgttaagggagtaatcactgttgtgcaccttaccatagctcccacatcatctcattcaatcatataaattgttgcttctgttctacgccagtgacttggaaatcagatatgcagtttgttaagttttagtgtaaggtaagagtaagtgaacctggtatgagatctcacgtgatcttctagtgagttgaatgcccaggctccagtagtatgtgttttgggcatgtgaaactctgcctaaaccttttcagctgaatggagcttttcttctcagtggaattgagttccgcattcagtatcaaaaggtgccagtgaatattagttagagaatgagtgactatctaaaacatctccaggatctcttacccttgtcttagaattaaataaatttgaaatatctttgctttctttcccctgcagagcttcagtgaagatgtgttccagtctgtaaagtctttattgcagagtcagaaggaactatgcagtgtaacagcagaggactgtttacagcaggatgagcatgccaatttaactgaggtttaacatactactttctaaaccctttcctaataatgcacagcatattttcatgcatctttgtaggactctatgatctatttttaaaatgcctaaaatctctatttgttgttacatgtatcagaagtacctgttttgtgggcgggagaggggaaaaaaaagaagtacctgttttaaatactggctaaaataattttcttaattgacaatgaactcaaacaaatgagcacatttattttatgcagagtactaattggatatatagcattacattagatgatgcctactatattcagcaactgatactttaatatgaatttttctactctgaaacatagaacaaatgcatgattcttatgttgattttttgggttattttcttgactgtttaaattcagtgctttgattaaaaatgaaaaagtagtgataaatttatctttgaaattaagatacttactctattacttgaggataagataatataccttgctcacctatttctctgctacatccagtgtttcaaatctttgtttgaatttattattataaaaagagtaagatccttttctataatatatccatacttcatcatcacatttgttaccaaatacgagatgtattaggtcgttgcagctcacaactgatgaatatttgaagttaaaacattttattttgaaataagcgttctaataaaatcgtggttatagatagatgctcctggacttatgatcgagttacatcctgatagatccatttttcatcaaaaatattctaagttgaaaatgcatttaagacctcataaatccattgtaaagttaaaaagtcagaagtccaaccatcataagttggggactgtatgtattctctttcgggtggatgattttcttaatattccttgagaaattctctatttgacgtcatttcataggaagatgagcatatgttttaggcctgtagtgttctggtgcctcatcctctttttgtgtcagcttaatttcactattattttctttgctaacctttttcattttactttagcaaaaccaagccactcttaatctacttggttgtttccaaataaacagtggcagaacataacaggcctaatacatatgctcatcttctatgaaatgatgtcctgtgtcctgtcctccagtggttttccagctcggataggtcgcagtgcttttccaagcccacattccttggtgaggcctttcttgaccaatgggaaagataaaactcccccggcatcttcaaaaccctatgccagcttattttctctcttgtattcagtaaagcaaacttgaaggaatagatggaatttctattccattttagggtgtgcaaatctctgagtatcttttcaaataaaggaaggaaattagttatttgcctatctgttattgagtgcctgtaatgtgctaggcactttcctctacattatccagttaacctcagaactatgagagggaagttgtattgccttaagttttacagataaggagacaggctcctagaggttagcaattcacctagatgcctagaagttaactgtatgtaacacttacatgaagtaatagccataattaatcagaataaagatctcagagtaatataagattctgacttgcttctgaatcatcagaaatagatcgaaaatatattcagtgttgctatattctgactatactattgtccccacattcttgagaatcgattattaatattgccgtcatttaagtattgcatattttttagccacagtggttgcttagtggacagtttactacactgtcttcaaatggaaaaaatgtcttactatgatgccaaatacatagagaatataaatgtaaaaagtaacactttttcaggttataaaagtagtatatatatatttttttcttttctttttttttgagacatagtcttgccctgctgcccaggctggagtgcagtggcgtgatttcagctcattgcaacctccacctccagggttcaagtgattctcctgtctcagcctcccgagtagctgggactataggcatgcaccaccatgcctggctaattttttgtatttttagtagagacgaggtttcaccatgttggccaggctggtcttgaactggcctcaagtgatccatccacctcagcctcccaaagtgctgggattacagacatgagccactgcacctggccagtatatattctttgtagaaaaataagaaatactcaaagtagaacaaagaaaatgactatcattgatcttatgacttagggaaaaaatgcagaggggaaaagaatgggaaaaaaatagctccatcatccagagttaatcactgcttatagtttggtgtattgccttccagtattattttccatgcatatgtttttaaaaataaggttgaaattgtatgcaggctgtaaatcatttttctatgacttgtcctttttacttaataatgtgacagttcttcatgcattaggtattctttagaaagtctgtttatataaagttctgcagagtaatctctacataaggatattgaaggaaataaatggtggtatcacagagtcaatgaagaagtagcctcaggagtctacccagggggaaggcctctctgaggaggtgacacttgcatcgaaacttgaagaatgagaagccaggcatgtaaccatccaaggaagagagatccagattgagggcgcaactgtgaagtccttaggcaggaatgtacagggcgtgttccagacccagaaagggggctcgtgtgtaagtgaaaatggtagaaggatgaaagcattaggtaacctcacttaggattttgccatgggaagcatggaggagtttgaatagggaggtggcatggtaataggaccaggtgggagaggattgtactagtgtaggtgagaagggtggctggggaatggagagaagtggatatatttgaaatatgttttggggttagaattgattgaacttgctagtgagggagaatggatgaggtttaagaactgcgttttggagcccaatctttggtgaaaaatatttttgggtcatctttgaaaaaaatccttttcaagcagacagcattttaatgctttgtctgttttttcctgtttgtcagctctgtcaccagcctgaaagatttaaaaattcaaattaatggaggtttatttgttctttactcaggtcacatttctgggttttaatgaagagacagatgctgctcatatacaggtatggtgaattttagcatttttactgagtattcttgtcatggaaatcagctttaggtttgaccacaaaagtcatttatctgagaaggttgcaaaccgcagactgactttttctgcattctgtgtataatacagaatgtatgacttgtttgtttattttgatggctttaataattttgaccttaacagtaaaaattcttatgtttttagttaagattgagttaaatttaaaaggtaagatttgtaaaaattaacaattagccaatgcaaaaatttagcctgtttgatttaggcagttattgacagagggactgatgtttgagattgggatcagcaaaggaaagcttcacagttacataaacagtggttgaagttcctgtacatatgataggcatacttttctttttccctcgtgctgcttcttaaaaatttgtgattcctacatatttccttttgtggcagtaaagtgtctcctcatagaggaggaaataacatttttaggtctttctgaataatgcatatcaggtgattatgggcaaaaactgctgtatattttgattgtggccttgcttgaaggaaataatttggacagaaggaacaagagaggatatattcttgagaacatacatagctggaaagagaagtattccaagatatttctttaatgttcttcttctcctttaagagttactgataaaaccatgtttataaaggaaagtactctacaaagggtcaaagactttaataattctttagctgggtaaaatatttgtgtataaagggcaaacaagaagaagaaataaaagcgattttcttttcctttaatcttcattaaaattatcagttaaagtctaatacaataccttggagaggaaagatagaaaaacggattatattgtacagagtttttaaaaaaaagtttttaagatgtacattctctagcaaaaaattttgtatgaaaaaaatttcataaagttaagttaagacctatatgttgacattgctaaaaactattaaatgcttaattgtcatggatgtgttaggtaccctgtacaatttttttatagcttgatatcagtacattttaaaggctacggggatagccagtatttaataattttagtatattttatttttgaatttttgaaaaattatctgtgaataataaactgtatatgttaactattatgaaccaggaaattcactagccagtagaccttaaaatttttggatagggtccacattataggaaccttaacaaaagtgttactctacagtgttacttattgttattattttaaatcaggatttagctgcagtttctttggaacttccagatattctgaattcactccacttctgcagtctaaatgaaaatgaaattatttgtatgaagaatataaataaaccattagatataagcagtgatcctctaaatcaggtaacttttgtagataatttctaatgagatttttagggcaaattttactatatttgataaagatgattaaacttttaaatgcttggatgacatttgttttttttaaatggtatctcaaggaaatatgattcataagaaatataactcatgaagcattgacatccctgaaggatataataattttggtcatatcttataaattatattttttaactgtgaagttccgtagatggtatgcaagtacatgttaattttttctgaaaatttattatttctggatttcttgaactacttttacctttgtataagctacagtgacttttccctattatggccaatttcaaatttatataaatgttacgctatatgttttagagaatgtacttcagttcattttctggtttaaaaaaattccatgtaaagtggacatctgatgtgttctttataaataaaaatgttaccatttcttacaggtggttagttttataatattcagcatttagttctttaccaagtatgattttgttgataatgcatcagagaaaatgctttgcattctaagagataagacatatacaattgaaccagaaaatttaaaatttggattattttagttttaaaaaaactgctatgttgttctttataaggtctgccaataaaactagaactgcttgcttcatttccttaattatgttctttattcgtatttgctttatttgctaggatataagaggtgataagctattatatttgatttctagttttttgaataaataatttcatcagtatttacttgaaaaaagtagtatgagggggaaaatctggttacttgtatttttaaagctataaacattgtaagttgtaatgctagggaaatttaagtaaaaggagtagacttttaacaattgtgataggaaggaagatggcatcatacttgaaactacgggaaaatgggattaaaaataaaagaaaatagaacttggttgctgcccccaaacaatttataatagttagtgagataggtgaatgattaaggaaaatcatagggctgtacagtaatacaggaaaacataattgctcaaaggaatggatagtaagtttcataacatttcaggagactgggtagaatttgaatacctggataaaagaagatgggagaaaaaaggactggaaagtgaaaaatgtagagaaagaattaagaagtaaacattacaaaaccaaggagcttttcaggatgcatgaatttcttgtttgtttttttctctgagattgtcttatatctaggctttacttcatgttgttttgtatttgaaattaaaattgtttttattatcttttatctttcccaagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggtttgtttttcattagactttttcctaaaatagggaattaaaatttttcagttttgaaaattttaaggcaggcttgttcagttgaaatttatgttgagatttgattcaatttaaaccttttaactttttttctgattacctaaggaaattccttatgatttttaagttcattgtaatctggttttcagttttgcttatttcaggttttcatatttagttggtgctgttcacgcactggttacatcattaagtgtctggaacattcctaggttccaattttggaagagttagctggcagagtctccacggtaatttttctaacatgcgtgacagcatgcaaaacatcccatagaccaggtatccctagacatagagtaaactgaaattattttataaacagtatatttactttcaaatgttacttgggtgaatctttctgttaaacatagtttagaagatacacataaatattatatgtttaaagtcagtttattccatggatttaagttaatttccaaaaagttttgttcaaaaataatttcaccatttcattcttttcctataggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggaccctggatccatatagaaatgaggtctcccaactgtatagtttttcaacctctctggttcacagcataacaaaagatgctaaggaagagttgacagcctctctagttggcctaccaaaatccttaacagattcttgcttgtttgaaaaatctggatatgaagaagataatgagtgtcacgttacaccagaattgcctaagtctcttcagccttcctcacaaaatcacaggttttaccacagcactggcagtttaaatggatatggttgtggagacaatgttgttcaagctgtagaacagtatgccaaaaaagtagtggatgacactctagagctaactctaggatctacagtgttccgagtgtctgagaccacaaaatcagcagacagggtcacttatgcagaaaagttgtcacctcttacaggtcaagcttgcagatactgtgaccttaaagaactccacaattgcactggaaattcatctcagcactttttcagacagggttctctcgccagtagtaagccagcttctaatccaaaatttagcagccgctatcagaaatctaggatttttcatctcagtgtccctcagattcatgttaatcttgataagaaggcagtgcttgctgagaagatagttgctgaagccattgaaaaagctgagcgagagctgagcagtaccagcctggcagccgacagtgggatcggacaggagggtgccagctttgctgaaagccttgccacagaaaccatgacagcagctgtcacaaatgttgggcatgctgttagcaggtaagtttcacgtttcttttggttgttaatgataaattaaaaagataaatgtgatcctatatgtcttaggtcctgttcataaaggaatgattatttttaaccctacataaacaaaagttttccctgttgcatttatgtattgtttcatatcctacacatgactttaatatattttggtctcctgatcccttttgagggaaggtgttatccatttacagagctggaaaatgagggttggagaaaataatcaccttatccaagttcatagagctatgaaataggtaaagttgaattaaataaatagctagagaattttatatagtagtccccccttattctcaattttgctttcctcaatctgaaaatgttaaatggaaaattccagaaataagcgattcgtaagttttaagttgcatgttctgagtagcatgatgaagtctcacaccatctcactcaggatgtgaattacccctttatccagtttatccatactacatgtgctgttcacctgttagtcacttagaaggtatctcagttatcaggtccacaaacctggtatgtacagggcttgatgctatctgcagtttcagacatccactgggtgtcttagatcatatcccccatggataaggggggactattctatagtaaatgtagaatattactatattaatttactattctgagattaaatttttgtacacctttcttcattcacaagggtaagttttcttataaagaccatggttaaactactctgaagaagaaagtgaaaattctttacatacttacaccatttctcttgattggttcacaatctaagaggacagttctttctggtagtcctacagtgtcctgtttttcagtagctatctcttgtgctcagtgattctttttttttttttgagatggagtctcgcactgttgcccaggctggagtgcagtggcacaatctcagctcactgcaacctttgcctcccgggttcaagcgattcctgtgcctcagcctccctagtagctgggattacaggcacccaccaccacgcccagctaatttttgtatttttagtagagacagggtttcaccaagttggccaggctggtcttgaactcctgaccttaggtgatctgcccacctcagcttcccaaagtgctgggatcacaggcgtgagccaccgcaaccagccatgctcagtgattctttaataacaacttagttacagtttttcagtttaaaccttctttgtccctgagaagatatcaggaccaacttgtgttattagttgataggatgatatttgtaagtcctgcttgaaagagaaaatgctttaagttgaggtggaatttaattgagtcacatgatattccagatttttgagtagcttctgttaaagccatgacatggtctgcctcttttcttatccatcttaaaatagggagatatagcttggccaggattcttgaatccaattgctccatagcgtctacttgagatgagagatgatgtaggtttctggtgaactaggagaggtctctatttgccctaatcaggcagccttctttctcctagaccaggggttggcaaactacagtctgtgggccaatgtggcctactggttgtttttgtatggactgcaagctaagaacagatttcatgtttttttttaatggttgaaaaaaatcaaatgatattttgtgatgtggaaattatatgaaattcaaatttcagtatttataaataaagttttattgggacaccaccatgctcattcaattacacatttctgtggctgcctttgtgctataatggcagagttgagtagttgggacagaggctgtatgaccagcagtgcctatgtacttcctgtttggcctgtattagttcattttcacactgctataaagataccacctgagactgagtaatttataaacaaaggaggtttaattgactcacagttctgcatggctgggaaagcctcaggagacttacagtcatggcacaaggcaaaggggaagcaagtgttttcttcacaaggcagcaggagagagagagaagggggagctgccagacacttttaaaaccatcagctctcatgagaactccctcactgtcatgagaacagcatggaggaagccgccctcatgatccaatcacctcccaccaggtccctccctgggggttacaatttgagatgagatttgggtagggacatagagccaaaccatatcatggcctcttacagaaaacaattgcgaacctctgtcctagatccacattttcgttttcactacataccagttcctagtatgataataaacataataaattgttaataaatattctcatgaataggtaataaattaggcctttttacaattgaaataattttcctcatacaggttgcttcaggctattttactttttactcctcctcagttcagtcctgtctgccctacggacccatccatccccctttcctcccaccctcatgggaagaaaagagactgtcctctaaagtttttaagacatcactctcaggggctagcaaatgcctttgttattgattttctcagtaatttccacttttccttcttagagttgggtgagtagatagcccctaaagttcttcctgtaagccagtgctgtccaatttcagctttttattaaggctggagtaattattttcctgcttctcttcttaataattgtgctagggttctgtaaatactgactaaggaaagctgactctagtgtgtagagtttacgtttaacattttttatttctaaagttaaatttgtctttcaaacttgaaaggagattcattcagatggattattctttaaggtattatttcacctgatgtccctttttgtttgattcatgaacatgaccataaatatttcacaaactgtaatgaacagagaggtggcatgtgaatgcaattgggaaattatgtgatagtacatttttattcatttttgtttgttgttgtttgtttgtagagatgagatctcactatgttgctcaggctgatcttgaattcctgagctcaagcaatcctcctgccctagcctcccaaagtgctgagattgcaagcatgagccaccgtgcctggctgatagtgcatttttagccaacaaaacgattatattctaagctatcattccgagccaaaataacctcacagtcattataaactcttctctggacctcatcctttgggtcatttcagccaaaaaccatgagaatgtggcacatattaggaaaagtattcaaaaaaacaaagtagtaatctatcaatggttcagaactataatgtgcctatgcttggaatgctcagtatcattctgtatcttacaaaattagaatagctgaaaaaatggggggcaattcaggggctattctcaggatagcactagggatacggaagtaagtaaaacaggcaaaaatctgcattctcttggagcttatgttatagtggaataagacaataggtaagtaaaatatatagtatgtcacatagtgataagtgctttgggggaaaaataaagcaaggtagggagttagggagttagagagtgctggtggtgacagtggcggtggccattagggctggtttacagttttggataggtagcaggggaaacaatactggcaaagtgatacttgagccaaaaaccaaaagtgaaatgagaataagtcatgtgggagtcaccgagaacagatttccaggcctaggggtgggactgtgcatgtttgggaaacaacagagaggcttgtattgctgaagtgggaggagtgggccagggagaacataggaggagtgggccagggagaacagtaggagttcagatggatgttataagaggggacaggcagtatgttttaaggatttgggctcttcggcttggtgggaagccattggaaggttttgatccgaagactgacattttttctttttatggaaacatcactttgaactactttgttgaacataaaatgtagtgggacaattaaaatagttgagcagtgaatggactttcttgtgatgatggaataaaagtataaatgcctcttattgagaaaaatgaaaggggttatgatctatgttcaaaatcttgaagagatttggttagtttgaatacaggcttggttgacaatactagaatttcttgaacgacttttttgttcttaaagccagaaagagactcctttaacataaataaaagtactgttttacaaagcagatgataacttaggaacttgtactgccccatggtatctcagttgaaaaatgaactgctttaagtagaatttagagaaataatgccctagggatagatccattgtagattaacaaagtaagttatggctgttggtgggtacctcagttaactttgaaattaatacgctatcctacagtctgtttgttggcagactcaaataaaggattacatgagccactggtctgattccgaataccatttcttgtttttatcatctttgtcatcaaattgatagtcttgtaagttcagaatctgggatgctttcaatttgattttttttctttttttcttctttttagttcaaaagaaatagaagactttcagtcaaccgagtctgtcagtagccagcagatgaacctcagtattggtgatgacagcactggtagctggtccaatttaagttttgaagatgaacaccaagatgaaagcagcagttttcatcatctaagtgaaaggtaactacacttttgcatataattgtgtagtttaggtcctcagatcttagaagtgagctataaatttacattattatttaaaaattctaaatttgaaaatatgctattactttcaaaatgtattttattattcacaatgtatttctaattgtttttaacacttatttaatacagtaagtagcccagctaattttattggggtgtgccaatagttgatttgaaaaatattgcatacatttaattttatgccttttaagcttctcccaaactttttatgaacttctgaggaaaaattttttttttcactttaaaaagggtacttttttttctttaaagaacaagaaaaaggacaggtatctgtaaaaggcatcaaagtagccctgtacttttcctgacattagttaaaatagtatctttttggtggggcgagggtccctgcttgtcctgctgttaggaacaaaatgacctggaagacttatgcttgaatgattgaaaatacgtaagtcaaagccattataaaaatgtgattttgtatagcacaaggcacttacctcatatataacttttcttagttaactttgttcataacagtggtgtttgaaatattttattaattatgagacagttgtttcttatagtcttaacctctacctaaaggcatttctgactaacctataaaattctataaactctttatccacattaagtgataactggaaataatagataccatttgtagcagagtcttgagggaggaaagggttcttagcatattgctggtttcaggcatgtgtggaaaggacctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcggcgatttgggctgggcgcggtgattcacgcctgtaatcccagaactctgggaagccaatgggggtgggggtggatcacttgaggtcaggagttcaagaccagcctgggcaacatggtgaaaccccgtctctaccaaaaatacaaaaattagccaggcgtggtggcaggcacctgtaatcccagctacttgggaggctaaggcaggagaattgcttgaacctgggaggcagagattgcagtgagctgagattgtgccactgtactccatcctgggcgacagagacagactccgtcaaaaaaaaaaaaaaaagactgtgacaatttgaaaacaccttgccagtttcattataagcaggaagttcagtggagggcaacaactaaaaaacacactaatttcagattttcaaaagtgtttaggaggattatataattatttgatcagaaaagaactggtctctgtctgtgactgtcttaaatatttaggtagtttgttattctcttaggaattatgaattagattaggttaagggatggggccagatttgcagaatgtttcagataatttttataagatgtatcacaatcaagaccagtcttgatatggctaaaagctgcaataaagcattgcagtactggaccactgtagtacttataccactggttggagtactcctgtgctagacataggaaatatgaaaagacataaaagaaagtgatggaagcagggtagtgtttcaagagtgaagtaggaaaactcttaagtgaagaaattaagttttttaaatgttgggttaatacagggtgatcatacttcccacttaggatagtttggcttatttctgctgttctgttgtaattattaacggtgaggtctttaaaaaagtgtcctggttagatgaaaaatgtatacagtcacctagttagaagtggcattttatgaagaatgacttcaaatacccatttggaggcacaaagagggaggggtgataaggttagagggaatttgaatttttagtctttacttcgtttagctgtttttttttaatgtttatgtaataggtaggtgatggattttattaagtggaagaatctgtgtgatgggtagaaaaattttatatttttttgttataatcattctattaatagaagtaaatagagtgtttgagatgattaattttctttttctcctttgctcacagctgtctgtccattctttgtttgtatattttcttatttttagtttatctgacaatgaactacatgggttttaacagttttataatagagctatatttgtttgaacatatgttaaaaagaccctgctcagttttaacttttactctctaatacatcatgatttgtgacagtttgatcatgttagagtgaatataactatgcaaattatttgagattgcttggaagttttttagaacttgaagtaatcacctttttttgttaaccataccaacatttactgatgtacataaaatgattttatgtttacttttttagaaccaaaattttggtttgtataaatattactttttataattgcctagcataatattgggaaaaatcgctgcttatcactgcaaactaatgtgcttactaatgtttaataattagaaatgattagaatttttaaattgcatgctgagggttttaatctgaaaatttgaatttaattttatttctgaacatggttgctttttttaaaaattgctttgctgcagttttagaaagtagttgctttcttcttcagttgattaggtagtgtaagacattatctgtatgtggcatttgtgactggccaactagacaagtgtaatgcttgattaagccttggctattctagctgtattctgaagaaaatgtttgttatttgccatctactgaattatacataatatatgaaatgaagataattgacataatagtattttaaaatctgagaacatgttttgcccaaatagttagaaaaggtctgtttgggactatgtctttatagagtcttccatcccatctccccccaacatcccctcacccatacctgtcactgttttgcactatctaaagacctgagagaatgttaacctgttttttttaactttatccaaatagaaaggtattggcatttcacaaattatagttcaagattggtcctaagacattaattttcctgtgaaacttattacttcatgcattcatttgctgtcctaaaagtcattctgttaatctgtaaaatataagtttagataattttcatgatctgttgagaagaaagaaaaaactcccgaatctctgaacttgtcaggcaccttttagcataggagtgatggtcaatctcctctctggatgttccccttcactgtggcagcttcagaacatctgcagttatcaaggacagaagctgttccgaggaaacaaaggtcttttctactattcattttctagttcagctctgttcttttcttcctctggcagtaatggtaacagcagtagctggagcagtcttggtttagaaggagatttgtatgaggacaatttatcctttccaacatcagacaggttggtccagtctagaaacttaaaaactgatgagtctgtcaccactaatgcatgatgtcatattcttcaaagaatgtgggttacagtgccagtatgtatcaacctgcttttctcctatattttgacatgattctgcttgatgaattcacatctaatgaaaaacttcaactgtgctaagatatgactgacatctaattgcaaaatgtgtcactgttatgcatgtgttgctctgcttgctatttttcattctaccaattatttcattcaaaagagcttgcttcctacaggatttctgttgggtttttttgttatgttttatttttgtgtgtgattttattttatatataagaaaagtataggtaaaaagtgtttttactgtattaaaaatatatataaattgcatcagctaaaccattaacaaatattcctggcattttgtaatattcaaatgctacattaaattagtagactatttcaactttaaatgattttaaattgaatattatgaaattacatggcactatgtatcatggtaaggtaggatttcttggttttgataactttagggatcatttgcaattcagattttaacatgaaatgatgtgagaagcaaagcttccttttttaattgtcatttctcccctttctaaatgtcatatgtcatattgtaacattcattcattaccacatttttaagaatttgttttgataccattattaattaaattttttttgtaactgcttctgctattttattcataagtgatggaccagatgataaagatgaagagcatgaggacgaagtagaaggtaatttgatttgtttttcaaagtgttggcatgtgttttgtataaggtttcctagaagagtctttatgcattttcatcagataggctctaggttatcagtgtaaaacattataaatcagggtattcttgaactaattttgtttgtccacttttagatcctttgttgagtagttttatttgattgctacactaatgaaattgtcattggtataaagaaatactgggcaggcacggtggcttacgcctataatcccagcattttgggtggctgaggtgggtggatcgcatgaggccaggaatttgagaccagcctggccaacatggtgaaaccccatctctactgaaaatgcaaaaattagctgggcgtggtggcgggcacctgtaatcccagctatttgagaggctgaggcgcaggattcacttgaacctgggaggcagaggttgcagtgagccgagatcatgccactgcactccagcctgggtaacagagccagagactctgacttaaaaaaaaaaaaaaaaaaaaaaaaggaatactttatgagaattatttgactatttgagagagattaattacagtctctctacataattattttcaaaatacaaaagctaaaattcttactcatgttataagataatttattataactatggcatattattttcataatattttccttccaaactggtaacttgtagaaccagggtttcatgtcaaacttacgtgagtcagtaagtaatatttttacttaccttgttttctaaaagatatttctaaattaattattcttccctcccccagttccagtgcttcactcacgcatacacatatttgaagaaaatactcagatccttccttaatgaacatagttccaagtatgtcaatactagatatcactggccacagagttttggaccatagtttgtaatccttaattcatgttagagtatctgagtttattcatctgagtgaatttagaaactttactttgaagctgagttttcattatattcaggcggttgttgaatttttttctgaaagtctaatttttttcttaattttgaaaataccaataatgtcttctataaagtgcacttataaaagtatttgtactctttgagatatttgtttttgaactagtgatgttttaaaaattgcttctctagaagcaggcaaacagaaaatagctaaaaagaatttctcgaaatttactttatgacacctgaattttcagttagtttaacaccttgtttagggaagtcacatcccagtttttaagctgtaatcttcagacttaagattattattttttagttttaatgcctctgtaagtagacattctttatataaggcttctagaagtcagtttttctcatcagatataaagtcgagatggggcaatatttttagtgttattgatatttgatattgatattccccactgcaatatttgtttcattcttgttcactaaaaaagtgttgactttgtttataaaagttatgccttttctcaagtaacatctgtgaacagttattctaaaggctatacatcgtataaatgcatgtggttacgtattctctaatgaactagcgattgtttaactagctttactgaggaatgattaagaaaaaagaagatacaagttaatgtaaatatgaaatttatcttgaaaaagattacttttggcactaaccaggctgttaaggatttcttttgtagttggtagaaatcaggagattaattatatgttgatatgtcattactgagtttttgagattataggtatttctcattatatagaaagttacagccagctttaaatttgttagagattggtaaattaggagctagattggtctggatttatagaaagattcaaaattatggaaatcccaaggcaacaaacttatttttttaaaaaaataattttgtagttgcaggatgtcagtccctccccttttcactaatggttagagacttctctaaagagagagccgtttggaggttcttgtaggccaggcaaccaggagtcctgaactgagaaaacaccagcagtgcaaagaagcagtgggatgattagcttctagccccctgaactcctcaggattgcagaaaggcccagagaccatgccttgtaccatggtatgccaaacctatttttgattgagagtgttggagagaggggagggaagagacaatacatttatttttagagagtaatgtggaccaaatctttttaattaaaaattagggaccaacacaactcctaaaaataattaatagtggtctagaatggcctgcaagctgtagcagagaatcagagacatctgtcaacaaccttccattactggtacatgttggcatgatgtctgccagcatgccctggtgctcacctcttgtggtgtgtgttaaggggtggaggggtcctggtctcagcactccttattgctcaggtatcattaagcagcaggaatgttaaacgcatgatattggcccataagtcattatttctgtcaacagagatggatccctctttgtgatgaaaacataattatcataaaaaaagaaaataaatttgagataatcttgagactagaagtataccagaaaattccctgatctggcttttgggtgtaagtggttgcatatggcatttccccccacttttgtctgaagaatgagagattaagagcatggagccagactgcctgtgtaaatgtcctggctcagccacttccccactggaagactctggggctctctttgcctcagatctctcacctgtagaatggagacaataatagtttctacctcatagagtggttgtgaggattaaaggagtttgtacatataaagagcttagaacaatacttaggatggaatatgtgctgcacagatgttgctgctcttctttatttgagatttctgtttttttgtggggttttgtttgttttttgggacaaagtcttgctctgttgcccaggctgggtggtgcaatctcggatcactgcaacctctgcctcctgggttccagcgattcttgtgccacagcctcctgagtagctgggactacaggcatgtgccaccacgcctggccggattttgtatttttaatagcgctggggtttcaccatgttgggcaggctggtctcgaactcttggcctcaagcgatctgcccacgtcggcctcccagagtgctgggattacaggcctgagccaccatgcccagcctcatttttatttttattgtaatgatagctttatagttttattttctctctaacccactggtcataatttatatcaaattatggcatttatagaacttgaattcagtatgttaaaatgatgttttatatttttgcaatcaataaatgatcaaagttattcctttgttttacattattttgccctttagaagttttagttgaggttatggtgtggttagaaaaagatggatatttttttcaccattcattagaatcctaagaaccagaaaatatttgtatctacttgacaaccagagtattgagagttaaattgatgagttttactttatattgtttacatttaaatattaggtttggggcaagatggaaagacactgctaattacgaatattgacatggagccatgcacggtagacccccagctaaggattattcttcagtggctcattgcctctgaggctgaagttgcagaactttattttcatgactctgcaaataaggagtttatgctagtaagtacctaccttacagagtgtgaggatacatttaacagtatatgatgttcttgtcatgtgattggtctaacaagatgcctggtgatggttaaattcttaggctgtagtgtccaacagtttgggttcagacatcagctctgccactttctagcagtataaccagaggcaggttcaccagtctgtctcattgcccctaactgcactatgcaaatgaatatagaatctaccttacaggggtttatgaggattaaatataatgttaaaaaaaatgcttggtctaatgcctggcataacactaagctctcaaaggtagatgctattaataagcattgtgtgtgttcctatgaaaaaattgaattattctctgtatttaattgatttgtaattgtacctaatgattaatatatctgtttctctgataatccagtttcatttgtatgagcagctgtcataattaaaagccgataaaagtttaaacaagatgcttactatgtgccaagtaccttattagtcaagattttcagtttacagtcttaaggtttttgttccataattttctttatcagaactttccttttggggtggtagaaatattcgaattgtggtgttggttgcattcaacttggagaacatactaaaaaccattgactaggacactttgggtgaattgtatgttatgtgagttttatctcaataaagctgtttttaaaaaggttaagcatatatatgttacacaaaattaaagtagtttttcagaatttaacttacagatctttcaaaacttaagagcttttacagaacttagtagaaaaagaaatgaacaaaagcatgtcgtgagtggtgacaacaggatttatttaaacctgtatttatttatttatttatttgttgttttgttgttgaaacattaacattctttaacttagaaagccatgtttccattgaggctagagtgtgtattccagaaaaatgccacactatatgttgtggaaggaaaatccacatccttttattgagtttgacgttgtctttattattttatgtcctaattgagggtgtggcagttgtatttagttaggtgaagaatttcctgtagaaactcagcctctgcatgtccatgcagactatttgcttggtgaggtttgtggagctctgtctccagcgatcccaaagtgtcattctctggaggagatgtgtttataaaggggaagaagggaaaatgtttaatttgggtaaaggggtagcggtttagaggggaagaccttgttataactaggaaacggtatttaattgtaaacagcaggattcttaagtttcagctaatattgaaaataaaaataaaagctttgttataaaattgtttttggttaatgtttgacacatctttctttcttagctttcaaaacaattacaagagaaaggatggaaagtgggagacctcctgcaggctgtgcttcaatactatgaagtgatggaaaaagcttccagtgaggagagatgcaagtcgctgtttgattggctcttggaaaatgcatagagcaaaccccaaaccagtatattttagtatttgtttggggaggggaacaagccaataaagatgtttaggataaaatttgaatagtgaatattaacatcgtaagtcagttgggaggcaagtaaatatagctttctgagcgctttgtgttatcactcggtgtatatagttcatacttttgtaatctgtcaaaatactaccttcatttattcttctatacacatgtgtagtgtgtcaagaccctaagaacatgtatttgaaggaaggtctaaccagggggttttcaggggcattgtctgaccacattctttttgtatccaaatagtgctgctagaaactgcactgaagtggctgaggataggttccagtgatagagttataattttgctcctttgcaaacaaatggtatctaattaataactagtctgacatcagaaaataaaattgaggctgatttttaaaaatttctagtagatttttggcctttcctgtttttaaaaatcagtttcattttcatatttcatagatcagctattggtagctttttgatttccccaaactatttaatttcttagcagaaacattagtattttaggtttctataaacactataagtgatagtttcccccatcctttcattgacattatttgccaatgctgccagtcattctggcatgaaaggtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagtttcctaaagtttcttcaagtattttttaaggtggagaaatgcaggaattgtataaccagaattgttcctgcctttagcttttcagaacttgagatgtggcagcactggactgggtttttttaaatgttaggactaggaatgtttgctcttgttaattatgaattaattgattattaagtttagaatgcatttttacaagtatctaactatcaaattgtgtttagtaacttgagtgtatgcacaagtttgatcaacagcaaaatagagttctgaatttcttttaaagtgatgatatattattttgtgaaactttgtgtttgaaaatgtttatttctgtttatggtgtaatcattctgaggtgaggcttttcttatttcctttgcattttgctagagctgtgctgagttcagcatttgcttatttaaccactacataatgacagaccagttattaggtattagcatgtgtggtaataataatagtggaacttcacacttacatcaattcagtgcaggggcatagaataaaatattaaatattggcagatgtatgaaaagaagtgtgagttaaaaatattgaatattggcaggtgtgaaaacaagtgtcaaaattcctcatatagagaaaataattttgagtttagagtattatcttttaattaagtgtagtctaaacttaactttctgtaaaggcactttgtggtttttccaaagatgttctagatctatttggttgctctatagtcaaacagctcttttgaagacaactgtcttattttattacaaattggcttgacatatttatactgtaacattgtaatattgctgtgctgtacattttggcccttacgaaatacgtctttttcagaactgttaaagttttgatgtacatcgagctgaattctgtttttaccagtttcaaaaccttcaagtgatatgtggaaaaaagtgaatgagacctctgatagggggttttcagaaccttgttcacaccaaaatgtgacagttctttcatgttttcctaaaccaagttaaaattacatgtatattttggtgttaaggttgatttttaagatacttctgatttgtacaaaaggaatgtttcctttataaatcacagaagaaaatgacaatatctgttggatatttgatataatttaatggtgttataaaacctttaagaggattcatggtgaatatatgtgataacatctttatactttgaaaaatgttccacttacccttcagatatttgttgtaagttaattcaattcttaatactttaattttgctccaacaagggctttatgttgctggtaagagaatttatttactaaatgcactatgtataaagtgaaagatagtttacttatctgactttgatattagatggctgacattagtgcacataatgcagagtttaaccttgattcttcaacagagtccagatttaaatgtctacttagttaattagttagctgatattcttccacaattaatatattcaatttcccatcagtatatcactttaaattttatgtttttctaaggaaactttccacagaattttaaacaactgatgcatccatactcagggtgtagggagaatactttgcatttaaaaaccctgtccacctgtcaccagcacaagagaattagagcttcagtgagaatttagaaaaattatactaaagtgagatgcattttttctcattttcagcaagactcctctaagcatttactcatttactgtattcctgctctgaagatgtggatacagaattagtcactcttgtcactttatttatttattggtttttttttaaccatctgtgtacattcctttcatagggtagagttctagttctagaagttcttattttgtttttgttgtaatgtttgaatactatttaatatccggttttaatattgctggatttgctacctttggttacttgtgcagtgttaaaagtaatccactttcttgtttaatataccagatacatagcaaaagcagcttggaataattatagctgtttatttggctgtgctcagttactatattaagatcttgtactgtgtaacagtaactcttttttgcttttcagtaatttaatatgttcacttaacaaaatacgaactttgagatgcactaaagttttgtttcagcagtggctcaaaaaatttcagaaattacttttgtaattatttgcaattaattgttcttttatcttacaattgtttaagcctgtgatctttcttctcccagctaagagttcttcaataaatttaagaaatacctgg

SEQ ID NO: 36352 - DNA, 27879 bp, Homo sapiens
agagaaagtgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcaggtagtgtatttaagctattatggtgttaggtttatttatccttttgaaagagtgtgtgacgttggagggaagctcattaatttactggaaatcattgtatgggagataactcaaggtaagttttctgtttcgtccaaatgagcttctttgaaatattaaagccaaaatgaatgatattagagcaatcaaatgatcactatgcggttaacagggagaggcaacccatcaaataacacaaccgagtccagggattcatgccacttgcttaatacacaaatgcacacttttaaaaagtgtggctcatatggttcacatttttccttttgtcttgttggttttaggtttctagctctatactttctaatccatttctacccctaccgttgtacccagaatccagccttctagtgaatggaacagggtttattcgttcaaacattattgaaccagctaagggacgggattctaaggcctctaatgaataaggcagagttctgcactcaagaaataaggaagatgaacattttaggagagttcagagttgccagttagtaactgcctttgggagtcaggcttcacattgcagataacatttgactttgttcttgaataagattccacgaggccaggaaatggcacaccagaatgcacaacacaaagtaaaagtgcactgaggcaggaaagtacaaaaaagtacaggacattgcctaaattgtggaactgggtttgggaaatcgtgctgagaaaggctgtgactaaattagtaagattttctttaattactatgggaaaagagtttaaagtttgtcctgtaagtaatggagggtaagttctaaaaaatttccctgtttctctgcatgagtaaaacacatgtaagtttttctcttttttcttttttcttcttttttttaattgagatagttgggggtcgggggggctgtctcactatgttggccaggctggtcttgaactcctggcctcaggtgattctccccctccttggcctcccaaagtactgggaattataagtgtgaaccaccccacctggcctaagcttttttgtttgtttgtttgtttttaacttttgtaacaactagaaaacaagtaaaatgaccaatatcaggaataacaatgtcaggaatatagtgaaattcttcattctgtcagtgatgatgaatttaggggattctgttttgaaatttaagcaactgaacttctcagcttctgtgctaccttggaaattcacagtagagtaaatgtccaggtatgtggtggtggtaggaggtgtcacaactacactattttcctgcaatcttattctcacagacatctaaccttatgtacacctcctcaaactgctaatgagtgagccactattactggtgaaatgatggtgatagtactttttcctcagttgtttggttgagagataattgctttgcacccaggtagatttgtctcagtgttctggggttccactcctgctttatgaataattcactgctggccgggcacagtggctcacacctgtaatcccagcactttgggaggctgaggtgggaggatcacttgaggtcaggagtttgagaccagcctggccagcatggcgaaaccccatttttgagactctgtctcaaaaataaataaataaataaaataaaaaataagtcacgactgggcacagtggctcacacctgttatcccagcactttgggagtctgaggtgggaggactgcttgagctgaggaggtagagccagcttgggcaatacagcaagacctcatctctactaaaaattaaaaaaaaaaaaaaaatagctgggtgttttgcgaaggcctgtaaccctagctactcaggaggctgaggcaggaggattgcttcagcccgggagattgtggcttcagtgagctatgatccaatcattgcaccccagcctggtcaacagagtgcaaccctgtcttaaaattatatatatgtattttttatatggagtctccctctgacactagactggagtgcagtggcaggacctcagctcactgcgatttccacttctctagttcaagccattctcctgcctcagcctcctgagtagtgggattacaggcatgtgccaccacacccagctaatttttgtatttttagtacagacaaggtttcactgtgttggccaggatggtctcgatctcctgatcttgtgatccgcccacctcggcctcccaaagtgttgggattacaggcgtaagccactgcgcccagccaaaataaattaattaattaaaaataaaattaaaataaagaagtcaaggctggtgcagtggctcacgcctgtaatcccagcactttgggaggctgaggtggacagatcacctgagatcaggagtttgagaccaacctggccaacatggcaaaaccccttctctattaaaaatacaaaaattaggtggaagtggtggcattcacttgtaatcccagctactcaggaggctgggtggggagaatcgcttgaacccaggaagcagaggttgcagtgaaccgagatcgcaccattgcattccagtctaggcggcagagcaaggctccatctcaaaaaaaaaaaaagaataagtcagtgtaaattaaaatccagtggcataattttgatccattagggaacagttgtggctaagggagtataaatataataactcttgaactcataacattattctctggaatgatgttttaccaatcactcttacattaagagaaagttccaatttagctaattagcaatttagtttccatggcctcttaaaccttgatttcactgaggctttctcatcttaagtaacatcatctccttaatcctctgtggtgatataaacagcagtctcaggacaaaatgaaaagcagacacataaaaagcaacaaactggctgggcgcgttggctcacgcctgtaatcccaacactttgggaggccaaggcaggaggatcacaaggtcaggagatcaagaccatcctggccaacatggtgaaaccttgtctcttctaaaaatacaaaaattagcccggtgtgatggcatgcacctgtagtctcagctactcaggaggctgaggcaggggaatcgcttcaacctgggaggcggaggttgcagtgagctgagatcgcgccactgcactccagcctgggcgacagagaaagactccatctcaaaaaagaaaaaagcaacaaactgataacagacagtatgcattcacagagtatttctaggcagtgaattgttattattattattattattattattattattattattattattattctgagatggagtctcgctctgtcgcccagggtagagtgcagtggtatgatctcagctcactgcaacttccccctccagggctcaagctattctgctgcctcagcctccctagtagctgggattataagcgtgtgccaccatgcctggctaatttttgtatttttggtagagatggggtttcgccatgttggccaggctggtcttgaactcctgacctcaagtgatctgctcacctcggcttcccaaagtgctgggattacaagtgtgagccactgtgcctggctgtcacttgttattttgaattgcccctttttttttttttcctgtggaatttgaactttgttctgcagtagattctataactagcttactttttaattcaactgtttatatctgtagtggactgctgtttctggttcaaacattttagttgaaagttagaattcctatagtttcattctcctttttatgactgaacataccacatttataacattgttctttctggaacttattaataggataagaaaaaccagtggttttgaaaaagttatatagcacaggaagaattatatgatggaaatataattgcttaggtgattaaagaggagctaaacactgaggcaatgtttagaaaatctgagtattaaaaggaagcgtaattgttttctttttttaattctaaaatatgttctggccaggtgcagcggctcacacctgtaatcctagcactttgggaggctgaggtgggcagattgcttgagctcagaagttcaagaccactctgggcaacatggtgaaaccccagctctactaaaaatacaaaaaattagccgggtgtggtggcgcatacctgtgatcccagctactcagggaggctaaggcactagaatcacttgaactggggaggtggaggctgcagtaagccgagatcacaccactgcactccagcctgggtgacagagcaagactgcatctccaaaaatataaataaataaaaaataaatgaaatactatctgtaattaacagttttgattgttacagataaatggagatggaatatattgggtagatagataatgtaaatgagtcatctgagttggaggggacagagataatttgagaaatccatgcccctctaaaggtgaggagcgtcaactctagtaagttgtagttttgtgacaataggatcccaagattgctagatcttctttttttgttgttgttgagacagagtctcactttgttgcccaggctggaatgcagtggtgcgatctctgctcactgcaagctccacctccagggttcacaccattctcctgcctcagcctcccgagtagctgggactacaggcgcccaccaccatgccctgctaattttttgtatttttagtagagacagggttgcaccatgttagccaggatggtctcaatcccctgaccttgtgatctgcctgcctcggcctcccaaagtgcttggattacaggtgggagccaccatgcccggcaagattgctagatcttaggcatattcaagagaaactagaaattccttttttatttcctaattttacaaacacttcttaggctcatataaaaacatgtctttagctgagcacagtggcacgcatctgtagttcctgccacttgacaggctgagatgggaagatcatttgaggccaggagttcgaggctgcaatgcgttataatagtgtctgtgaataaccactgcactgcagcctgggcaacatagcaagacccatctttaaaaaaatctgtctcatctatcatctctctatctgtcatctatctaatctatgtcttcaggccagatctagcctgtaaactggtaattgaggccctctcctctagcagcagtagtaacaattagaagtgattggaatagggagcagtgtatttgggtttaggagcagggagcaagacggtttaatgacagagaaggaagctaaagatattagagtttataaatcagtttgtttataaataggcacgcacatacaggaataaatgagagaaagtgttgctttgaaaaagttgatgctataagtatgaatctaaccaaactaatgacaataaaaacagtatttgtaagacattgatgctttatttatttatttatttatttatttatttattttttgagacggagttttgcacttgtcacccaggctggagtgcagtggcgtgatctcggctcactgcaacttctgcctcccaggttcaagcgattctcctgcctcagcctcccaagtagctgggattacaggcacacgccacaatgcccacctaattttttttgtatttttagtagagatggggtttcaccatgttggtcaggctggtctcgaactcctgacctcaggtgatccgcccacctcagcttcccaaagtgctgggattacaagcatgagccaccgtgcccagcgacattgatgctttaaattagaaagcaggactattaattcctacctgatgacaaatttctttgtcctgctttcagaacacataatttatatgactcaaaatgcctgttagaatttggaaaagactaattgacccatttctagatagaccaggtattcttacataggctataatacattctttagcattcatgtctaggcttaaaatgttaccctacattctcagaaaaacaaactgtattccttttttatttttttgagacagcgtcttgccatgtcatccaggctggagtgtagtggcacaatctcggctcgctgcaacctctgcctcctggattcaagcgattctcatgcctcagattcccaagtagctgggattacaggcatgtgccaccatgcctggttactttttgtatttttagtagagacagggtttcaccatgttggcaaggctggtcttgaactcctgacctcaagtgatccacctgcctctgacttccaaagtgctgggattacaggcatgagccaccacgcccagcctatttattctcattaaagtaatctccctataatttattgaataaaatgaattctttaggaagacacaccaagtttgtttatcctgtgcatttgaatttcctttggcatatcaccatatggggagacagaggtgagaagggggaatacaagtagtcagtttaaagaagtgagggagccaggcacggtggctcatgcctgtaatcccagcactttgggaggccgaggtgggtggatcacctgaggtcaggagttcaagaccagcctgaccaacatggagaaaccccgtctctactaaaaatacaaaaattagctggggtagtggtgcatgcctataatcccagctacttgggaggctgaggcaggagaatcacttgaacctgggaggtggaggttgcggtgagctgagattgtgccattgcactccagcctgggcaaaaagagcgaaactcagtctcaaaaaaaaaaaaaaaaggaagtgtgggaaaatatctatgttccagacctcatggttggagctaaaatatgaaccttttttctcagtggtgtccagttgatagaaaagagagcttacttgctgtgggtgtatctgagtatctggatgacataatggaaaacatttcttgctttagaactagaccgcagtttgaatgccatttctggcactttctggcttgtgattctgtttccttgtatataaagtaggagtaataatgcctatcttggaaagtgattttgggatttaaatgagatgtcctctgttttttcccagatcttataatagacactcaggtgcgagctattgtacctttattggttactaatgaattgttacatgctcttaatttctgcattcgtgaaagcactggacaagatcttgcagccacttcagaatatttagtctgttttttaggtctttactcggaaatcatgtttatgaaacttgaacatcagctttgatatcttgatcatacatttatataccatgtatgcttaagtttataaaatacacaaatcaaaattaaccaaaatattaataatgaaatatttccatatttttggtaataatgataaaatacataaatcaaaattaaccaaaatgttaataatgaaatatttccatgtttttggtagtaatgtttctttatggttgttggcataacaggctatggatgtctctagcatcaaagcaatgttaataagtctaataagactactggctatcatctatcaacattggtctgatttgtgataattgtgttcataaaacttcttaatatatttcctggcctctctgaactattggctttttcattcttctgcatgtgcgagagatggaaaccctttgaattagggctttgtgactgacccattgtcactacttccttctttttatgtattttctcctcaaagcacaaagaaattagaaatatccttgtctgggtaccgtggctcacacctgtaatctcaacattttgggaggctgaggcaaaaggatcacttgagcctaggaggtcaaggctgcagtgagccaagtttgcaccactgcactgcagcttgggtgacagagtgagaccctgtctcaaaaaaagaaaaaaagaaataatcttatctgcaaacattgctgaaacctgtgtagtttcttcttcttttttctcttggtattggtatcaaggaatttaaattttagatggactgtgtttattaaaattggtagactatgctaaacaaatttacaattcttttgcctagaaaaatggaactacttaagtcttatataactggaaaacttttacttttcgcttaacattaattggaattttggtgacagtgaaaattatttttttttcagggcttgttaaacaactgttttaaaacagatgatgaccaaaaccctgctcaatgagaatagtattgtacgtgaaactctaaagaagtcattattcatctcattttgcagatggaattaagaatgcaaaaatagtggacatgccaagtgaatgctgttaataatatgtaaaattatttgattaaacatttattacttaaaaaaaagtggacattagcctcacttataaggataatgttattaatacattattgttcattcctttcgaaccagattccaaaatgctagaaattatgttaagatgttattttatactgggcgtggtggctcacacccgtgatcctggctctttgggaggccaaggcagacagatcatttgaggtcaggagttcgagaccagcctggctaacatggtgaaaccccgtctctactgaaaatacaaaaattagctgggtaaagtggcacacatgcctgtaatctcagctactacagaggccgaggcaggagaatcacttgaacccgagaggtggaggttgcagtaagctgagattgcaccactgcacaccagcctgacaagagtgagactccgtctcaaaaaaaaaaaaaaaaaaaaaaaaaaaaatatatatatatatatatatatatatatatatacctttatgtaggcagtgtaaaattatgaaaagaatgtaagactcaacttcaggaggttgagattcaagttctgcctctgcctctgcctcttagtgatttttacctttggtaaatatttaagtattctgagtttcttttcctcgtctgtatttaataataacacatgcttagcctatcctgtttgctatgagaatcaaatgagataacatataagaaaggaatatttaaataccaaggcgaaattgatctaaacaaataatgctgtctttctgcctcgtaagtgaggttcaaactgtagtgatcaccttcagtgagcacagcagcaagagcaagattcaatctaaggaaaaaccctgactgaagaatattctaattgtttttgagaagaggtgacttagggtccttgatcagttgtgccacatacaccataaaataaaaagtaaaagcatctaaaatggagcacaagtctagaatgtttgagctataatgcaaggattttctagccaaatcttcttttacagatgaagaaactgagacagggttatctaataagttttctagtggcaaactgaaatgcaattctcagggtggttaatgagatacaagttttgaaattagttgtacttataaggtgtgaaatcacaattttaccactgacttagaatgtaacttggacagcttgacttccctaagccttagtttgttcacctgtaaatttgggctggtgaagtaaaggatctattgggctgtagaagtaaaggagttgatacatgtaaaatgcttagcatatttttgtcacgttgtatgcactcaataaatgatacctccattattactattatttttagctgtttagcagaatcttccagaccattatttactccctccactaaatttgttcaaggtgatagctaatggctcaactatctttcactgaaacaacccagacagtactcttcatgggtcctcattctgcacctacgagtgtgagcaaatgccttttatatcatattattgagatgagaaggttattcttaaacagattgaaagcattagaaagtttaaaaatataaggtagaaaatctgatgtaaataatcacctgttgtcaaatttaataaagaactgaaaaggcttgggtatataagaaatgtaactgatggatcttaggggatatgaaaatcatttcccacccctagcactttccttgaataaagtgacatgataggcttttgttcattcaactcagttgtacactaaatgtaatgtctcaccaccccctgcctttttggttgttgttgtcacctattttgggtctctacgtttaagagtcaggactgttttgttcatttgctgtgcctggtacaatgccttgaatataataaagaggtacctaaatgttgactttttttttttttttttttttttagacaaggtctcactctattggccatgccagagtgcagtggtacaatcacagctcactgcagcctccacttcctgggctcaggtagtcctcagcctcccaggtggctgggactacagatgtgcaccaccaagcctggctaatttcttattttttgtagggatagggtcccactatgttgcccaggctggtcttgaatttctgagttcaagtaatcctcccaccttggcctcccaaagtgctaggattacaggcatgagcacctgtacttggctaattttttaaataacattttaattgaaagttattgtatatagaattatttagtatcaatgaaattatgtaattttaaaaattaattatagatttaaaacattttcagatttcctttttttctggggaactgtatttttaataacaacaacattggttgcccttctgaaaaaagaaaacgaagtatcagtagtaaaagaagaaacacaagggatcacagatacttacaagctgctttttgcaattataaaaatgccagcagttctgacattttgccttctgattctaactgcaaaggtaagagatttataaatcaaatttatcattttcttataagtatcaatatcatggaatacttacaatgcctttttcatatcacaggtccctttccactaccattagaatttaacaatgaaaaacaatattttctgtttattaaatgtatttgaaaagatgtaatgatatcaactttaattttaaagtaagctaaatgtcttggagtattgtaaagaattatgtccattggagaactgttagtaaatgtgaaccttaatgatattaatgcttggaatggagattaatatctttaaaaatcaatagctctgtcttcttataatgagtatacatttaatgttgtagtaatacaattatttactaagagtgtgacgtaaaaagatatagggccaggtgtggtggctcaagcctgtaatctcagcactttgggaggccgaggcaggtggattaccggaggtcaggagttcaagaccagcctggctaacatggtgaaaccttgtctctactaaaaatacaagaatcagccggtcatggtggcacgtgcctttagtcccagctacttgggagactgaggcaggagaatcacttgaacccaggacgtagaggttgcagtgagccgagatagcaccacggcactctagctggagcgacagagcgagactctgtctcaaaataataaataaataaataaataaataaaaagatatagaagtatatgagtattagaagtcaattttttaaaaatccattgaattatttaagtactgaaaggaaaattatacgagaaacggggattactggtgacttttattctatattaaggtgtctcaattttatagttctaaaaatatttttaacatgttaggctagaataaggtaagtatattttgttacagtgaactattgctagtgttggagttaatatttctgaaatctgcaatcttataggattttcattttatatacttaaatctatgtatataaacactttgcacctatcttttgacagttttgaaggaaccattagcctcattgttttcattttaaatagtgagtgttttttcctcttaatgatagaaagaaggccagatgtgctggctcatgcctgtgatcccagcactttgggaagccaaggtaggaggatctcttgagctcaggagttcaagaccagcctgaatatggcaaaacaaaaaataaaaaaactatctgggtatggtggcatgtgcctggagtgctagctgcttgggaagctgaagtaggaagacagcttgagcctgggaggtggagtttgcagtgagccatggctatgcctctgcactccagcctgggcaacagagccaggggtctgtctttctcttgagacaggggtctcaagaaaaaaaaaaagaatggaaagttcagaaaatatgaaaagttcaaggagcataacaatatatatatatattttttttgagacaaagtctcgctctgtcacccaggctgggagcagtggcacaatctcagctcactgcaacctctgcctcctgggttcaagcgattctcctgcctcagtctcccgggcagctgggaccacagtgtgcaccaccatgcccagctaatttttttgtatttgtttattttgagatggagtttcactcttattgcccaggctggagtgcaatggccctatctcggcttactgcaacctccacctcccgggttcaagcggttctcctgcctcagcctcccaagtagctgggattacaggcacatgccaccaggcccagctaattttgtatttttagtagagatggggtttctccatgtaggtcaggctggtcttgaactcctgacctcaggtgatctatccttggcctcccaaagtgctgggattacaggcatgagccaccgcgcctggcaatttttttgtacttttaatgaagagagggtttcaccctgttgaccaggccgttcttgaactactgacctcaggtgatccacccacctggccaaacaatattatctaattatatgatttaataatttttcatttaagataaacagtatttgctggaggtggtggctcacgcctttaatcccagcactttgggaggccaaggtgggctgatcacttgaggccaggagttcgagaccagcctggccaacatggtgaaaccccgtctttactaaaaatacaaaaattagctgggtgtggtgccaggcgcctgtaagcccagctactcgggaggatgaggcaggagaatcgctggaacccgggaggcggaggttgcagtgagccgagatcacgcactgcactccagcctgggtgacagagtgagactccatccccaaaataaataaataaattaattaaaaaaaaacagtattgaccttcttggtatatttcctttgaaactcccttttttccctatatatgtgtgtgtgcatgtatgtgtgtatacgtatacttcatatatttatttactcatatactttattttattttattttgagactgagtctcactctgttgcctaggctggagtacagtggcgcgatctctgctcactgcaacctctgcctcccttgttcaaacaattctgcctcagcctcccgagtagctgggattacaggcacacaccatcatacccagctaagttttgtattcttagaagagacggggtttcactatgtcggccaggctggtctcaaactcctgacctcaagtgatccacctgcctagactcccgaagtcctgggattacatgtgtgagccaccatgcccggcctacttatttatttactttaaaagtgaaattgaatcatatataattttttatcttctctttgtcttataccaaacatttctatagcattacatatttgaaaacatacttgttagtagctacatgatatagttagtgtgttaaatttaaattttccgtaatctcatttttctgttgtctattttgcttatgtttttaaattataaaaatgcactagcaaatatttttgtgcataagtctgtgattttctggatatttccttccagtagactttttttttttttttttttttttttgagacagagtctcgctttgttgcccaggctggagtgaaatggttaatttttttttttttttttttttttttttgaggcggagtttcacttgtttcccaggctggagtgcaatggcatgatcttggctcactgcatcctctgcctcctggattcaagcgattttcctgcctcagcctcctgagtagctgggactacaggcatgcaccaccatgcctggctaattatttttattttcatttttatttttagtagagatggggtttctccatgttgatcaggctggtgtcaaactcccgacttcaggtgatctgcccgtctcggcctcccaaagtgctgggattacaggtgtgagccactgcacctggcctaatttttgtatttttagtagagacagagtttcaccatgttggccaggctggtcttgaactactgacctcaggtgggtgatctgttcacctcagcctcccaaagtgctagtattacaggcgtgagccaccgcacccggcctattttttattttttttaagatgaggtcttgctctgtcgtctagactggagtgctgtggcatggtcataactcagtgtaatctcaaactcctgtgcttaagccagactcccacctcagcctctcaagtagttagaactatagctgcttgccacctcacccagctaattttttttttttttttttttgagacagagtctctctctgttgcccaagctggagtgcagtggtgggatctctgctcactgcaacctcctcctcccgggttcaagcaattctcctgcctcagcctccggagtagctgggattacaggtgtgcaccaccacacccggctaatttttgtatttttggtagagacagggttttaccattttggtcaggctggtctcgaactcctgagctcaggcaatctgcccgcctttgcctcccaaagtgctgggattataggcgtgagccaccacgcctgacccacccagctaatttttacattttctgtagagatgggggtctcattttgctatacaggctggccaatagattttttttttttaagtttttttttttgagatggatttttgctcttgttgcccaggctggagtgcaatggcatgatctcagctcaccacaacccctgcctccggggttcaagagattctcctgcctcagcctcccaagtagctgggattacaggcgtgcaccaccatgcccggctaattttgtatttttagtagggacagggtttctccatgtttgtcaggctagtctcgaactcccgacctcaggtgatctgcccacctcggccttcccaaagtgctgggattacaggtgtgagccactgcacctggccagccaatagattattaagcaggcaattagtgggtcaatgaatgtaatatgattgctgaattgcttttcaaaaggttatactaatttatactgtctccagcaatatataaggaggtacttcaattacaaagtctataatactgttttcttcttttaaacttcccccctaataacatatctcctaacttttaatactacagattaattttctttccttttgaattatatattaatggactatacaatatatatttttatgtttgatgcatatgttcttttgcttaatattatatttgtggaatttatccatatttttatttatagcaatagtttgtttatctcattactgtatagtattccgttgtatggatatgccacaatttatccattctatcaacagatttttagagctattatgtgtagtgtttctacaaacattcacatacgtgacttttggtgaagataggtgcacatttctcattggtaaatatataggaatagaattgctggttcatagaagatgcatagtattttgtactgccaaatagttttccaaagtggttgttccaattttccctaccaccagcagtgtaagagagttctgattttaaggagtttcacatccttgaaaacacatatattatctttttttttttttttttttttgagacggagtctcgctctgtcccccaggctggagtgcagtggcgcgatctcggctcactgcaagctctgcctcctgggttcacaccattctcctgcctcagcctcccaagtagctgggactacaggcacccaccaccacgcccagctaattttgtgtatttttagtagagacggggtttcacctagccaggatggtctcgatctcctgaccttgtgatccacccaccttggcctcccaaagtgctaggattacaggcgtgagccactgcacctggtgtatatcatctttttaattttagcctttctggtggttgtgtaatggcatcttgttattgccataatttgaatttccctaatgacaaaagaaattgagcatcttttcatgtgattattgaccatttgaatatccaaagttgcccttttctttaaatttgtaaagttgttgtttctgtttagatttcgttgtttgagatgaggtctctgtcacctaggctggagtgcagtggcaccatcacagctcattgcagccctgacctcctgggctcaagtgatcctccaacctcagtcacccaagtacaggcatgtgccaccaccacgcccagtaaattaaaaaaaatattttgtagaaaagagttcttactatgatgtccagactggtcttgagcttctgggctgaagcaatcctcccgcctcatcctcccaaagtgctgtgcttacaggcatgagccactgtgccagaccaaactttttaaaatatattttgaatttgagtcttttattagatatgtgtattacaaatatctcctactatataacttttaagacttttttaacattttaagattaaacattaaagtcagtttgtatgtcttatttttacaaagggaatgagtaaaatgtaagtgaaattattttctggacttaagtgaaatatatgttacctttaattttttttatggtgaaattttctttggctctattccaagaagttaccgtgtatactatttataatttttctttctttctttttttctttctttcctttttttttttttttttttttttttttttttttgacagagtctcactctgtcaccaggctggagtgcagtggcgcgatcttggctcactgcaacttccacctcccaggttcaagcgattctgctgcctcagcctcctgagtagctgggactacaggcgtataccaccacacctggctagtttttgtatttttagtggagatggggtttcaccatgttggccaggatggtctcaaatctcctgacctcgtgatccacccaccttggcctcccaaagtgctggaattacaggcatgagccaccgcgtctggccttataatttctttaaaaaaaaaaaaattgtgtgatattgaagtggccttgtggtctagggtagtacctgaggtttgctgtctcacagccacagagatcaaggacgtggacacacaaagagtgaggttaacagcagaagtttagtaggtgagagagagaatagctctgtgctacagagaggtgtcctggaaaaatgtgttgccagatctgtggtgaaatgcaaggggttttttagatgagctagtggggaggcagtgtctgttttaaatagggcatgaaaaaccggtaaggtccaggtgcaccatttatatagggcatgaatttctggcagcccccaccctaattttttatcatgcaggcaggttctctgcctgagctgcaccatgttgcccatttttttactgtacacatgctaacaaaaaagagaaggtggagctttcatggtggacatgcctggctcccaggtagcccttttctgttggttcagctgctggcattcccccgtgcaagcttccagcttgcttatctatgtttgcaactcaagtttttcaggctgctcttcgttagaaaagaaatgattttgggggccgctttttgttagaagggaagctctgccgaggtctcttttgccctcactatctgcctaaataatttctttctgcctactgtatcgatataacttcacacttcttgaaaatgtattagtagaactcctttatatcctttatccagattatctaattattaacgtttagctacactttccttattctgtagatgttctctttctatgtatatccattacatatgtcttctgaaatactttagagtaatttgtacacattatgcacttttatccataagtaccttaagtatgtatttcctaagaacaagttttctgcttacaaaaccacaactcaatattgggaaattttaaattgatataatattattgtctaattatagtccatatccaaattttacacaataacagtccttataactttaatttttttcttgttggggatctaatctaggatcacacattgcattcagttggtatggcctttcattgtccttaatatccttgacatttttgaagaatacaggccaattatgctgtagaatgggcttctagttacatttctctcatgtttcttcttgtttgggttgaggttattcaggtatataagacaggaagatcaaagaagtaatgttttgatgtctgcagggaattatactgaaagccatatcatgtctctttatccctttaactgctgtttttaactttaattgctttgctaatctattgtaaaagtactattttttcttttgtaattaaaaactgactcatggggagatactttgaggctatctaaataatcttaatttaattcttactcttttttgtgctgttttaaagaattaatctaactatactttatccctttcattttattcaatctctcagatacgttttcccagaattacttttgaaacattagatgaacttaggaaattttattatggtcagtcagaaatcattaaaaatgtatatatatattggcagttatgcttcattttaaccagattgatttgggtcaattaaaggcttaagttcttttaaacctaaaactttcaaattggtaaatttggatttttgaccccgtttactataacacattggactttttgaagtggaaatttagttgtatttatagccatctaccatccctaccagtactgaattttcagttgttttcacttaatattattagaaaaccataaggcaaaatgtacctcgtataacttgactgttgtaccaggtataataatatgatgctcacttgtaactgtcatgggtcagtaataaaattgaggttcttgaagaacttacatatgcatggaggaaaatatttcataagtcacgaattaaaatacttttttgtttttatattgcagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacaggtaaaaatgaaataaaaccttactaaataagaaagggtaaaatgaggaacattcatcaataccactaatatctgagcgtagaattatatatatggaaaaagatttgaaaagcatcttttttcaatattatttatatgcacttttatctttttaacctcctaacaggtttagatacagcttctttcatatggtaggcacacggatttctgtttttgttgttgttgttatttaagctaaaatggaagtcaactcaatgtttctttctctatagattattgcttgggttagaatatgccctactggtttggtggactcctaaagtagaacatcaagggggattccctatatattactatatcgtagtcctgctgagttatgctttacatcaggtaagcttgcagtggttttctcaggaaataaactgttctgtgtaaaataaggaagacagctttctacagttgtcttaaaataatgataataaattttaagcatgaatctgacactgaagaaattattgatggtgcgctttaaactttatgacttttcacttaatgagttctgctgttcatagaaagagacttttttatttatttatttatttttttcccaagatgaagtcttgctctgtcacccaggctggggtgcagtggtgcagtctcggctcactgcaacctccacctcctaggttcaagcatttctcctgcctcagcctcctgagtagctaggattacaggcacgtgccaccacgcctggctaatttttgtatttttagtagagatagggttccactatattggccaggctggtcttgactcctgactttgtgatccacctgtctcagcctcccaaaatgctgggaatgcaggtgcaagccactgcgcccggctgaaagagactttcttattcattcattcattaaaaaaaaaattattcaacaagtatttgttacattttagaattgattccaaagccagcaaattctactcttgctaaatatttctcagtttatccctaggtttcagttcattctttcttgaattcctaatatcttttctttctgaaagtattgagaaatagtattggtcttagtttctggcttagcttctgctttttttttttttttttttttttttgagacagagtctggcttgcttgcccactgcccacgcccggctaattatctgtatttttagtagagacagagtttcaccatattggccaggctggtcttgaattcctgacctcaagtgatccgcccacctcggcctcccaaagtgctgggattacaggcatgagccaccatacccggccctggcttagcttctatattgaaagttttgacttattctttatgattttgaaagctgtgtcaagctgctttttctttctttgttaaatatgtttgtaatccttaaaagaaggaatccccactttgctctagcctaagctgctgttgcagaatgagattttttttttttgagacagagttttgttcttgttgcccaggctggagtgcaatggcacgatctcaggtcaccgcaacctccgcctccagggttcaagcaattctcctgcctcagcctccaagtagctgggattacaggcatgtaccaccatgcccggctcattttgtatttttttagtagagacggggtttctccatgttggttaggctggtctagaactcccaacctcaggtgatccacccgcctcagcctcccagagtgctgggattacaggcatgagccaccgcgcctggcccagaatgagatttttttgttctggatgcaagtgattcaagtaaatggcaaaggcccagaagtaacctttgggacttaactgcagttattgctaatgcatatttctgagtcactttggatttttctagcttatatcctttgaaagttatatttgctaatgtatgaattaatttttaactgaaacgtaaaaatatgactaccaggtaatctcagtagttttgtgcatacagtaaatcatttaggagaaatctgtagtggatcctgtcagactaaattctatgcttataaaattattgaggccaaactgtcaaatataatttttttttctgttttgcacatgcttagttaaggctagatatgtaatagaaggttaaagaaatactttaactagtcaatgcttcagtatttctgtcggtatgttatagcccaaaaaaagtatttatttagctttggatttcatttgagaatttcctgaagtgtaatcactgaaactcagataaccagatgctttatgggggaaaaaaggtacaagaccaaataaattcgagaaatgatgtatgacataagccttctgtaagtagtgccttaatgattccttcaacaaattttttttttttttttttttttttttttttttttgagacagagtctcactctgttgcccaggctggagtgcagtggcacaatctcggctcactgtgatacctccacctcccgggttcaagtgattctcctgcttctgcctcccaagtagctgggattacagatgagcaccacctcacccagctgatttttgtatttttagtagagacgggttttaccacattggccaggctggtcttgaactcctgacctcaggtgatccgcccacctcggccttccaaagtgctgggattataggtgtgagccaccgcacccagcttcttcaacaaatattaagtgaacacctattccctgccagaaaccattctgagtactgaaatataacttaataaatcatgcccaaatccctgccctcaaggagtgtatgttgtaaatatttcaaaaggcatacaatgaaaggaaccttttcaattttgtgtaagttagtgtctttcagtcttatttgactttggaactcctttttctgtgaacacccccaaaaacactattcaaaggaataccattattgaaacacagtttgtttccatctttctaaattaaaggttaattcttgccttttaagtactttttgcctcttaaggatgtttttctccagtttgtcacataaattttgaaatacttttcttgtgtatatgtaggagaaaaatatatatattcctatttctttaaatatttgagtatttatatatgtaataaatgcatacatataaatatgtatatatacacatgcaatatatgatacatatttaggtacagtacaaatatgaggttttgcattttgctgtatgcattatgtatcctttagtgccacctcatctaacattttctccgtggagtctttcttgactacttgtggtagaattaatctctcatttatctttatgccccagtaacacaatgtgtgcacttctatttacagtacttcctgtatttataattatttattccccattttccagcctagaataaattcttcaatgtcacagaaggaccaaggtcacatctttgtattgctgggatctttttttttatttatttatttttatttatttattttttttgagactgagtctccctctgtcgcccaggctggagtgcagtggtgcgatctcagctcactgcaagctccgcctcccgggttcacgccattctcctgcctcagcctcccaagtagctgggactacaggcgcctgccaccacatccggctattttttttttttttttgtatttttcagtagagacagggtttcaccgtgttagccaggatggtctcgatctcctgaccttgtgatccgcccgccttggcctcccaaagtgctggaattacaggcatgagccaccgcgcccggcctgtattgctgtgatcttaaagcctggcctatagtaggtgcttgataagtatttgttgaattgagttcaataaataccatgaaaattaatttcaggtttatgactttgatgttcttaatttagactgtagctttataagctttataatcatactaaagatgttttacatttttccgtaggttacagtgtacagcatgtatgtttctataatggctttcaatgcaaaggttagtgatccacttattggaggaacatacatgacccttttaaataccgtgtccaatctgggaggaaactggccttctacagtagctctttggcttgtagatcccctcacagtaaaagagtgtgtaggagcatcaaaccagaattgtcgaacacctgatgctgttgaggtaagtatgttttaattttagataacattaagctaatactaagatattaatatctttgttttgtctctagaagtactatatcttttttaaaaatcatatctgtccataggttctggtttagaaatctacatatatattttctttcacatcaaggctgagggttataatcattcaaatcagcaagactagttcccttaaaggcgtttctcagtaaaggagaggcgatctctctttcccccaccttgacgatcactgtcctacacagcaggcactatataaatgcataattaatagcttaagttttgtagtgatagaaaaagggaatgtccattggctattcctataacagtgataactaaacctgtatagtgagtggtttgttgataaattctttcaaagtggtatttgtctacttctagagtagatggactggaaatttcttcacatttccgaatgtgaaagctgcatcgtgaaaatagataatcgggccaggtgcagtggctcacgcctgtattcttagcactttgggaggctaaggcgggtggattgcctgagctcaggagtttgacaccagcctgggcaacacggtgaaaccccatctctactaaaatacaaaaaattagccgggcggggtggtgtgtgcctgtagtcccaactactcaggaggctgagacaggagaattgctagaactgggaggcggaggttgcagtgagctgagatcgcgcccctgtactccagcctgggcgacagaacaagactccgtctcttaaaaaaaaaaaaaaaaaaaaaacatattcggctgggtatggtggctcacacccgtaattccagcattttgagaggctgaagcaggcagattgcttgagcccaggagttcaagaccaccctgggccacatggtgaagcaccatctctacaaaaaatgtagaaattaatggggcatggtggtgcacgcctgtggtcttatctactcacaaggctgaggtgggaggattgcttgagcccaggagccagagaccgcagtgagccattatcacaccactgcatttcagccggggccacaagtgagaccgtgtctcaaaaaagaaaatgagtattgtttacagcaagaactgaaaattgtttttaatcctgttagtagcattagagagattaagatacattaacatattttgtcattggaattcagtgaaatactgaaatgttttaagaaaaatatatttttattctttataaagtagaagcatgttaattgctaaatactttcattttgaaattgtggagtatttattatagttttatttttacagctttgcaaaaaactgggtggctcatgtgttacagccctggatggttattatgtggagtccattatttgtgttttcattggatttggttggtggttctttcttggtccaaaatttaaaaagttacaggatgaaggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaattttatcattgtggaaaaatgtgtactaactcctgattttgttaattttataacataggttgaattttagagtggggtttttataagtaatggaggataaaatgggtgggagaaaatggcacacagcacctgaagaaagatggggcagtgacctctagaactcatgcattgccattggaaagcctgtgttgggcatcgatgtcagatcctgaagaatcacctggaaaaaatcccatcctagaggcaaggaggctacaccaaaccatacactacagtactttgtcacatggttgtccattatcatgtattagagtctaaatgattacttgaataaagaaaaaaaaccactt

SEQ ID NO: 36353 - DNA, 72412 bp, Homo sapiens
cgcagcaaacacatccgtagaaggcagcgcggccgccgagaaccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtaggtaaggagcggcgaccccagcccccgcgcggggccccacctcccccgcgaccccgagggttcgcagacgccccgcccgcccgccgctggccgagggaccccagcgcccgcctcctggtccctcggcgccttctcgaatcctgcaagtggacgcccagagccgactttctttcccccctccctcctctccctttctttccctctctttgccgagatgcgtctcaacctcaaaattccaccgaaattccgccgcagctccagccccaggaaagggagccagtttggcttttggcaggcggcgcgccctgggatgccagcgctgggggcggggagcgtgggggacacggcgtgggggcggggggctggaggactggggaccccaggaagaaactttcgcagataaggtgggagttgggcttctctgggcttggggctgggtggggaagggcttctctgctggggcttctcccaccagccccatttgggggctccccgatcaagccagggtgggatggaagcccgccctacccgaggcaggttccacaggcccagaggggcaggtgaaaaagccggtggcgtctcctggcgtggctccttgcttgcgccctgcccaggaggccctgcaaactggctgggcagggaccgggacccccgaatgttccgctttttcgggacgtccacaaaagctggagactttggtgaccggacccggcacgtgggactgtgctgctgctcagattccccagcaaatacccatgacctccggactcctagcccccaaaagacaggcgccatggagggaggcaggaggggcccagttatttgttctgatccatggagggggaggaccagcagaaatgggaggaacccgctggctcgaagtttccaccctggtcctgcacctcaagcctctgcagccctggtgctggtcagcatggttttcctggggcaagtctggctacacggcaggtggtctcggagccccctgccctccttccttcttatgtctgagtctcagtcgagtgacctgtccagggcagatggagcaaggcgggggccccctcacctgcccagagtggaggtgggactttctgtttctcctgctgtcagccacgcccttcccataccccgcccacggcttcttgccccaccccggttagccctaggagctgcgtgcccagctggggaagttttcagttgcaccaatctattgagatcacaggtctcaggtggctcaggccacctgggcggaaggcttggtgtgtgcctgtgtcagtttccacaaaacccagtttgggggaaatgaggtcttttctccagtttagccttggtgctcagcaagatttgtgggtgaaggagaggttcctttgatgagggagccataatgggcctttctctgggggtccacgaggagtgcaggcctgtccaggctccttggctcaccagcacgtgctggggcaggatgtagccaaggcccagaaggaggctgtggataaaaggacctgggagttggatttgtaggagttgggccttgggacccctccccctcccgcccccccccccaccccgccccacacacacactcctcagctgtgtgggagaatgtccaggcagccactctgtccttgcttggcataagttaaggcggccactgagctgggagctgtttctgcgtggggtgtggatccaggatggcagagggtggagggctgcagtgcgtgcctcccgcctccttcatgctcagcgcagcactctcctcttctgggttgcctggcatttgtgtctaaatctttgcatcaaaatcatcctgtagctaaaacttttcaccccatcccggctcagaggcccagtcagatgccagagttgcactgcagagctcagggcattcgcttcctgtggccgctgtgacaaactaccacaaatgggagggcttaaaagaacaggaatcgattctctgtagctcaggaggccagaagtctgaaaaggtgtccacagagccagttccttctgggggctgtgagggagaatctcttccaggcctctctccttgatgttgcttggttccattttcaaggaacacatcacttccatttccgcctgtcttcacatggccttctctcgtgtgtctctgtgtccaaatttccctgttctttttttttggagagcaggctggagtgcaatggcgcaatctcggctcgctgcagcctccgcctcctgggttcgagcaattctcctgcctcagcctcccaagtagctggggttacaggcacctgccaccacacccggctaattttttgtatttttagtagagacaggaattcgccatgttggccaggctggtctcgaactcctggcctcaggtgatccgcctgcctcagcctcccaaagtgctgggattataggcgtgagccaccgcgcccggccaaattgccctgttcttctaaggacagcagccattggatttagggcccaccctaatccagtatgacttcatcttgatagatcaacaaatactctatttccaaataaggtcatattcataggatctgactagatgtgcatttgaggggggacgtaattcagcccatacaccaggctgccttctcttattcccagtcaccctttccgtgctcaaccaacttgggataaacaacccaggacatcccagggtagggtcccggaacaaatcccacagggacgacagcggcctgtctattctccagtgttcgattctcctcgaagcgatgcaggtttgtgactttctcagcaatggttccccattctggctcagagcagaattgcctggaagattcttaaagattgctcaggtctaggtccctttgcagatacagagggtcttgctcagacttcggcttttgcagttttaaaaggcccacaggtgatttaaccagggctgtgacccaggggtctcagaaagggggtacagtggaggttaataaaggctggcttgttatgtggcaagctggctccttttactcttggctgcatgcagccttgttaaatggcttggtgtctacaagaggcaattggcttaagaaacagtcagatttctgtctgcccggctgaggatttctgggaggtatctccctagcagctcttgcagttggtaggaccggaactgtggtcggcaaagataattcatgatgaggtggtgatgtttaggataagggatggtaagaggtgacctgatttcttcctggaaggccccaggtccttgtcctttccagcaaggccagcacaaacgggaagcattttgtgtctcagttacagtactgttcaaatgcgctgctggcccggctccctctcacccagtgaaatccttcacatctactgccagcctgcacagctacagggatctggctggaaattagctttgggctcaccattcaggcagtcccatgcctggagccacttagccagctgagctacttggcagactcgggctgcttgggcccgtttctggactcaagggtaaagccaggagctctctggatgcagagaataaaacctctcctctggcttgggtggcagtacctaaggccacacattatcctagaagacctctgcgatgacatcttcctcacatgttcccacctccagaaactgtcctctgcaaatcccccgaggagctccagctccagctagagaggggtccacaaccaagagggggaacaactgctattttctggggtgaacagccaagggtgacctggttcctgggggacacagtgacagggaccagacagatagtaggggccaccccagaaaacacacagcacgcagtcaaaaatggctctgtcttcaggacacgtgctcaggaaaagcaacacagcatcagattcatgtgagctgggtcaggccttccatgcgagggggcggcgtggcgctttttaaagaaactgttggcaactcgttgtgcgaagtatgtgatcgatctgtattgtcagttttgttcatcttgattttcatattgggcttgtctgtgtttcaacaagcaattatggagtggctgcctctgcccccggggatgtaagggagaagcaagacattgtccctgtggtgggggatgcagggggtggtacatcttggcaccaggcggtgtggaagggggttcctgctgcccggcgtggtgagcaggcctcccctcctcaactgcccaggtgtggtataaagtcagtccactcagtgtggtttcggtaaataattaacaacagataaactttcgaaataaccaaaattcaggagtaatcatgtgacaatgtgaaatgcatttgcaagatgtgaggatagaaggccccatggtaggttgaggagggagctgtggggagaactgaggctcttcggcttggttttgaacagcgtccttggagggacaggatctgtcaggggagtcactgacccctgaattactggcagctcccaaggcagggggactggaagagcagggagagctgtgcacagcctggaggtatggcaggtgctggaaggagctctctggacaacacacgtttctccctatctgggatctgaggacagtgccagcctcagagcctctcgggcctcccctatttgcacccttctgggggtgcagagccacgtacgcagtcctggcctgtcgtttgtgagctgcaggtgggcttgggtactgcctccctcctccctgctgtcgcagccaggttgctaggtagatgccactggtgtgggctgagaggttcagactctgtggcgacatctgagcacatggagaacagggcatagatgactcctgggagactgagaggcgcgggcagccgtctccagtcctgatgcagaaccactgactcgatgcagtgggggtcgtgtgtaggggtgaacgtcttgggttcggaaacaacaaagaggtctgcccgaggcttcccaggcagctgcgaggagggatgcaacagcagggaggaggagataagaaggaagcaaagacaggcagacgtggcagtggcaggggcaggaggggtgcatgccctggacactctctctgtcccccggtgcacgcacaggctcacaaaccagggacggagggcaagtggctgcatggctaggatggtcttcttttctttttcttttttttcgagatggagtctcactctgtctccaggctggagtgcagtggcgctatcttggctcactgcaagctccgcctcccgggttcacgccattctcctgcctcagcctcccgagtagctgggactacaggtgcccgccaccatgcccggctaatttttttgaatttttattagagacggggtttcaccgtgttagccgggatggtctcgatctcctgacctcgtgatccgcccacctcggcctcccaaagtgttgagattacaggcttgagccaccgcacccagcagatggtctttttcaagaggggagggcagagtgaagaaatcaaggtaagggagggtgaagaagccgcatctggaggacggcactggggaccgtaacccctggtcatttagcggcagcagggtggggtgtgcacaggtgttctaagccaagggaccaactgccccaggaaaggtgagagttctgggtacagagtaggccaaagaggagcctggggattcagggggacccacaaggagattggggccaaatgtcacggctctggcttgtcatgtgacatctgcattccatcccgggacccacgcagccaccaaagatgttctggctgtggaatgacagcgggcgttgcccagggagcctggtagaaggcagccgcctaactccgcgtgctggagcgggcctgggggtggcactggagtttcaggactctccaggtgctgctgccgcccgccaaagttggcatagaccagtcgtctccggaggggtgcccagtacagcctcggtgctaagaatgttatgaatagttagcatatggattcagagttgtactccaaatataatttttttttttttttttgagacggagtcttgctgtgtcacccaggctggagtgcagtggtgcaatcacagatcactgcagcttcaatttcctggcccaagcgattctcccacctcagtctcccaagcagccaccacgcccagctaatttttttaattttttgtagagatggggtttcgccatgttgcccaggctggtctcgaactcctgagctcaagtgatctgcccaccttggcctcccaaagtgctgggattacagatgtgagccacggtgcccggcctatatatacttttttaatgaatatctgatattgtgagtgcttggccaaggttttgtttttgttgcccgtgggtctgaacagaaagtgtggaggctgaccacctcagtgtcggggggtggagtaagcaggcagatgagctgccctgagattgctgggaggagggaaggcgggcagacccagacttcccaatggagagatggtcaggagcatggatgtctcagagtggcaggcaggatgaagctggtgtccccaggacctcccagggcccacctgcctggacccctgcagcctgtgccctgacgccctggtgccctcgtgcatttgctgggacgtggctgtgcagcggcagagggaagggcacagagaccccgccccgatgattcccaccttacaactgagggctgagctactccccagtcagccaggtcagactggagcccagggaaagcttccggagccccagcaagtcaggttgagagtgtgtttacgctaagaagcaaattgaggaacagtctttataaaagaggggtcctaacccagagtgtgtgaacacccagccagagataggcctggcgggtttgggggtggtcacaagcccggaaactgtaagtgaagttgtgtgtgtgtgtgtgtgtgtgtgtgtgtgtgtgtttgtgtgtgcacgcgtacgtgttttttttgtggacagtggcagccgccaacttctcaaaggtgcctgtggccctccaaacgtcaagtcactgccatttaaaaggagtctttttataggtttcgagtcttctgtttcttgtgagtatctgcctagtctcggagctgagcgatggtaacgatcttgcctttctctcctcttccaccctcattctgcactcggccgccctgggcagccaggatccgctcagacactaccaccacgaggggagtccgaggcagacctgtaaccagctctggggaaaggatgccatcagtgtcctttggcctcctagctggtctcagggatggctccaaagacctgggaggttctgtggttgtcttccatggggaagacgtccttggtagacggcagctgctctttgatctcaaactctgatcacagctggaccacacatggcctgagggaactccagacctcaccagttaggaagggcctggtgtctatgtcttagatacctgcttcttacagaatttattcacttaagtgtttttatattttgttttacaatagaatttgggtgcctaccgtacacagaaatactatggcaagtgtgtcaaggaattatttagttttctgagacggagttttgctctgtcgcccaggctggaatgcagtggtgcgatcttggctcactgcaacctccgcctcccgggttcaagcaattctcctgcctcagcctcccgagtagctgggattacaggtgtgtgctgccatgcccagctaatttttgtatttttttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccctgtcggccaggctggtctcaaactccaaagccatggtgcccatcttcaaggaagtgagcgcaggaatgcgaagatcatcttgcaggctgcacctcttgctagagactcttaccgaggttaggacactgttgagattgtgggccctgaggggtggatcttatcagagctaagataagccccgaggaaaggtcctggggtgggtatggggagcccagggtggctgtggtagagagtgtaccacagggggacagagtcattagaacaaagtatggccaggcttgagcccaggtggagcagcaaagcctggaggcccggcagtgggacctggcagtgggactccggggaaggctttatggcccctgcactgggggagagggggcagacaggagggggatgacactgaggaggaaggtggtgttgagaggctcgcagttaccaggggagcagagctcccacctgcactggggaagacccaggagatggaaggcaggccctgagcggggccatgggtcgcgggcagacacaggagatgcctctggagcttgacccagtgcctgggagccagatgccctctaacctggtcaggagctcaggcgggtagaggtctctgttgagttctgctggaatctggtgaccagaaagtctcggcgagagggatttgagctagaacttcagcagacagtggaaattgtgtaacggggccttggagggaacaggaaacggagcattgagggggaagggagccagcagtagcgaggggaactgacattcatagcaaacagggtgagcgggggtcaaatgctggccccagattgagtccagcagagcgatccgggacaggtggcctctctctgcccccacttccacacctccaaaaaggagaggcgaatttcctgcctcccaggaagctctcggagctagtgggggacaccagctctttctgcatcaaaccctggctctccctgtctttgtgttcttgttcctccccaccccgccctgagggaggcctgggagcagccagggaggtgaatcatgacatggtgataatgactatggcaacaataacagctggcagaggtgccaagggcttggaggtatgttcttgctcttcactagtgtcaacccatttccttccctatcctcatccccattgtacagacgatccaacggaggcacaggcccactaaggaacctgctcagggttagctggctaggaaatagcagagtaaaagaagagatggtttttaggccgggcacggtggaatcatgcctggaatcccagcacttggggaggccgaggcatgtggatcgcctgaggtcgggagttcaagaccagccttgccaacatggtgaaactccatgtctactaaaaataaaaaaattagctgggcgtggtggtgcacgcctgtaatcccagctactcgggaggctgaggcatgagaatcgcttgaacctgggaagcagaggttgcagtgagccgacatcgcaccactgcactcctgcctgggtgacagagtgagactctgtctcaaaaaaaaaaagaagaaaaaaagagagagagacggcttttaaaaggaggtacatcaacagaatggtgctgattcagactgatactggcttggggatgaatggtctaggctgtggagctgggctgaagctctacaggtgacggatggagccactgaggagggagaggagctcctgaggctggccttgttcatgaggtttgcctgtctgctggagataagctaaatcaattaatctttctccctgccgcaacagagtgagcagacatttcaaatgatattacagatttgtgtttatgacctagaaaaatgttcagagcacagtactttcaaaagcccagactgggccggttgcagtgactcacgcctgtaatcccagcactttgggaggctgaggtgggtggatcacctgaggtcaggagtttgagaccagcctggccaacatcatgaaaccccatctctactaaaaatacaaaaattagctgggcgtggtggcgggcacctgtaatcccagctactcagtaggctgaggcaggagaatcacttgaacccgggaggcggaggttgcagtgagccgagatcgtgccactgcatgccagcctgggcaacagagcaagactccgtctcaaaaaaaaaaaaagaaaaagcccagactggccaggcgcggtggcttacacctgtaatcccagcactttgggaggctgaggcgggaggatcacttgagcccaggagttccagatcagcctaggcaacatagcaagacctcatctctacataaaataaattaaaattttaaaaattagccaggggtggtggcacgtgcctgtagtcccacctactcgggaggctgaagtgagaggatcactggagcccaggagtttgaggctgcagtgagctatggttgtaccagcctgggggacagagcaagactctgtctataaagaaaaaaaaaacagcttggctgggtgcagtagctcatccctgtaatcccagtgctttgggaggccaaggtgggtggatcacctgaggtcaggagttcgagaccagcctggccaacatcatgaaaccccatctctactaaaaatacaaaaattagccgggcatggtggcgggtgcctgtaatcccagctattcaagaggctgaggcaggagaatcacttgaacccaggaggtggaggttgcagtgagccgagatcgggccaccgtactccatccagcctgggagacagagcgagactccatctcaaataaataaataaataaataaataaataaataaatgaatagccaaaatttcgaaggcagatgaatgccaataatgttctcaagaagcaataaaacattgggttataacctgtgcctctgaggactcaaggggaagtcaggcaggccccagccagcgttagtcgcagctgcctgctctcccaggtcagcccttgcaccctcgcagaggaagccgtcccttccgcctctctccatcataaagaaaacttctctgtctctccattcacgtcccaaatgccttctaactttaaaataattacacaactatatgtgttaatcatggaaaagacacttaagcaaaaagcaagaaaaatcatcctgattgtatccattgcctagaatttttttttttttttttttttccccgagacagagtttcgctccgtggcccaggctggagtgcagtggtgcaatcttggttcgctgcaacctccgcctcctgggtttaagcaattctcctgcctcagcctccagagtagctgggattacaggtgtgagccactgtgcccggcctatgttttttgtttttttttgttgttgtttttctgagacaggttcttgctctgtcacccaggctggagtaaagtggcatgatcatggctcactgcagcctcagcctcctgggcttaagcagtcctcctacctcagcttctcaagtagctggaactatgggaccataccagcacacccagctaatttttacattttttgtcgagacgaggttttgccacgttgcccagtctggtcttgaacgcctgggctcaagccgtcttcccacctcggcctcccaaagcactgggattacaagcgtgaaccactgcacccagcctgcttttgagctgctttattgagatgtaattcacataccatgaggtcactcctctaaagtgcacagttcagcggtttgagtacattcacagagccgcacagccatcatctctaattttgcagcttccagagtagggcctcaacgtgggttcacgtgatgtttccccagatagactcaggtcaaacgctgttgttagagccctgcagagccgcgggtctcagcccttgttggtatggcgaggtcctgtagccggcagtcggcctcccaaaatgttgttggctttttccagcggttggcaaactagacccactgctgggctgatggcctgttgttgtaaatatttttttttctttttgccaccacacccggctaatttttgtatttttagtagagacagggtttcactatgttggccaggctggtctggaactcccaacctcaggtgatctgcccgcctcggcctcccaaagtactgggattacaggcttgtgccacggtgcctggcctagtgcaaataaagttttattggaacacagccacgcccactggtaaggccaaacccacgtggcttttgtgctataacaacagagttgaatggcggtgatcaaggactgtatgggcctcaaagtctaaattacttaccagctggctgttcatagaaaccttttcggatccccagcctaagtcatcgcaggctgatggcacaggtctgggcttcccagtccttgtgtggctggctcctctctccccggattgcctgttccctgctttccagaagcaagcaggtggcctgggaagaagtggaacctgcagggtgtcattctccaagccgatgctgaagatgcaatgccttcacccgcctcttctgtgctcttcatcgcacgggtgggctagagcagggaagatggactttcaggctggagcctggctttctgtggtgggatgttctgtgggtaccgagacccccttactgcatcttcagggacagaatctggcttgggttgagagtttatttggccctttctgatctgtaatcgggagagattgattgagctttcctgacacagacgtggcaaagcaaactggcagtggggcaggctttgccaaggctcgtcatggtagcggaggcctggacagagcacccgccaacagctgctgcttaaccaaggacagaatgaggaaatggacatttcagagaaaagaggcgacatgaaaagtattggagaaaagagcctgggctttggagtcaagtgggactggttctgaatcccgactgtgtgcctctctgagccttggtttcctcttctgtaaaagcaagatcagactcttcagtgtggtgccatgggagattcatattttttttttgagacagagtctcactctgttgtccaggctggagtgcagtggcacaatcttggctcactgcatcctctgtctcccggcttcaagcaattctcctgcctcagcctccccagtagctgggatttcaggcgtgtgccaccatgcccagttcaatttttttttttttttttttggtgtgtttttagtagagatagggtttcaccatgttggcctggctggtcttgaactcctgacctcaagtgatccacccgccatggcctcccaaagtattgggattataggcgtgagccaccacaccctgccaagattaaatttttgatgagtgagtcaaatggaggccaggtggggtggctcatgcctgtaatctcagcacttttggaggccaaggtgggcggatcacttgaggtcaggaatttgaaacaagcctggccaacatggcgaaaccccatctctactaaaaatatttttaaaattagctgggcatggtggcgggtacctgtaatcccagctactcgggaggctgaggcaggagaatcacttgaacccaggcggaggttgcagtgagctgagatcacgccactgcactccagcgtgggtgacagagtgagactctgtctcaaaaaacaaaaaacaaaaaacaaaaacaacaaaagcactggaggggctcaatagttagttagtttgtcctagacccttctagaatgttgagatcctggacagtgcttctgagaaacctgcagtctctgtccaaggagcccttaaggaagaaaggcaggagtgtggggcaggaagaccagcttcccctttccattccacacggctggctcgcaatattctgtttctcctgcgacagcctggttcctccctgctccccagctcgcctctgccaccattcttccctcagtccagatcaagagttcaagggacggggacagatgatcagaaaggcccagctcaggcaaggaaggggagaaaagggaactcgtatatgcggtgggtgggaatggaaagtagtacagtcactatggtggaggttcctcaaaaaactacaaatagaacggccatatgatccagcagtcccacgactgggcatttatccaaaggaaagggaatcagtgcatcagagagacacctgcacccccatggtcctggcagcactgttcacaatagccaagatatggaatcaacctcagtgtccaacaacagatgaatggctaaagaatgaaatagtatttcattgtggatgttggtacatctacacaatgaaatactactcagccataaaacagaatgaaatcttgtcatttgcagcaacatgaatggaactggaagacgttaagtgaaataagccaggaacagaaagttaaacatggcatgttctcactcatatgggaaagctaaaaaaaagaaaagttgatctcatcgaagtcaaaagtagaacagagaatactagagtctgggaagggttgggggaggagagagggagagatttgttaaaggatacaaaattacagctagataggaggaatgagttatagtgttccatgtcactgttggattaatgtaattaacaataggccaggcggtggcccacacctttaatcccaacactttgggaggccaaggtgggcggatcacctgaggccaggagtttgagaccagcctggccaaaatggtgaaaccttgtctctactaaaaatataaaaattagccaggcctggtggtgtgtacctgtgatcccagttactcaggaggctgaggcaggagaatcgcttgaacccgggaggtggaggttgcagcgagccgagatcacgccaccacactctagcctgggctacagagcgagactccgtgtctcaaaaaaaaaaaaaagaaaaagaaattaacaaaagtatattgtatagtttcagatagctcggaggacattgaatgttcctaccacaaagaaagaaatgcttgagatgatggctgtgctaattaccctgatctgatcactatacattgtatgtatctaaacatcactatatatgccataaatattacaattatgtgtccattaaaaataaaggcccagcccagctcacataaggacggcaggtgtgttccttaaagcatcacaccgggtcccagtactagacggacactccgcctccggttgtgtgactctgccttttctgtgccctagttccctgtttgctccagctagttgagaatccacactgcctgggtcacagtgcccggcctgggtcccgtaatgttgtggggggcggggggtggaataagggagaaagccaggagtgccagcaaggccggctacttggagtgtcggtagcatgacgctgcacgtctagagcatgtacagaaacccgatgagacccgagccttacggtgaccctaggtacagaggacgtttgtcaccactgggtctctctaacactgggaaggtgacataatccgtttgcccacggtcacacgggcagctgggggtccagctgcaccatggccaggcctctggcaccaggtgatggggtacggggtgcttcagtgacacagcacttgacgtgacatgagggagaaaggactgggtgggggggtcattcgtgggcttcaggtccggggggattattatgctcagaaggcatgtgctgacactgtggcaggagagctctggggacaggtgggctccttgatttatcttttttttttttaaagagatgagggtcttgctctgtcgcccaggctggagtgcagtggcgtgatcctagctcactgtagctttaaccacctgggctcaagcagtcctcccacttcagcctcccgagtagctgggattgcaggtgtgtgccaccacgcttggctaatttttaaaattacttttgtgtttagaaaccagatcttgctatgttgcccagtctggtctcgaactcctgggttcaagtgatcctctcatctcagcctcccaaagtgctaagatttcaggcatgagccactgcacctgacctacctactgttttggggcaaaggcttagatggacacgcacacacatgactctcctgggcttctggttcagcactttctcttctgggggtgctcctctcatttcatcctcaatcctgagctgaccccagaagccaaggaccagcctgcccagcccaggcagaaactgagtatgccaagaggaatggggtcagggtggagctgggatgagcattgctggcctgactctcccttgtgaggtcttgtccacttggcccagttggctccagggcagggaataaaggaacagtctgtggtggtcttcccttctgtgcactagttctggaaagcagggataaaacaaccaggcaaatgcataaaaatactgtcgagggcttttcagcacaaaggacttcacatcttccttatttacaaaggctctgcgggggaggtgaggcaggtgtttggatggggagcagccgatgacttgcccaaggtcacccacagagtggcagtgccaggaatccaaggggaatgatcctggctcgagtctctgggaagaagattagatttcacagctttggatttaacatcactttgctccttttggccaagaggcatgttgtcctcagaaggccttggtgacaggtatattttgccttaatttgagtagtttagaggcatggaagggcattttggcagcagtgatcaaggactttaaaaataagtcttccctttgatcaggcagccctatatcttggagtttttctgagagaaataatttaggacacatggaagtatttagctgaaggatattcatctccgtcttgcttatcttacggaaacgttagaaacacctatatatacagtagcaggggcgtggttaaataaatcacagcatcagatgctctgcagacatcacatggtatagctttttcttttcttttttgtttttgagacagtgtctcgctttgtcacccaggctggagtgcagtggtgcgatctccactcgctgcaacctctgctccctgggctgaagcaatcctcccacctcagcctcccaagtagctgggaccacagacacacaccactatgcccagctaagtttttgtatttttagtacagatggggtttcgccatgttgttcaggccggtctcaaactcctgagctcaagtgatcctcccacctcggcctcccagagtgccgggactacagacgtgagccaccacacctggccagaacgtttggacacatgaggggacattagactttctttggcaagggtgtattttccagttgctctagaatgaacatgaattccatgggtgcacctgttttactggacttcgctatattgtgctctgcagatactgcgttttcatgaattgaatatcacggctggctcaactctgagtctatcggtgccatttttttctcacatcacgtgttcacttcatgtgtttgtgtcccattttaataattcttgcaatatttcaaactttttcattattatcatacctgttatggtgatctgtgatcagtggtctttggcgttactgttgtaattgttttggggcaccatgaactgtgcccacatgagatggcaaagttaattgatccatgttgtctgtgttcagacgactccaccaactggccgactggcggcttctggtctctctctctctgcctaggcctccctctttcctgagacacaacaatattgaaattaggccaattaattaccctataatgggactgggcgtggggactcatgcctgtaattccagcactttgggaggctgaggcgggaggatcaccttgaggccaggagttcgagaccagcctgggcaacacgacaagaccccatctccacaaaaaattaaagaacttagctgggtgtggtggcacatgcctgtagtcctagctactcaggaggctgaggcgggaggatcacttgagcctgagagttctaggctgcagtgagccgagatcacaccattgcattcaagcttgacagacagagcgagacgtctcttactttaaatcaaaagctaggagtgattaagcttagtgaggaaggcgtgttgaaagccaaggtaggctgacagctaggccttttgtgccaaacagccaagttgtgaatgtgaaggaaattaaaaaatgctactccaggtgatcacacaaataataagaaagtgggcctgccggccagacacggtggctcacgcctgtaatcccagcactttgggaggctgaggcggggggatcacctgaggtcaggagttcaagaccagcctggccaacatggtaaaaccccgtctctaccaaaaatacaaaaattagccaggtgtggtggcgcaggcctgtaatcccagctactcgggaggctgaggcacaagaatcgcgtgaacccgggagatggaggttgcagtgagccgagatcgcaccactgtactccagcctgggcaacagagcgagactctgtctcaaaaaaaataataaaaataaaaaagaaaaggaaaaaaaagaaattgccacagccaaccccaatcttcagcaaccaccaccctgatcagtcagcagccatcaacatggaggcaagaccctccaccagcaaaaagactggactcactaggtcgagatgattgttagcattttcaagcaataaaatatttttatttttatttttatttcttcaagttttgggtttttcttttttttgaggcaggaccttgctctgtcactcaggctggagtgcagtggcatgatcttagctcactgcagcctcgaacttctgggcttaagccatcctcctgcctcagcctcctgagtagctgggactgcaggtacgcaccactatgcctggctatttttagttttttatagaggtaggatctcactgtgttgcctggctggtctgaaactcctggggtcaagccatctacctgccttggcttcctaaagtgctgggatgacaggcgtgagccactgccccggccaataaagtatttgtaaattaaggtatgtgcattgataagacataatgttattgcacacttactgggctactgtacaatgtaaacataacatttatatttgggaatatatattggtttgggaaaccaaaagagtcatgtgactcactttatttcaatattcactttattatgattctgtgggaactcaacccgcagtatgtctgaggtctgcctgtacctgtaatttttaaaagctagcatttgctaatatgtggttctaattgcagtcaacaatagtatggacccagactctcaaggctgagttggccttaggccagtagtgaatcccatgccagagagaacatttagcagggcggattaatccagaggatggggctgccttctagagcttgccaaggcagcgtcaggagagcccaggcttgagagagatgtcctcagtccagaaaagacctgacgagcacttggcagtcgtgctggacattctgcaagggccatcgaaggcctagcgtgccatcctgttggtccccatgctatttcctcctcactagaacctctccccttgctttagaatgggcgtcaaggccacgctgagaggataaaagatgtagggatcttctccgaggaagaagcatatagaagattttgtatctatgggtccgtattagggtttcccagagaaacagaaccaataggctccatccagctgcgtaagatgggatttatgtgggaattgactcatgcaagtatgaaggctgggaggtcctggaatctgctgtctgtgagctggagcagcagggtcactggtgcagtaatgcagcctgagtctcaaagcctgagaagcggggtggccactggggtaagtcctggagcccaaaggcctgaggcccaggagctctgaggtccaaggcagaaagaaggtggatgtcccagctctctctctttttttttttgagatggagtctcactttgttgctcaggttggagttcagtggtgcgatttcggctcactgcaaccttcacttccctggttcaagcgattctcctgccttagcctcctgagtagctgggactgtaggtgtgcgccaccacgcccgggtcatttttgtatttttagtagagatggggtttcaccatgttggcctggtctcaaactcttgagctcaggtgatccacctgcctcggcctcccaaagtgctgggattacaggcgtgagccaccgcgcccagcctggatgtcccagctcttgcagagggagggtttgcctgcctctgcctctgtctctttgttctgtccgggctttcaacagattgagtgatggtgccccacctggcgaggagggatcttcttactcagtcccccggttcagatgccagtctcttcccagagccacccagaaatcacgttttcccagctatctgagcatcccttagcccgtcaagctgacataaaatgaatcatcaagggctgcgaagatggactccaaaagtgggcgggggtaggggggtggtggtggactgtgatcgagaacattcctgcagggagaatgcctcccttccctgagtcagggaccagataacctttccagggtccttccagcccaggacaaagggctttgtctcaggttcagctctcctgagaattcatcctccccgagatttggacacctcagccgaattcctgctgtttaccttcttctctcaagaaacaacaacctgaggattgttgctttcacttcttcggacccaaatcatgatttcccagccacatttctcagttgtcaaatttgtggaggatgctggaagcttctagtgagttgcttacagatgatccaactggcggcttactaaaacatatcttgggctgggggcggtggctcgtgcctataatcctagcactttgggaggtcgaggcaggggaatcgcttgaggtcaggagttcaagacccgcctagccaacatggtaaaaccccgtctctgctaaaacacacacacacacacataaattagctgggcatggtggcatgcacctgtagtcccagctactcagaaagctgaggcactagaatccctgaacccgggaggcagaggttgcagtgagccgagattgcgccaccgtactccagcctgggcaacagagcaagactgtctaaaaaacaaacaaaaaacatatcttgacaatgccagtcatcactttaccacagaccttaagatgccaaccacccagactaggtcaggggcccccatttccagcagctactcctgcttcctggaaaccccctgcaccggccagactcccccagtgtcccatgttcatccccagcctcgccctgccagcttccctcgcccatccttctgatcaaactgtctgtggggaactagccctcaaacgaggccaagtacgtgtggcttctcctcctgtgtgggcaggtggttgacgggattctttcttcccccgcctccagtgggtttcagtttaacgatggctttctggagctgtttagaagcgtgaacagatgctgtccctacaggagaagggatggcaggcgttgtcaggaaccctgaccttgaagtgtacctccttaatggcctgacagctcagagagaatgacaccctgggaggtctccatgcagccagctggggacaaaaagatgtcctctgcctggtatggccacgagcatttgtacattgcactgtccttgttcacccacacctccttaaacagtgccttcaggtgcccccatggctcccggctgcttgagccaaatctttatgattgatcccctaacctacacgcttgccccctggctggctcacagctgtccctgacctcacccctgccatgatgtcacagctcaacagctctgctgttcccatggcaacagcctgctatgagtagccagccagggcagaggccgggctgcaggtggaggcggggaagcgattccggccacctttggtcagtgggcccctgagaccactgcggggctgaggctctctgtgtctgttcccatctgtggtgagggtggggttctttccatgcccagctgtttagcgaggctcccaagagggccccggagagtgggccaaggaggggctccaagccgtgggttcgcaaggccagcggcaaagtccctgcaccacggggctccccacaggcagtgtgatgggaaggagagtgagggaagctggtgggactgggttggagatgaatatggttgttggaggagttgggctggggggtcttcaggaagcaggaacacctgctgggattggggacccctgacctaggctgggtgcttaggatcttgaggtttgcagggaagcggtaatggacgctgtcgaggtatgtttagtgagccaccggttgcatcagctgtaagccccccacgtggggagctggcgtctcagctgggagtttggaggtcagtctgcctcagtgtctgtctctgtgaagctggtcaaggggaggcctgagcccgagcttgcccccagaggctgcctgcccaaccatctccaccctggagagctgacccagcccaggatatggatacacacagattcatgagctgtggccccagtattcgggtggaaaagcctgctgtgggcctagccaggactcattctaacgtgacccacccctgccccaggtgatgctaacacagccagtccaaaacccagtgcaggctgggcatggtggctcatgcctggaatcccagcactttgggaggccgaggcgagtggatcacctgaggtcaggagtttgtaaccagtctgaccaatatggtgaatccccgtctctactaaaaatacaaaaattagctgggtgtggtggcgtgcgcctgtagtcccagctacttgggaaggctgagacaggagaattgcttgaacccggaaggtggaggttgcagtaagctgagatcgcaccactgcactccagcctgggcaacatagtgaaaccaaaacccagtgcagtggcttgggacccccgtccccccgccaccactgggacgtggctaagagttggggagaagagggcgaaaaccaagcctctggcagcacacagcgtgtcatggagggtatttttagaggctagaactcagagaaacggagttaaaaatgtttctgatgtttgttttatctgggcttggttcggatgcctccagtgatgggcgtctcactacctacaaagtcagcccagtgatttcaagacagccctggagacagtgcttcctgccctcctgtcagcttctgcctccctgtaatgtgttctgggtggtctagctcagtcatctggagacacacacagtaagtaccacccctcttccccaagcatttcaggtgcttctcgtggtgacaagcactggcatctctgtagatgggtgctgctgttgttatcatccccatcctaaagagcaaactgaggcacccagagtgaagtcgcttggcctaggtcacatagtactcttaagcaccatactctgccattctagacttttctatcctttgcaaacacccttgccccacctcacctcctttggcttttcttcctaggacctttggtcagtgggcccctcctgaccaaaggagttcattctcctcctggactccaagcctgcggcctcttctccccgtccttaccgccctcctcctctcccgagaactgtccaggaagacacacctctccctcgttcagatttgctccttgttcttcagcccgtgcatctcctttaggtcttgaacagttctggacaggtttattcctgatcatttcatcacggttttattgattttgaaactttatcccgtgacatgatcaaattggccatttctagagcacaggcacttcgtagctgttgaccatcatttagctccacgtctgcccgtcggttcctcgtgcgtggaatccagcaccacgtgggtgtctctgccgagctctcggcatttcctgagccctcccggaagccagactctgttctcggcgcttcacacgggccgtctcgtctgatgctgtggcgtcctgcagggtgggaacgggcggtgcccgtggacgtggcgctgtgcctgccggcgtcctgggcaccacagcgttgccgcttgcccactgcctcctagcatggccaggtgaggtcgggctggctgggctgcaccattcgctcgcatgttagaggcgtttctgttcactcaggggacagtcacgttggcccttctggtggcccagcgtcttttgtcccctgtgctgctccacacacccacctctgtacttgcatagttggatttagggacccacatataagttttagatgtgttcccattacctttttttatcttgtaagatttggccagttgtgcaagctgttaaaaacctctaggctagagtctagcaacaattttccacctcccccaagggttatctgtatccggggatgcccacagctttgaattgataaggtcaggtgtgaaagctcaggcagtggtcctgtggaagagcccaccaccacctcggactctacttactttattaaaaaacacatttttttttttttttgaaatggagtcttgctctgttgcctaggctagagtacagtggtgcgatcttggctcactgcaacctccgcctcctgggttcaagtgattctcctgcctcagcctcctgagtagctgggattacaggcatataccaccacacctggctaattttttgtatttagtagagacgaggtttcaccacgttggtcaggctggtctcgaactcctgtcgtgaggtgatccagccacctcagcctcccaaagtgctgggattacaggcgtgagccaccgcgcccggccaaaaaaaccacaattttaataagcttgtttgtgtggctgctgtcagacagttatgaccagggaagggaggacacaggaagctctaaaaaggcgacttaaaaaacccaaattgcattctggggtcacttagtttatgggacctctgttctttacattttaaaagccctcgagggatttcctatattatcatcccaaagacaatccaaaatttcccccaaagaaggtcaaattacatattctacgtaggcgccttagacagagaaatgtctaactttccatatgaaagggtaagctctaattatatggaaatgttctctctctggccgatgccagctaacggagcccttctatagctatttttatgtttcaaagacaaagcgcttgactatgtggcccgggtgctgggcttctggagaaagggaagagcattctctttgttcccttggagggttggggcatcctgggggagtgggaacgaggcctgggctggggacatgcgggtaggatggggaagggggtgtgtccatgtcacgaggaacctgcatgagcacattccaggcgctgctgggtgtggggcatttgggaatggccaggagctctaccacccctgtctggtgtgcagcgttccaggctagggtggctcccaggggagccagggcgagctgcttgaccgttctcaagcctctaggcccagagattgccaggctttggcagggcagctggtgaactggctgcattcctgggcccctcccgcaggggctgggataggatctgtcaggggtgaggcccaggaatctaccccttcaccagcagctcagctgattatgatgcacgtggctgcgggttgcactcagagacttgctggtgtggacagcagggaatcacatgggggatgctgaaatgtaacccaggtctctcagttagacagcgctgggctgcagtgcgggagaggacggggtgcaggcctgggggtcgggggcagagaggctgattgggaggcttttaagggcctcaggtgagagatgatcagggctgagctgctggcaggggaggaaggcagagcaagatgcagcttcctggaagagatggtttgccagggccgcagtactccaagcgtggtcccccagatggcagcatcagcatccctgggagcgctttagagatgcagagtctggcgggcgtgggggctcacacccggaatcccagcactttagagatgcagagtctggcgggtgcgggggctcatgcctggaatcccagcactttgggaggccaaggcgggcagatcacttgaggtcaggagtttgagaccagcctggccggcatggtgaaaccctatctctactaaaaatacaaaaattagccaggcatggtggcgcgtgcctatagtcccagctacttgggaggctgaggcaagagaattgcatgaacccaggagggggaggttgcagtgagctgagattgcaccactgcactccagcctgggcaacagagcaagactccgtctcaaaaaagaaaaaagaaaagaaaaagaaatgcagagtcttgggccccacccagactattgaatcagagcctaactgttaacaagattcaagcagcaccatggccaggtctcacccttctgtgcatgttgacaaatcaagtacttgagcagaaagaagatggggatgatcgacgtgatgaactcagaggcaccaaccgtggtgtcctgggtcgatgcacacagaatgcacgcaggccccttgcaggccttcccacccttcagaagctcagcacacctgtcagggtcacaggagggccagggaggtcagaggtcacgtgaggccaagcacagtccaagcagagtctccttgtgctgtggaagtggtttccagctctgacctccctgggcagcaggctaggagcctggatcaggggcctgcctgctcggcccggaatccctgctgccctgattacgagctatgtggccttaggcaagttacttaacctctctgagtctcaatttccctgtcagattgtgcggataggaataggcctcacctcctatggtgaggcggtgagatggagagaggtgtacgtgaaatgccggaagagtatgaaaccctgcgggtctgcgtgctgatcagtgtgatgtctggattcaaacccagctcctccgtgtaagctgggaaagttattcagcctctctgagcttttgtttctttttgtgagctcagaggggaaatcaaggagagctggaggcggcagggacaaggttgcatccgatggtgtcatgggggaaatcaattcctgaatgatggagccagctgtgattttctggactttatcccaaagacctctgcccagatgttttaagtttgtacccatttccgtgtctccaggaaaaccgacacagcagccccgctggctcctttcacagtcaccctctggatcatgttgcagtgactctagccaagggtatggcctgtgtcgtgtctgttacaggccgaggtgggaagaaaaggttgtccctgtatctggaggggccagttcatgccttgaggaggagagaggcactctgggtcctgccattgtcctcagggatggccatgcttgccattgtcccacgtgtctgttcgggggggtccttctcctggggatacaacgtctgccgcgttgatttttgggtgtctaagtgtaccgggctagtatcacattgagagtcacccactgtgggtggattcacccattcccgtcatggtgcctggggctccagcagcctcgtcacaacacagcctggtagttggagggtctgagcctttgttacaaccgccctgacttagccgcaggactatgcacctggtggggactggggtgggcggccactctctcacaggcccaccccaaggctctagatgggcacgtgcattgttcaaatgccgtcataccttgggggtgcgagggggcagcgtgaggcagacgagagaggcggaggtctcacagtgaaccacaggatctggtatcctgcagccggggtgcaggcctgactgtggagcccccattctgggcgcctcacactccctatgactgtgatgcttgccccccgccccccgatgccacaggagtgcacagcaggcctggagtctccttcggagggggtgaggaggccggcggggggcgggggggtgctgtctgtgggccctggcacttccacgctgcctgggtggagggtccctgggtgaggtctgccttggctgaaaagctgtctgagcggccgcccagggaaaggcgagctgcttggacgtcattctcaagctgtaggccagaggttgcctgactttggtgagaatcgctgggaatctggtggccaagcacattcctgggcccaggtgctgggatcggatcggtctggggtggagctgccatgggctggctcctgcgctggggccacggggctgtagagagcaagagaggagaatgggcccagtgtccactccgctctgtgggaggccctggtgccgtccggaggccagattggtgtccactcgccttccttctgctgctccgagcgcggcttctgcggaggggggagctgtggtttctctgagtggttgaaggcagccagcagaaggcaggcttgtcagctcggggtggcaggaccagagggcagcaggggagtagaaaacaccaaagcagcccaggatgctcagaacactcagaggatgtggaggacagaggagcgccaggacccctgccccttctagaatattctaagcaaccagagagggcaggtgcctctgggaggggagctgtagcgagggccctgattggaaccatggctgtcttcattggcaagtgtcctgccaagggcacccgacgtcctgtctggcagggctggagagacactgggctgcctggagatcagcctgggcatcacaggcagaggcaggcatcccagcaggctgtgcaacaggtgaacggctgtttctccttggtcatcttgggctcagctaaggctctgttgctttccctgccagtgcctgcacaagtccacgtgagaccctgccctctgcctcaagttagtaagtggggagggtctcagaggggagagcaaggagagctggggtagcggggacgaggttgcatctgatggtgtcagagcggggatcgattcctgaaggatggagctggctgcaattttctagacttatcccaaagatctctgcccaaatgtgttaagtttttacccgtttgcgtgtctccaggaaaactgacgctgcttcattgggatgcccacgccagtggggctggcacggggtgcactgaggtcattgaacgggctgggggcacttccagagcagggaagacttgtccaggttttactaattgttggttgacaaggggtgtgagccaacggctcttggcacagaaatagactgtgaaccttggggcctccaggcaccttccgagacacacagaggggcattcacagcagccccgacctcaccacacctaattggacatccctgtggccgttcctggtggtctttggtgtctgaggccaactcctccatgtgagctgggaaagttattcaacctctctgagctttggtttctttttgtggactcaggccttctcttggttatagacctaggagtggaatctctgggtcatagggtaagtctgtgtttccctttttaagaaactgccagactgttttccaaagtggctgcaccattttccattcccaccagcagcgtgcacagggttccaattcctccccctccttcctcactgacagttgctattgtctgtctttttgacgacagccgttggagtggatgtgaggtggcaggacactgcagggtcagtgtgcatttctctaaagaccgctgccgttgaacatgtttttatgtgctgtattagccacacatctatgttctttggtgaaatatctatttaaatctgttgctgatttttatttttatttatttatttttgagacagaatctcactctgtcatccaggctggagtgcaatggtgcaatctcagctcattgcaacctctgcctcccagatacaagcaattctcctgccttagcttcccgagtagctgggattataggtgcgtaccaccacacccggctaatttttgtatttttagtagagacggggtttcaccatgttggttaggctgctttcgaactcctgacctcaagtgatccgcccgcctcagcctcccagtgtgctgggattacaggtgtgagctgccacacctgtccttcttttgctgattttcaaatgggattatttgccatcttactgggtagtaagaggtgttcatatgttctggattcaagtcttctgttggatatatgatttgcaaatatttccttccagtccgtaccttgtattttcactttacttatggtaccttttgaagcacaaaggttttttttttcttttaattttgatgatgttcagcttatccgtttctttgtttattggttgtgcttttggtgttgtatctaagaaatctttgcctgactcaaggtcatgaatatacacctacgttttcttctaagcgtttatagttgtagatgaaggtctatgatccattgtgagttaatttttgtatatagggtgagataaggctgtgaattcccattttttgcctgtggatatccaactgtgccagcatcatttgttgaaaaacaaaaaaactattctttccccacattaaattgccgtggcacctttgtcaaaaatctcaatcattgcattgaagggcccagctttctctctccctttctctcttgatcatcatggtggttggcagatctggctaaatataatattaaccactattctaattgtgtgatctgatttaccaagaggtgcaaggacctcccactagaagacttaagtcaaagccagctgcagtgtgaccacctgaggttggtcaaaggtgctggggttcgtccaagcagcagagggcctgtctctgccacttaccagctgtgtgatctgggttaagcatcttcatctctgcctgcctcagtttccctgtctgtgaaccggggggggtaggagcttcgtatctcaaaggattactgtaaaaaagatgaacggatacatgcccagtgctcagaggggagcctgcacggttaatgttagctgtaatgtagatgcagtattttctgactcctgcaactacatgtgacttcagctgcaactacgtttgactccaaaggcttagcctggttccacatagactaagatgaaagaagggaaggagcagtggagggggactccatatcgactgtggctgtcccttagcctttcctgcagctcacagatctggctgtttctggcatcagctacccgtggcaacagacacaatcccgtactgttttggtgtaaatgcccctcctttcctaggaaggcctgccaaagcatgggtcccttcctgatgccaaagagacctggaagagtccttctctgatcattataaaaggaaagagctgggagtcatgaagagagagctaacaccagcttctcctcctctctggtttctactggattcaagtatcagacttgcatgcacacatacatacctgcatgccccacacggacacatacacatacacacaccgacatgcacacagaggcacacacagacatgcatacatacacacacctgtacacccccctgtacacacagatgtgcaggcatgtgcacagaaacataaacagatgtgcacacgcacacacccctgcgcgcacacacccctgcacacacaccgctatgcacacacacccctgcacacacagccccacgcacacacccctgcacacacacccctatgcacacacacccctgcatacacacccctgcacacacactcctacacacccctgcacacacacccctgcacacacatgcatggagacacacacacccttgcacatacacccctgcacacacacccttgcccgcacacccctacacacacacccctgcacacacactcctacacacacatgcacacacacccctgcacacacatgcacacacatccttgcacacacccctgcacacacatgtatgcacacacacccctgcacacacatgtacgcacacacacccctgcacacacatgtgcatgtgcacacacccacacacacccctgcacacgcgtgcacacactcctgcacacacacatgcttggcaggctcctccctgccccgtctcttcctcctttcctttacgatcaattctccctccagaggcccagacttcctcttttacttccacctgctcttctcaatatttgtttccaagggctgccctttgtgcccctccatccctacctgaatcctaacccttgccctttgggtgggattgtcagtctcggcactactgacatctctggccaggttattcactgtcttgggcagccctcctgtgcagtgtggggtattcagcagcctccctcgcctccacccagctgcaggcccggagcacctcctccctgcatttgtgacaatagaaaatgtttccagacattgccaatgtcccctgggaaacaacaccacactctgttcaaaacagctgccctacaggctcttgtcaaaagtgtacaggacagaaattgggaggctgagagtgggccctggtgggcacgggtcaagagagcttggaggggcacattttgcagcctgtcctcacagtgagaatcccgtgtgcttgtctccagggctttgctcactctcctgggagcgatctggaaagctgcacttgtgctcccttcctcgtaggtttgctgtggaacgttgtggcttctgtggctcctcaggcccgggggcgccccttgaaccctccactcttggctccaagcaccttccctgggaagctgtatctgctgggttcgcagacaggaacagaaacatggatggagccatgtggctgagcctctgtcctgataacgaagacctgctttggaggaaaaagcacaaattgctacaagcccggggcaaaggcgatctcgctctgcagagaagagcggatgccaagctgtggaaaaactaccagctccagcgcttggctgaggagttgaggagagggtatcaggaggcacagcacctgcacgtcggtggcctggacaggctgcagtcagcacgtctgttgggctggggaggaggacgggccagggaaaatgagcctgactcgcaggggcccatccagcgaagatcagccaggcccccgagggccaaggagaagcatagagcagcccttagtgaagagaggagttgcagggaagagttgggccagcaacaccccaggcactccaggccccggaagacagcagcgagtccagagaaaccacagactacaaaagccacgggtcggatgaattctcacctggccccgcctgagaagagaaagggaaggccagaaccttcgaccaagtctgggggtggccgctgtgccatccatcctcggaggagcaaaggggcggacctagaaaggtcaaacccactcgtggctgctgtgggagaaatcgggcttgtggaggaaaaagagaaaggaacagctcgggcggggaggaggcaactgggaaagggggcagtttgctttgttccagccctgaccagtcgctctcagggacagagtctggaggggaagctgagagacctcgggcagctgtggccagctgattccagctgcagaagggaagccgtgtccccagcatctcagtgcacgctccgggagaagaacaagtggcagaaagagctggagttggcctttgaagagttgtttaatataaacagaaagctgaaaaaacacctgtgcttgtacctggcactgaagcccaggatggaccagagacctggggaagggcatgccttctcagagatgcaagagtgtggcgctgggaccccaagagggaagaaaatggcagacccagagatgctgcctgccggggaacccaggagcccagcagaggaggaggcgcagcaggcagcgtccaagaccgacttgaaaacgttcatgggcaaggcccagaaccaaaaatatcagggcacggtcaagcccacgtttagaaatggaagtcaaacattgtctcccgaggcaggtatatttatcaacaaagaggactcattattgtatagcactgaatctggacaagagacccccaaactgggcacgctggcagagggctcccttcagctccaccttcaagaccaggcagacagagtgggctcgacggcatccaggcaaaggcagaaagcagagatggagcagagaagacaaaaacaactggaatcgcttgaacaaatggaacacccagatatgagcttggaaatccactacaaagctgagctagaaaaagagaggagggagcaaagaagagctcgactggcccatctgaagtcctcctccacgagagcccaggaaagggagagaggatctgagctcagcaccacttccccatcgggcaccagcctcgccgacgacgaccggcacagtcagatgatccgagaccagcagcagcagatcttacagcaaaacaggttgcacaagcagtttcttgaagaagcccggaaatgcttgcgggagtttcagaacatatgctaaatgcgagaggcccacccggggtaaatacatcactgataatggtgctgccagcactggtacccgggtctctaagatctgtgtttgcgtcattgcctcagagactattaggcctctttaaaatgggcaatctggggccgggtgcagtggcgcacgcctgtaatcccagcactttgggaggccgaggtcggcctcaggatcacctgaggtcaggagtttgagaccagcctggccaacatggcgaaaccccgtttttactaaaaatataaaaattagctgggtgtgatggcatgtgcctgtaacctcagctactcaggaaattgaggcaggagaatcacttgaacctgggaggcggaggttgcagtgagtcgagattgcaccactgtactccagcctgggtgacagagtgagactcgtctcaaaaaaaaaaaaaaaaagcaatctgtcattataccgtcctccagggcacattccctcacagggactctttccctaatcttgcctttattgattgattgattgattgagacggagtcttgctctgttgcccaggctagagtgcagtggtgcagtctcgactcagtacctctgtctcctgggcttaagcaattctcctgcctcagcctcccgagtagctgggattataggcgcctgccaccatgcctggctaattttttgtatttttaatagacacagggtttcaccatgttggctaggctggtcttgaactcctgatctcgtgatccgcctgccttggcctcccaaagtgctgggattacagacttgagccaccgcgcctggcctagtcttgcctttaaaacgaagtcccttttgggaaaccacctatatacaaaaataggaacccgtgtgggtttcagtgggtgtgtctagcccatgtgctgtggatgcatctcccagagccgatcatgtcactacattccagcctgggtgacagtctgttttcaggggccacaggcacagatggagactccaggtcatttaagcccttcagatgttttagccaaataaacactggcctttcaggggcacccaaggtcagacgggcacaatttcaggagatagatcacttagtgcttagccaaggctgagacattaacggagattgaaccaaagctaaaacctcttagtctttcaaagtcacaacaaaaccaacattgtttaaatagcacgtcgcttaatacattcttataactttaagagaaaagagagtagacggaaaagagaagacaagccaccctcgccccgctgggtgattccctctggggctggcaagggtgtcggcacctgggtgtttgatcagtttcctccccgctagctttgccactgacctggcatccaccagagccatggagacctcacactgggtagcttctcttctgccaattgcagtcttagggacaggcacagggatcaacatactttttctgcaaagagccagagagtaaatattttagcctttgccagctgtgcagcccccgtggtaattacccagctctactgcagctgctcagaagcagccacagatgagatgtaaatgaaagggcgtggccaggttccaatgagactctacaaaaataggtggtgagcggcatctgccctttgtgccatagtttgctgatccctgtactaggatggtttcagagtctgtctctctccctcccttccaacaacctcagatacattgacttagatcaaccaatctttgttcatgacacattagtatcattggtccacgaatggccttacttatgtatattttgtagacaatataatgaagtaccatgagcccatcacccagacccaagacccagaatattcactacctgtgcgctacctcccttttccatccccctgctgcctccttggacatatacctgctgatggctcacacctacaatcccaacattttgggaagccagcgcaggaggatcacttgagcccaggaattcgagaccagcgtgggcaacatggggagaccctatcctacaaaaaataaaaaattagctgagcatagcggcctgcacctacagtcccagctactcgtgaggctgaggcaagaggttcatttgagccccagagactgaggccgcacagggagctgtgatcacgccactgccagcctgggtgacagagcgagaccctgtctcagaaacaaaaagatactggacgcggtggctcacacctgtaatcccagcacgttgggaggccaaggcgggcggattgcttgaggtcaggagtttgagaacagcctggtcaacactgtgaaacgctgtctctactaaaaatacaaaaaattagccgggcgtggtggtggcatctgtaatcccagctactcaggaggctgaggcaggagaattgcttgaatccgggaggtggaggttgcagtgagccaagattgcgccactgcactccagcctgggtgtcagagcgagactccatctcaaaaaaggaaaaaaaaaaaaaagaaacaaaaagatatatacctgctgaacttggggtttagccctccctatctttatccatatatgtatgctaaacatagtgtttagttttacttggttttgaactttataaaaaggatattatgtggagtcttttgaaagctaggttttttggcctcggcacggttactgaattcatccacatcacacaaacgcctcttactcattttcactgcagcatatcctcatcgcgtgtatgagcttctttccaggatcatagcttctccagtttcgtgcttgtttccaaaaagaggactatatctctgatgcatttgaatcaaaggaccgggtgtcaaaaagtgcttttggcacagctgggatgtaggtgtgggaaagatcccgtttattgctctttttttttttttcctatttttttttttttccccagaaaaagattgacctgctcttataaaatatttaatttacaaatatgaggctgggcgcgtttgctcatacctgtaatcccagcactgtgagaggccgaggcaggtggatcacttgaggtcatgagttcgaggccagcctggccaacagggtgaaaccccgtctctactaaaaatacggaaattagccgggcgtggcggcgcgcacttgtagtcccagctattcgggaggctgaggcaggagaatcgcttgaacccaggaggcggaggttgcagtgagctgagatcatgccactgcactccagcctggggacagagggagactccatctcaaaataaataaataaatttacagatatgagtcctagacactgtcccagtcactagagatgagcagtgagccacacacatggaaccacaggactcccgttctggtggaggacgcagatgatgagtgagtaaaagctggaactatggctgtgcaggacaaggtgctcagtgggaccccaagtgcacgcctctgagaaactcaagccggacttccctggcgaatgcgaagctcgtggaaccaacaagcgttacgctcatttggacggggcgggagtagcatcccacaagactcttttgtttttgcttttgggttctttaatcattagtagcttaggtctctgttgtctgtggctttctgcttcaggccaagtagaggaaattcgaggctgggcatggtggctcacacctgtaatcccagcactctgggaggccaaagcaggtggatggcttgagcccaggaatatgagaccagcctgggcaacatagtgagattgtgtctctataaaaacaaaaagtagccaggcatactggcgtgcacctatagttccagctactagggaggctgaggtgggatgatctcttgaacctgggaggtcgaggctgcagtgagctgtgattgcgccgctgcactccagcttcagtgacagagaccctgtcttagggggaaaaaaaaagaagaagaaaattttgatcttagcctggtttctttctatcctctgcttccagaatgtcatgggctagggttgcaaagccactccacaatttgctataggctcaacatgattaagaaggaaactgggggtcaggagggctgctgtttttcaaaagccacatagatttctcggggtggggtgtcaccgtgctcctgctgtttctgcacttgccttgtgcccagctattttttgcacacggagacctggagcgtagccgcctgtcagtgtagcatcacctctgtctgagagggcagagagggtgttatggcatgactgagttaaaagccatggccacaatggggcccaaacattgagtagccgaggtcttcctgccttagcctggaagccacagtctgatgggggaaccagcctgcctttgagtgggttatttttgtttccattttcaaaggtagcatttgtgacccatgtgttctaggtgaggaatcgccccttcttgaccacacgagctaaaactaggcgtggagacgggcagcaagacagtgtggagggtgactcatctctgcccggacggtcacacctgcactgtcccctggcagcaggaccagacacccggccctttcccacctgtcctgcagaaggctaaggggacagggtggttctttaactagggcattggtgtgggcactaaaacagccctccaggatgtccacacccaaaaccatggccctccagtgattcttacggagatgtcatgagtaactttccatcccagggcctggcagtgcctgtgttcccctccccccttggtcaccttggcacagctggactgcggtagaaagggctgtggagcagcctccagcttcccctggctcaccccgtcccatgcctccacccagagcctccaccaggagctggtgagagccctactgccggggttggagccctggctctgccatttgccagcagctaggtgacctgggcagagtgttaaggtttctgcacttcctccaaggcctggccctccacctcctgcccctcacacccctcacacccctcacacccagcttccagcatctctcttcccaccacctctcttccggacacaagtgcacagggcctgccccctgccttgcgagcctaaatcctccccgaagtgccaggcacctcatagggctatgttggcgggctcaggggtgccccctggactcacaccccagcccttgcccagccttcatttgactgtaaaacaagggatggagccacccggaagggtgtggggctcctgaggtttccagagagcactgccatgccagcagcggtgaggatcccagatgtggtggccgtgttcaccttcatcctaaggcacttccaggtaccccgcacggttctcctgctccgaacactttgcaccttctagagctctgctctggtttggtgcttctgcccccacccttgggggacagattccgtgttcgcgcctcactctgcatttgctggaaccttcgtcctccggccccatctttgctccctgccttgtgggtccttctccccaaaccacagggacccaggaaggcctccgtggctgagcagtggtgcgtgggtcgccctgttggtccgtgaggcttggacggggagcagcagcgttgcttgtgctttctgccgaggtcagctgtccatgggctgaggggggccagcagggtctggcaggtgctacctgttcacctcctggcctgctcccccccaacctgctggccagttgggctttggatgtgaccccaccctgagagctgccctggggcgtccatcttctctccgcacaaatctcccttccccttcaagccctgtgtgaccaggatctccgacacataagacaaaaggaaatagggtttttagagtggacgggtgggtagagcaccctccctgacctgtggtcattcttccagttcgtgcaaatggcaagggggttatatcgagatctccaagaagacacggggcggagggctggggtgcagcctgcacttgcagctgctgtgacagcccaggccaagtcctccagctggagacggggctacacagatgcacaccccccaggacaagcttagggagtctgggggcgccgctcagcatggggcttgtttgggaagctgtgctgaggaggaagggaaaggggagtggggacctcagcccccctgctttcattctttcctgggtgtgtggaccctgggattccagccttcatgtccttcatgtccctgtttctgtctcctgagaaatgcagcaagtcaggctcagcccacaggccacatgaccctgggtccgacgaacagccagggctcaaagacagtcagtgccaatgagcctgaagcctgggcccggacctcacgttcgtccccaaaaatggatcggcttgggaggaacagtgccctgcccacctcgcgctgtcgcagccccccagcaacagtgcgaggagagaatctgctgctgcccctggctccggagttgtcaccctggccccctgctcatctgttgtaggggggcgggttgcagggatgggtaggggtttcctcggtgcctctccaggctccctctgcctcctgccctgcacggtcctgctcctgtccctgctccggctctggcttagggtttgcagggctgagcttggctgttccgtgggtcttgacggagaaaatgcagagctgcacttccctccacaaagccgcactgttctcagcaaatcctcccggggtctggtgcattgttttcaagtgattcagcagcacgtgaatgggaagggccgagccggaggctctggcatgagacctgctggcccaccagggaaagggagggcagcgggacgtgggccccgaggtcctcccagagctgcagagggagggggcagggccctggggttggggagggcggcaggaaggctgggcagagagggcggctttgctctgcgtggctgaggtgctctgatagatgctgtttcccaagaggagccaaaacgaatgggcaggaagtgagatgggagagctggtctccatggagacgggcacccagtggccagcagctcacgtgcactagaatctcaggcagccggggagggagcattccctggggcggcagggcctggagcacccccaggtgcccgctggcaggcggtgtggccccggctgaggctgcgcttctgttccctgatctctgttgtgcaccctgttaccttctctgccccaccctcctccgcaccctccccaacaaaatatcttttctgagtagttgtcattccaggcgtttttcaccctggcctgagtcatgctggccaagtcctctgtcctcaccctggatgtcacggtcccgccctgcaccagggctgcaagtcaccactgagggtggacctggggcctctctgtcccagccacccacaaactctcaaggtcagagtctggaaagggaggtggtgccccatgtcttcacttccggtgtctacaccctcaactggggacggatgtccagtgtgctcctatggtgccccctctgctgaggtctttcctgcttcccagaaggccccgttgctggcttccgggggccgaggaggttggaggacctgagggtgggtctggcctccacagcagctgcagggcgggaagagcctggttcctgcccagcaccacagggctgtttttaattaccaagtcacggccctcttttctgctcatttccctaaaaggagtgaatttggaggaggtctgccgcacccgctgaccaaaaggggctggcatgaaggggccgaggaagggcagagcccagtgcccgggggagaccctctgactgcccaccaagggcacccggctgtgtcacttgaggccagaggctgaaggtgagctggaccagctaaccctcactgtcacctcacaacacttgtgacacttcctggctgctcagccttgccccgtgcccctgggcagttccgttgggagaggcgtggcctccaaacctagaggactagagcaggtctggggtccttgtgagcacagccccttcctggatcaccgtctgccatccctggtggcgtttgtggccacttctgctgctccagctggcgaggtcggccccatcctgctaaaagaaggaggtgctgcccgaatggagagcttccatgtttctaagctgtctttactgtgatcctgaagcccaacgagattagttacacacaaacatttagggatcccacagcgatctgagagcagggccatgaaaaatagtcatttattacagcagttgcagggcagggccacagctgtgttactggacatctgtcctgagctgagggtgtagacaccagaagtggggaaagtgggcttcacctcccttttcagactctgatcttgtgggtggctggggcagaggggcccctggtacaccctcagctggcgctttagacatattaatcaaaatggtcaggccgggccaggtggctcacgcctgtaatcccagcactctgggaggccaagatgggtggatcacgtgaggtcaggagttcaagaccagcctggccaacatggtgaaaccccatctctactaaaaatacacaaaataaaaatcagccgggcatggtggcgggcacctgtaatcccagctactccagaggctgaggcaggagaatcgcttgaacccaggaggccgaggttgcagtgagccaacgtcgtgccattgcattccagcctgggcgacaagagcgaaactctatctcaaaaaaaaaagaggatatggagcccctgccaggttgaccagccatatggtgtcattacatccacccaaaagggacaagagactctcatccccaatggcaacgccaagttatagttacagatgttagcaagggcgttactaactgtgtgatttgagggtgtggacattggcactcatggcaccccacttttctggagagtttagacaaggcgtggaacgtcacagtcctttcccagtgaaagaacaaagctgagtccacctgcaactgccattggatcctccccaggagtaagtggaggttgggtttcatccgggagagaaaatggtttctttgataattcctctgaaatgactggcatgtaattccacccagagccaaatgaaccaaatgacgctcagaagacgtctgcggctccggcctgcagttaccgcgtttgcgtctacgcagtgtggagtcctccagggctggcccctgggatgcatgcagtggccactggtcttcattgccactgtgggtgctctgggctgactctgacccagctgcagcatcagaatgccccccacccactagtgatgtgggccagtagggtctttggcacatgtgtgaagcccccacccgactcccaggaatgacccatgttgagaacatggggaccccttggcgttctccgctgggccataagcaggacaggacagaggggaaggaggcgctttccctgccagtgctggtcctatgggcgcccctccccaggtgaaagctggagcctgcagaagagggtggacggctgggaggggccagtgccctccagtgatactgagcaaaccctcccagtccgagtcagtgtgcacacaaggtgcagatgatcgggccgggttttgactttgtatttagcagccgaatgtgtttctgagtcccagggatccctgcacctcgtctgggcagacaggtgactttgagggacagtgggccaccttctcccgctgcctgagcacgtcccgtagccgagacaggcgctatgctgttacagtgtgtggagtgccccggggagaggctgtgagtggtctagacgttgggtgttgatatccaccggtttgcctgtcccaaacttgggcctgggagcccggcagagtggctcaagtggaaaatgttctatatggtatatttatacatatagcatgtgggattcctccagcgagcagttgggcccctggcaagataataaagagaattcaatgagtgtggaataagtacatttcttacaggcaattttctttttctttcaaaggcagggtctggttctttcacccaggaccgaggtgcagtggtgcattcatagctcactgcagccttgaacatctagttcatacaattctcctgagtagctgggactataggcagatgccaccacgcccagctaatttttgtttttttttgtttttgttttttgtattttgttttttatagatgaggtattgctatgttgctcaggctggtcttgaactcctagcttcaagcaacccatccaccttggcctcccaagtgctgggattacaagtgtgagccactgcacccggcctttcgaggcaattttcttttggggtctgtctccctcccccaattgtgggcatggcttgttcttattttccgcaggaacttccatagtacttctgtggacacaggaggattggaaagatgttggtgggtgtatgaaggggacgtgaggacgcaggacccacgtgttgatggcagcagaggggacaccgaggagagagaacaagggaggaccgtgccacagaagccgtggcgtctctgcctggggctggcgtggttggagtctgtggagagtgccgcccctccggccagcccttggccctggcacatgctggtgacaccaggttctccagcaagcccccttcactgtctgctcccctccgagagcagcagcagccggtccggcctctgatggttttccaggggcggttgtgactgtcgaagtctgaccgtagcccatcctctttggatcgtctcccgcgaccttggttttccgcccacccggttcttttccgtccccactctggcgggtgcgctcgggattgtttttgcaggggggaagtgacatcatatggtgtcctgggctggaggggtgggggtggggaccctgcagttgcgtgtgctttgaattcagccgacggttgtacattccagtagccggcatctggcggtgaattcatcagccagtgtatcacccttgatctcaaacccagatgttgtgttcacagcagaagggaaagaaggaaaaacgaaatctgagacgcccagggagaggccgtggtttctgggctcagggcagttagaacgagagtctttataaagactccccctctcgcagctgcctctggctccttggggaaggggcagaggagcagagcagcccctctcgggggcatggacaggagatgggctgacacccaccccagtgcctaacaccaggcccagcacccagtaggtgttcagtaaacgtgtctgtgccacaattttcatttcttcccagattccttatgtctcttcgctttccccagccctgttcttcacatggcctgggactcggagaggccctccctcttttgaagtggcctgctttcccctacagaactggtggtccatcctggagctcagagtgcggaccattgccattggcatggaaatgtattccggagagctctctctccctcctcctctgtccaccactgggcattggaaactctccttctctgtgttcctatccatcgtctgtcatcttgcctggattggatgctcctcccaggcaaggcctgctgtatgcaggattcaccctgtaccctctcttcacctgctgtcacctctgggcaacaacccccgacaggtacccgctgctctgagcaggtcagcggtgcagatcccgctatgccaactggtgtgcaccgatcagagctgtcagctggcccctctccttcatgtctgcggcgtgctggtgctttggggaaggttgccgtggaactggtccttctttgcctctcttgattcccattttccttctttcatgtaatttctcattttgcaaagtgggggaggaggtgcccacccccaatttaaagggaccctgaagaatctgaattctgttccccaggggcagactaaagcagcccaggggagatggagatgccctcaggctctgctcctccaggcccctcacccccacttccctgcccctcacccccacttccctgcaggcatctggcggcctcctcgccagttcactttctagtcctaaccccacgtggctaccctggacccttgatttgaccagcctcctcttttctgacactttaaagaaggaaagtgtgtaatctgcagcccccaggcaaagctagcacgctgggaagctgcatcaaatcgagagtctgtggcctgctgaccaggaccgggtctgtgtacctgagtggcatgatgccaccgtcccaatccctcacccacgggagcgggagaattcgccctgcttgtctatgcgatgctcgtggtcctgaactgtacacgcattagttcccgggcaccgcagcctccacaccagcccctctaacagtcaccacgaccttgtgaagtgtcaagactgttgtcatcgtctctgtcttaggtgtgaacaactgtggctcagtgaagtcaaggagcttctcaaagatcacgcagccatccaggggtgaatgcaggatctctgtctcttgctgcctccttcaaataagtgcccagctgccacctgggagccttaggcgtttttgtaagagaacagcatgtgaacctcaatgcccatggtaggatgcaacattttggccgttttgaagtaatctttgcttattttctgaactccagtgacatgcttgttgagtgcctattgtgcgttaagcattgtgcggcttagtggaccattgaaaggcagctccaaggccgggcgcggtagctcatgcctgtaatcccagcacgttgggaggccgaggcaggcggatcacgaggtcaggagttcaagaccatcctggccagcatggtgaaaccccgtctctactaaaataaatacaaaaaattagccgggcatggtggcgcgtgcctgtaatcccagctacttgggaggctgaggcaggagaattgcttgaacccaggaggcggaggttgcagtgggccaagattgcaccattgcactccagcctggatgacagagctagactccatctcaaaaaaaaaaaaaagaaagaaagaaaagaaaagcagctccagaaatttccaaaataacatacagaattcagcagactgtaataaaggccggcttgctgctcctactggaactgttgattcctttggattctgctggcttgctttttttccttttctttcttttctttttttaaaagacggagtctcactctgttgcccaggctggagtgcagtggcatgatctcagctcactgcaactttcacctcctgggttcaagcgattctcctgcctcagcctcccaagtggctgggatttttgtattttttgtagagatggggtttcaccatgttggctaggctggtctcaaactcctgacctcaagtgatccgcccgcctcggcctcccgaagtgctgggattataggagtgagccaccgtgcctggccctggtttgcttgtgagctggtgactctgctacatgaagagcaaactttgaccaagttaatctggcacattgactaatttgcataaacatttttggtgcagcattgtcgtaaggtatatagattaggcagggagcaagagagccaaggacaaactgcacctgggccaccagcccaaagttgtcagcgtcatctcagctccatctggcaaagagttagtgagcaccaactgttctgcagtcagaatctagcctcaacctgttaggacctcccagggccctgagcagacaggtgtgcaggaactgacagcaggatggaaaagagatggggaatataccaagtgctgcagaaggacaggatttcccagaggaagacagaaaagggctattttagctgggtcttgaagaatgaagaaaagttctccaggcagagaggggagatggcatttggggcggaagaaacttgcctgttcaggctgggtgtggtggctcacacctgtaatcccagcactttgggaggccaaagtgggcggatcacttgaggtcaggagttcgagaccagcctggccaacatgctaaaaccctgtctctactaaaaataccaaaaaaaaaaaaaattagcctggcaaggtggcagttacctgtaaccccagctactcaggaggctgaggcaggagaattgcttgaacctgggaggtggaggttgcagtgagctgagatcaagccattgcactccagcctgggtgacaaaagtgaaactccgtctcaaaaaaatatatatggtaattagccaggcatggtggtgcccacctgtaatcccagctacctgggaagctaaggcaggagagtcatttgaacctgggagatggctgagattgcgccactgcactccagcctagcaggggtggggatgacagagcaagactctgtctaaaaaaaaaagaaagaaagaaacttgtctgttcagaggtgtggatgcacctgggcgtgttcagggcagacaagtattatgaagtggtagaatagtgggagcatgggtggggggtgttgggcacagcagctgaggcccctggctgacttcaggttgcaaaggcgctcatattttaggggagggcagggggcagccaaggatgatgtttgagcagaaacgaacgtgaataaaaaaagacagctggttgcggtggatgagaggatggttaggagggcactggaaatagggggccgtcagggcaaagccgtctgttctggagtggcctgccgggagacatttcctagatgtggcttttcaggatgaggcatggattagcctgggaaacaggaacctgtggccttggccagtcatgactcagctccaacagaagaagaaagaagaaaggggtttgtgcccaggcgaggcagtggggctgtggtgtgggactctgatgccagcctgggatccagagagcattggtggggcccagggggatggacacagatggagcacccacacgcctgagcctccttgcccctgtgggaagagacagccctgcctaaggggttctaagagatttgagccgaccacgtggggtggggctggggctggggctaggaggctgcctggagcctggcgtggtctgctccttacctctctgttttgctcatatccaccgtaacataacacttacccagagtgaccctgaagagctgagtttgggagggcaaagcttttaaagccattaaaacagaccatgtcaccaactaatggccttgaaattaagaaagggagggctctacccaaccctgcccaagtgacagcatgaactactgatctgcttgtcctcaggttaccaggagtggaacagaatcctggcttaattgctaggagaaagccctgtgttgcatggcctgtcagcaacctcaggctccagaatattctggaattgccccagcccagcctcttccccaactcctttctgtttggttggggcttagttgggatcctctttccttctgtttgtccttcctcagcatctgtcccttgggtctgccagctgtgcctgccgatgtctcctttgggtgaaacttcctgcccctgcccctgttgtgcccctgatagactctgtgttactgtaaagaatcacccaggctgggcgcagtggctcacgcctgtaatctcagcactttgggaggccgaagcaggtggatcatttgaagtcaggagttcgagaacagcctggccaacatgatgaaaccctgtctctactaaaaatacaaaaattaaggttgggcactgtagctcatgcctataatcccagcactttgggaggctgaggcaggtggatcacctgaggtcaggagctcaagaccagcctggccaacatggcgaaacgctttctctactaaaaatacaaaaattagctgggtgtggtggcagctgcctataatcagagctacttgagaagctgaggcaggagaatttcttgaacccaggaggcagaagttgcagtgagccaagatcatgccactgcactctagcctggacgacagagtgagactccgtctgaaaaaaaaaaaaaattaaccgggcgtggtgacagacgcctgtaatcccagctacttgagaggctgaggcaggagaatcacttgaacctgggagatagaggttgcagtgagccaaaacggtgccactgcactccagcctgggcaacagcgcgagactccatctcaataacaacaacaacaaaaattactcatagaacattttccaggtcaggaaagatgagaagagctggatagacctttccagatgtaagacccccaaagctaaatatgccgggtacgtttaaggcccctttaaggtggataactccccctctgccctcagcccagaaaagcttgtttccaataggccgtggctggagggtggggaaatgtcccatccttcgcggaatgtgtgggattgtgggtcagttccatggggtacctgcttgccccagccaccagtgagtacccactggagagaaggaaaaaaaaagccaaaagcactcaagcatgatatcaacagatgagcttcagtcaaatcaatgactgcctcccactgttacagaaactgccttggtcacaagggactctgggcttctggcttgggcccctgtcaacaaagaagggattcttgttgaagaatcgtggaaggaggaggaggaggctgggcatcatctctcagcctggaggaggagacgccatgccgggggctgggatcaccatgccccttgcccgtctcgcaccttgctgctgtctgtaaccccccagcacctcccgcaggcctggacgtcttatccctctccttagccccaggagcgtgtttcaggaactctcctcacctctgtgtcttgtgttttgcagtgatcagggccaaagcggtcagtgagaaggaagtggactctggaaacgacatttatggcaaccctatcaagaggatccagtatgagatcaagcagataaaggtaatagtggctgccggcatcccgggctgcactgtgggcacagctgtggggtgttggggttggcagagagcctgggtccctggaacacgatctggccacctgtggactagagcagaggatgaggtcatcaagctgcaaatagatccgatttcccttaatcctcgaatgcctgaaaagttgtgtggagatgacatgctccccacaaattcaattccttcagaaacctgtccgggcgttgcggctcacacctgtaatcccagcacttcgggaggccgaggtgggcggatcacttgagctcaggagttcaagaccagtctgggcaacatggtgaaaatccatctctacaaaaaaccagccaggcatggtagcgcccacctgtggtcccagctattcgggaggctgaggtgggagaatcgcttaagcccaggaggcagaggttgcagtgagacatctcaccactgtattccagcctgggtgacagagtgagagcttgtattaaaaaaaaaaaaaaaaaatatgtggcagggagggcagggagggcagggcctggcctggggcaggagaggtgatgctattgtcattgacagtaactaacatggtctgtaagagagacgaaaattcatgtcgcaggtggagggacagccgtgtgatatggtggtagttgtagtcatcgatatttaattttgtcattaaaaataaaaagtaaaccaggcacagtgtctcatgagtatagtcccaggtgagtggatcacctgaagtcaggagttcaagaccagcctggccaacatggagaaaccccatgtatctactaaaaatacaaaaattagctgggcgtggtggcgagtgcctgtgatcccagctacttgggaggctgaggcaggagaacacttaaacctgggaggcagaggttgccgtgagctgagattgcaccactgcattccagcctgtgcgacaagagcgaaactccatctcaaaaaaagaaaaaaaaaaaagtagctgaaaatcaatgttatcagaaggtcagtggaatgcttcatcatcacatgtatgtcagtttaaggggatgacctagtctctcagtgcctgagtctctttctttacgaagcaggaaagaggatctgctcttacgacctcataaaggggtcgtgaaaaggccagtgccagtgcccaggaaatgcttttagccttttggcaaatgatgtcatttagtacagcatcaacataacctttcctggtacaagctggagtgtcactctcaagccatttgtcatgacatcaggcatgcttccattccatttgggtttgcttattgaaactcttcggggggaaaaaaacagcctccctgagtgctgagaaaatgccattcttcacctgggcagcaggtgcgttcctgaaaggctgtgagtaaatcacatgttgagaaagcaaactcttctggcccatggagttatgtcctaattcctgaggtgcctctctgctctcattgccatcaagtagacaatatttgaccaaaattcctggaaatataggttgggtggagtgacttatgcctgtaatcccagaactttgggaggccgaggcaggaggattgcttgagctcaggagtttgagaccagcctgggtaatagagcgagacctcgtctctgctaattaaaaaaaaaaaaaagccaagcatggtggcatgcgcctatagtcccagctactcgggaggctgaggtgggaggatcacttgagcctgggaagttgaggttgcagccccagcctgagcaacagagtgagaccctatctcaaaaaaataaaaaattcctggaaatatgcaaaagtcatggtccttcatggtggtccagagtcacgtggaggtacaaaagcccctccccatagattcagaaatgacctctttggggtggggggtgagggaacagaggtgttgtctgaggatgtcatgctccagatgacagtctttttttttttttttgagatggagtcttgctgtctcccaggctggagcgcagtggcacgatcatggctcactgcaagctccgcctcctgggttcacgccattctcctgcctcagcctcccgagtagctgggactacaggcgcccgccaccacgcccagctaaatttctgtatttttagtagagacagggtttcaccatgttagccaggatggtgtcgatcttctgacctcgtgatctgcctgcctcggcctcccaaagtgctgggattactggtgtgagccacttcgcccggcacagatgagtcttgtgctcacctgctgtgatctgccacactaaaagttgagtgactccaaagaatcactttgctataagaagtctttttcttttctttttttttttttttttttttgacggagtcttactctgtcatacaggtaggagtacagtggcgccatctcagctcactgcaacctccacctcgcaggttcaagcgattctcctgcctcagcctcccacatagctgggattacaggcgcttgccaccatgctcagctaatttttgtatttttagtagaaacagggttttgctacgttggccaggctggtctcaaactcctgacctcaagcgacctgcccacctcagcctcccaaagtgctgggactacagccatgagccctgagcccagctggaacggtcttttcctaacccatgtatttgcacttcctggtcctcttgggtgctggctgtaccccagctacaggttgtgccgcccagggtgttctggatgggaacggaattcaccaactgtgtggcctccctctgcttacatgtcctcctccttgtctttccagatgttcaaagggcctgagaaggatatagagtttatctacacggccccctcctcggcagtgtgtggggtctcgctggacgttggaggaaagaaggaatatctcattgcaggtgtgtatgagtggggccatcagccggaggctggcacagaagtggggctgttcctagacgcggtccagggctcgtttcccaggctcggggggtggggaggcggagtagctgaggaacagtgaggcagggtacggagccctctcggccacttcccgtcagagaatgctagtgaatgttcactacctgccaatttcctgggaaatttgagattggtggacaaaaaaaagggagcatttttgccttttgttcctaaaagggaggcgagtgcgggatgctggagacatgcagggcagagaaaccctttctgccgtcgggagggccaaaagctcgcgtaacatctgtggatactatgcacgagacctgcttgacttattcattcatctgtctcctttttttattgtggtaaaataatacgtaacaaaatgtagccatgttaattaaccattttctttctttctttctttctttctttctttttttttgagacagagtgtcgctctgtcgcccaggctggagtgcagtggtgcgatcttggcttactgcaacctccacctcctgggttcaagcgattctcctgcctcagcctcccgagtagttgggattacaggcacacgccaccacgcccagctaatttttgtatttttagtagagatggggttctaccgtgttggtcaggctggtctcgaactcctgacctcaggtgatccacccacctcggcctcccaaagtggcaggattacaggcgcgagccaccgcgcccggccaaccattttcaagtgtacacttcagtggcattagatacattcgctattgtgcaaccatcaccaccatctgtctccacatcttcccaaaccaaaactccgtccccgttaaacactaactcccccttctctcttcctcagccttggcccacctccattttactttctgtctctgtggatttgactactccaggggcctcacatgggtggaaccctgcagtgtttgtcctctctgtctggcttatttcagtagcatcatgttttcaaggttcgttcacgttacagcatacatcagaatttccttactcttttttttgtttttgagacagagtctcgctctatttcccaggctggggtgcaatggcactatctcggctcactgcaacctccgcttcccaggttcaagcgattctcctgcctcagcctctcaagtagctgggattataggcacacgccaccacacctggctaatttttttttgtatttttagtacagacagggtttcaccacgttgaccaggctggtctccaacttctgacctcaggtgatccgcccacctcagcctcccaaagtgttgggattacaggcgtgagccaccacacccggcccaaaatgtccttactttttaaggatgaataatatttcattgtatgaatgtagcacattttgtttattgttgcatctctttgtttatagttttttggtttgttttttttttttttgagacaaagtcttgctctgtttcccaggctggagtgcgatcatgactcactgcaacctcgatctcctggggtcaagtgatcctctcgcctcagcctcccaaagtgctgagatcaactacaggtgtgtgccaccacacccagctaatttttttattttttggtaaagaagtctcaccatgttgcccaggctggtcttgaactccgaggctcaagcaatcctcctgcctcagcctcccaaagtactgggattataggcgtgagccactgtgcccagcctatatttttattcctaagtaaaattattttcccttacttccttctacggcctcctctgcttgcccagctaggctgaaccacaggaggccaggacaggattctcaatctcagcactattaacatttggggatggaccattctttgttgtgggggcctaccttatgcattataggatattcagctgcatccctggcccccaccctctacatgccacagcacccgctccagtcgcggggtctctggacattgccacatgtgcccaggggaggtggggtagattgcccctgcttgagaaccactgggctcaaagagctttctgcagtgatggaagcggtctctgcaccatccagtccagcagcccccagccttgtggctcatgagcacccgagatatggctagtgcagccgaggagctgcattttaaattttatttcatttcaagtaattttagtataaatgtaaacagccacatgtggccggcagccgcagtctagcatggcactgactcagccagttaaggaacattattcccctcctccctggggaagtaggaatctgatcacaaacttaagaaaaaaagaatagacaaggcctggtgcagtggctcatggctgtaatcccagcaatgtaggaggctgaggcgggcggattgcttgaggtcaggagttcaagaccagccttgccaacatggtaaaaccctgtctgtactaaaaatacaaaaattagctgggcgtggtggcaagtgcctgtagtcccagctactcaggaggctgaggcatgagaatcatttgaacccaggaggcagagattgcagcaagctgagatcacgccactgtactccagcctgggtgactgagcaagaccccatctcacaaaaaaaaaagagaaaagaaagaagagacaagacaattcccctagcctggtactatagtttgttccaaaaggcaactgtaatcataaacatatactccaaatccaaatatccatgattgggggattttcttctggtttaggtgacatgtacttttttcccttctaaaaatcaatgtgtgcttagtgagcacctgttaggtgcccagccccgtgttagagacaatgggagattcccacggtgagatccttggctctggtcatcatggagcacacagatgttccgaatggggagactggaaaagaaagaaaatagattttgcttgtggagaattgtgaatagtaagtgaatgcttagaaggtgcaaaaggggccgggcgaggtggctcacgcctgtaatcctagcactttgggaggccgagacgggcagatcatgaggtcaggagattgagaccatcctggctaacacagtgaaaccccgtttccactgaaaatacaaaaaaaaaattagccgggcgtggtggcgggcgcctgtagtcccagctactcaagaggctgaggcaggagaatggcgtgaacccgggaggcggaacttgtagtgagccgagatcgtgccactgcactccagtctgggcgacagagtgagactccatctcaaaaaaaaaaaaaaaaaaagaaggtacaaaaggaagagagactctcacaggtccaagggtctagacagacttgctgctggaagaaggtggtgtccttgcctatggatggggaggaggtcattgcagggaggaagatgcagggctgtgagttgggcagggaagactcctgttatctccccttgggtaagatcttccctcccttccttaacatgctcacagctcctgctttgctgggtatctcggtcatcaagacttctatccctctccttggggataataggagacttcccccccttttaagatgcatttctggacttcctaaaatgttttattatgagcacttttcttattctcattccaagacagagtctccctctgttgcccaggctggaatgcagtggtgtgatcttggctcacagcaacctctgcctcctgggcaattctcgtgcctcagccacccaagtagctgggattacagatgtgtgcccccatacctggctaatttttgtatttttagtagatacggggtttcaccatgttggccaggctggtcttgaactcctgacttcaggtgatctgcccgcctaggccttccaaagtgctgggattacaggcgtgagccaccgcgcccggcctacaattcagtggttttagtatgtcacagagttctgcaaccatcactacagtcaaaaagaaatcctgtattcttgagctattaccctcctgactcccctccccctcccccagccctaagcagccactggtatacttcccgtctctatagatttctctatgctgggctttcctgggaacggaatcatacgtgtgaccctgtgtaaccggcttctttcgtgtttccaagggtcatccatgttacagtgtgtatcagaatttcattcctttctatgactgagtattccactgtatggatagaccacgttttgtttatccggtcatcatttgatgtgcatttgggttgttgccaccgtttggccattgtgacaaatactgcaatgaacattggtgtgtgagattttgcagggacctgttctcatttttcctgggtgtatccctggcagtggaattggtggggtcgggggtggggaggggttgggtgactttaggtttaaccatttgaggagctggcagaccgttttccaaagcagctgcaccattttacacgcccagtattatctatgatttttacaataagaaaaaaaaaatcaaatggagaagggtagagggacaaaaaccacctgtggtgcaaagatcttaccagctaactaatgccctcaaaaaaaacacagaggaggcaggagagctggggtggccgcacagcacgcacggtggcgcgtggcagaggcatggtctgcagtgtggcattcgggggctgctgcagctgtgcacagaacagagcacgggaggaaatttcccagcgtgtcagcatctgctgtgtctccttttcagttctttcctgtattaaacctttaaaattatggcatttattacgtttgtcatcagaaaaataaaatctggagagacaagaaaggagacagaatcccccgtggtgcagggaacttacttccagttttctgcatcctgtttgttcctatccacagggaacagcctttaaagtaagtcccagccgtcccagctcagtttcgtcacactgccctctaggggctttctggccaaactgcagcgctgcggaaggactcttgggtgcaaaagtgaccttggtctgagccagcaccggtgtccaaacatacccagctgaatcctcgcccatgctgaagctctctgtttgtttttgtttttgttcgagatggagtctctctctgttgcccaggctggagtgcagtggcacaatctcgggtcactgcaatctctgcctcccgggttcaagcagttctcctgcctcagcctcccaagtagctgggattacaggtgcccaacaccacgcccagctaattttttttttttttttttgagacagagtttctgtcttgttgcccaggctggagtgcaatggcgtggtctcaactcaccacaacctctgcctcccgggttcaagtgattctcctgcctcagccttccgagtagcagggattacaggcatgtgccaccacgcctggctaattttgtatttttagtagagacgggatttctctgtgttggccaggctggtctcgaactcctgacctcaggtgatccgcccacctcggcctcccaaagtgctgggattacaggtgtgagccaccgcacctgggcggcattaagtacattcacagtgttgtgtaactatcactatctatttctagaagtttttcatcatcccaaactgaaactctctccccattaaccaataattccctgttcctctgtttgcccagcccctgacaaccacctttctacttcgtctccatgaatttgcccattctagacacctcgtacaggtagagtcatacctccttccatagctgaagcattgcacttagcataatgtcctcaagttcatccatgttgtagcatgggtcagattttattttattttatttatttatgagacggaggcaacaaagcccaggctggagtgcagtggcgcgatcttggctcactgcaacttccgccccccaggttcaagcaattttcctgcctcagcctcctgagtagctgaggttacaggcatgcaccaccacgcccagctaatttttgtatttttttagtagagacggggtttcatcatgttggtcaggctggtcttgaactcctgacctcaggtgatccgcctgccttggcttcccaaagtgctgagattacaggcttgaaccactgcacccggctggtagattttatttctttttatgtgcatacattttaaagtttccaaaatatgtaatactcttctaagttgaattctatatatgttttcaaattgttaacatttccattaactttttaactcagatactacttagtatctcaaggaggaggcacgaggttttgatgaggacacagaactaaaggtgccaagtgcaaacagtttattgcataaagaaaataaggaaatgggctgaccatagtggctcacacctgtaatcctagcattttgggaggctgaggcaggaggatggcttcaggttaggagttcaagatcagcctggacgatatagcaagaccctatctctacaaaacaggaagggaggaaggaaggaaggaaggaagggagggaggaagggggagggaggcatggaggaagggaggaagggaaggagggagggagtgaagggagtcagggagagagggagagaggcagggaagaaaggagggagggaagaagaaggaaggaaggaaggaaagaagagatgagctgggtgtggtcatgtgcacctgtagtcctagctacttgggaggctgaggcaggaagatctcttgagctcaggcatttgaggctgcagtgagctaggactgcaccactgcactctagcccaggtggcagggcgggaccctgtctctgttttagaagagaaaaagataacgactaagtgtcatgaaaagatgtgaagaaatacaatgagatgcccgagtgaaggctctgaaaacacctgctcgagttcgaatgtgtgctctgacacctgactcgttaatgtccttggccaagtaactttacctgtctgtgcctcccatgccgatccgtacatgggggatgatgacagtagtatctgccccacgaggggttgttgagaggatgaaagtgggagtaggagaccagaaatgatgatcacagagatgctggttatcttggtcaggccccactcaagggtagctgataattttatgtcttacactggagatgacagtgacccatacacgcagcacagcactgcatgaaaagctggtgagtcgatacagagagtcatactgaaggtctaaggagggctagggtagcctgtagcagaatgagcgtgaaggctctgctgaaagggcattgctccctggacctgtggcgggatcctcggtagaaagctgacattgaaagattttgaagagctttagttaaaaagttaaaaacagcccagcgcagtggctgacgcctgtgatcccagcactttgagaggctgaggcgagtggatcatgaggtcaggagattgagaccatcctggctaacacagtgaaatcccgtctctactaaaaatacaaaaaattagccaggcatggtggcgggcgcctgcagtcccagctacttgggaggctggggcaggagaatcacttgaacccgggaggcggaagttgcagtgagccaagattgtgccactgcactctagcctgggcgacagagcaagactgtccccccacccaaaaaaaataaataaaaaataaaaataaaccaatgttggcaaggctatggagtaaagggaacgcttaggaacgcttatgcgctgttggtgggaatgtaaacgagttcacccactgtggggcacactttgtagatttctcaaagaactgagaaagcaactagcatttgacccagcaatcccactgctgggtgtatacccaaaggaaaataaatcgttcaacggcactgcgcccgtatgttcattaccgcactatctgcaatagcaaagacacagaatcaacccaagtgctcatcaatggtgacttggataaagaaatgtggtgtatatatactacggaatactacgcagccgtgaaaaggagggaaatcatgtcctttgcagccacatgagtgcagctggaaaccattatcctaagggaactagtgcaaaaacagaaaaccaaataccacatgttctcacttaaaagtgggagctaaacattgggtacacatggtcataaaaatgtgaacaagagacactggggaatacaaggaggtgggagggaggaagcaggataagggctgaaaaaattctacctattgggcgctatgcccactacctgggcgatggatccgttcatatgccaaacctcagggacacacaatatacccatgtaacaaatctgcacatggacttcctgtttctaaaaatcaacaaagattgtgagacctgcccagtggccagctggctgtgtatcttctccaccaatgaggctgcattacttcatcctcctctccctgggagggggagcaggggtgaagctgttaatggccacagtggctgactcacctcatggcgagaggaacctctctcatctgacttctttcccagccttggtcagatgactccacattgaatctggcatttatttcccgaggcaggaacctagatccagtttgcctcgagtcaggatagaccctttatccaggggctaaccagaaatcacagggcacagtgaaccactcagctctggctggctgtggccagtgagtgaccgcatggcctgagcgggccacctcctcctggaccgatgactcagtctcacgtgtcgagtcgggcaccaggagactcatacagagttggccctgtaattttcttctacattcctcttctccaaaaggaaaaataaacatacaacccttcgttacaaattttaattcccggttttctgtaacccagactcatgcctcgcttttctcggagacagacataagtagaacatcgctgcagatgctcacggtgtgtacacccaaccaagtcttaatcagaccagaggcggtcctctcttcacatttatacatgacagccacgttcatgttagcccaataactaggaccattgaaaagatacaattttttggctgggcgcagtggatcacttgaagtcaggagttcaagaccagcccagccaacatggtgaaaccgtgtctctactaaaaaatacaaagattagccatgggtggtggcgcatacctgtaatcccaattttttgggaggctaaggcaggagaatgcttgaacctgggaggcagaggttccagtgagtcgagatggcaccgctgcactccagcctcggtgacagagcaagactccgtctccaaaaaaaaaaaaaagaaaaaatacaattttcacttcatctcttcttcctgccattgcttacctcctgaggaagccagaattggtggtaaaaggccaaaagagaagatggcaggaaaaggcagaatgtgaagcatatcattagaacaagcacgggtgtgtctcatcagtaaacttattgagcaattactatgtgcagggaactgtggaaacaaaagggttaagacacagcccttactctctatacgtactctctgattaaggagcgagatgcagaagaaaggcaaatctaatagaaagtgggagttaatgctggtcaagtgatacatacagtggaaatcaccatagaagctgggaagccaggatagagcttcagcctgtctgtagtggcaggtgcccaggctggacagggaaggggctgcggtatacctgtatgggcgccaaatgccagaatcaaccaggatacaggaatgggttcctttccatctgtctgttttgctccttcctgatctattctgaactcacagaaaatagctataggtctagtggggaaagttatatatctaattttgattttttttttttttgagacggagtcttgctctgttgcccaggctggagtgcaatggcgcgatcttggctctttgtaacttccacctcccgggttcaagcgattctcctgcctcagcctcctgagtagctgggattacaggcatgcaccaccacccccagctaattcttatatttttagtagagacggggtttcaccgtgttggccaggttggtctcgaactcctgacctcaagtgatctgcccaccctggcctcctaaagtgctgggattacaggtgtgagccaccatgcccagctagttttgaattgtttaaggccacccaaacatttaccttatgaagttataggatttggaataaatgttacaggagtaattctactttctcatcctgttcctcacctggaatgtcacataagtctaaacggagaaaaggacccgaagataaaggaacagctagaacaggaagtgcgagcataagaattcaaacccagggagctggcacaatgagtgccccgtgcccaggacaatggaggccacttgtgtctgcttggagccccaggcaagccatccacatttccatggcacaggggtgcagtcgatgagctgcattagtccttcgctgggctgtgtttctattagtggatcctctgaggctggtgctgtgcctgagatcattaagtcagatgcgctgaaactttgtcaaacaaaagtgcttagggcacagcctgaggctctgtctgcttctcaaggaattgcccatcagtctctgccaggcgtgggtgctcatcactgacacctgtgtctcttcacaaggggctgttgtagcaggagggatgaggttttttttgtttttgtttttgttttttttgttttgaagacagagtcttactctgtcacccaggctggagtgcagtggcttgatcttgactcactgcaacctccacctcctgggttcaagtgattctcctgcctcagcctcctgagtagctgggactacaggcacccgccaccacacccggctaattttttgtattttttttattttatgtatttatttgagatggagttttgctcttgtcactgaggctggaatgtagtggcatgacctcttctcgctgtaacctctgcccactgggttcaagcgattctcctgcctcagcctcccgagtagctgggattacaggtacccacgaccatgcccagctaatttttgtatgtgtagtagagacggggtttcaccatgttggccagactagtcgcaaatgcctgacctcgagtgatgtccctacctcagcctcccaaagtactgggattacagccatgagccaccatgccctgcctgaaagattagtttttattttatttattttttatttattttcttttttgagatggagtctgtctctgtcgcccaggctggagtgcagtttgcaatctcggctcactgcaacctccacctcccgggttcaagcgatcctcctgcctcagtctcctgagtagctgggattacaggcatgcatcaccacgcctggctatttctttttgtatttttagtagagacggggtttcgccatgttggccaggctggtctcgaactcctgacctcaagtgatccgcccacctcagcctcccaaagtgctaggattacaggcatgagccatcgcacctggcctgagggatgagtttttaaatgacttccatagctgtcattaggttctgtcagccactggaacacactgctttgttcttttcctcctgcttgtaaaacgccaaggctattgccaatgtagtatcttcagcaaaggaaggaggcagctgagtcaggagccggaagtacagaaagaagccacagctcatcatgcctgatgaagggaattcagagcagattcctaattttcaaaaattccatgctttggctcttcataatggaaaaatgcagaattataagtttaaactcaaatgggagaagcacctgtgaattaatattttgtgaaaaacaaaacaggaaacaatataatctacatactgcatgacgttttatgtgtgaagatgcacatagaagagaatattggccgggcgcagtggctcacacctgtaatcccagcactttgggaagtcaaggtgggaggatcacttaagctcagttcaagaccagcctgggcaacatggtgaaacatcgtctctatcctttttttagaataaaatttaatttaaaagaatattggggccaggcgtggtggctcatgcctataatcctaacactttgggaggccaaagtgggggtattgcttgagcgcagaagtttaagaccagcctgagtaacatagcaagaccctgtttctacaaaaaaaaatataaaaaattagcagggtgtagtggttcacacctatagtcccagctattcaggagactgagacgggaggatcgcttgagcttgggaggtcaaggctgcagtgagctatgatcataccattgcactctggcctgagcgacagagcaagactgtctcaaaatcaatagtggaatattggaaggaaatacatcaaaatattagctgtgggtaatgaaagtagggaatttttttcttttcttttttttttttagactgagtctcgctctgtcgcccaggcccaggctggagtgcagtggcaccaactcggctcactgcaacctccgcctcccgggttcacgccattctcctacctcagcctcctgagtagctgggactacaggtgcccgccagcacgcctggctaattttttgtatttttagtagagacgggggtttcaccgtgttagccaggatggtctcgatctcctgaccttgtgatccacctgccgcggcctcccaaagtgctgggattacaggcatgagccaccgcccctggccaggaagttttttctttgtttccaatgtttaagtttctgtcagtgaacatgcattatggctttctttttttttccactttttatttttttgagacggagtcttgctgtgtcacccaggctggagttcagtggcgcgatctcggctcactgcaacttccgcctctggggtgcaagagcgattctcctgcctcagcctcccaagtagctgggattacaggcgtgtgacaccacacccggctaattttttgtattttagtagagagggggtttcatcacgttggccaggctggtcttgaactcctggcctcaagagatccacccgcctcagcctcccaaagtgctgggattacaggagtgagccaccgtgcctggccacccactgtgttttaactcagaatagacagtgcacaggattgttgcaacgaaatcccagcgcccctgcgccgggtggaggagctgggcaggaggaggacttttccctctccctgagctcggtgatccccgtctctccgcaggaaaggccgagggggacggcaagatgcacatcaccctctgtgacttcatcgtgccctgggacaccctgagcaccacccagaagaagagcctgaaccacaggtaccagatgggctgcgagtgcaaggtaagcaggtcctgcctctgctggagcatcgcctcctcccagtgtctccagatggacggcagggattttgatccctggctttccaggacccgttaatccccggctcctgatctaagaccaggctctgggaaggtagagtcatcccaagagtaaggctgtctggctggggacagagcctttgacccctggtccctggagagccctgaggcacatctctgacaggggatgtctggaggccgggcgctgcggctcacgcctgtaatcccggcactttgggaggccgagataggtgggtcacttgaggtcgggagttggaaatcagcctcaccaacatggcgaaaccctgtctctacaaaaatacaaaaattagccaggtgaggtggtgcacgcctgtgatcccagcaacttgggaggatgaggcttaagaattgcttgaatgtgggaggtggaggttgcagtgagttgagatcacaccactgcaccccagcctgggttgacagagtgagactctgtcccaaaaaaaaaagagggagatgtctggaaggctaggagatttgagagtaagagcatgaattcagctctgttacctgtagcttccagaaaaaggagctgtatggggagagagaatatggtcccatggagaattttctacaaatgtgcaagtgcaaacgcctgtgtggcttatgagaaggcactgcaggccttacgctgtttccaacattcccgacattttcacacctgggttggtgtctatgtggggtctgtgtgttgagaatacctgaacacctgctcctcttaaaatgagcccggaggttgtgccaggcacagctggagcagtgcagcgcctagatgtggctgtggaaggtgagattaccgcctccagggctcccaggctggctcctaccctgtgggctcctagcaccctatccccaccctccctgcaggaagcatggctgagtgctgggcacctcccaccctgggtcactcccagtgagtctgggaccaggagactctggtgaggctgtggggattggccttccctggggagctgcctggggctgccctccctcctgacggcccccagccccttctccgcatgttcaaaacaggaattctgaactcatagtctccagccacacgtatgttaagcgaaactcctctgtgcccagcatgaaatcaaaagcaagtttttcctttttctttccacggtggtgaaggcggtcatcctcttgtagcctagggttccttggccaaattgctagttgccgatgacctcggggctcggcttgcgagcaacactgggctggaatctgtctccaggaaacccaggcccttttattgttgctgtgtcccccagagggcagggccaagctgaggccattctgtcatgctcaggaaggtagaagatggcccaaagggaagcacacctgcagtaggagggggggcagcggtgggcagggcacagcttccctgcaggttagaccccctcgcaggccagctgcctgcccctgcaggaaccgtgggtctcgggagaggctgccatccctgcacatgacaggtaggcacattgccgggttctggacatgcccccagagcagcctctgcccaccccttcctgggtccctgactccgtccccctccgtgtgcccctccccagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatcccatgggtccaaattaatatgattctgctccccccttctccttttagacatggttgtgggtctggagggagacgtgggtccaaggtcctcatcccatcctccctctgccaggcactatgtgtctggggcttcgatccttgggtgcaggcagggctgggacacgcggcttccctcccagtccctgccttggcaccgtcacagatgccaagcaggcagcacttagggatctcccagctgggttagggcagggcctggaaatgtgcattttgcagaaacttttgagggtcgttgcaagactgtgtagcaggcctaccaggtccctttcatcttgagagggacatggcccttgttttctgcagcttccacgcctctgcactccctgcccctggcaagtgctcccatcgccccggtgcccaccatgagctcccagcacctgactccccccacatccaagggcagcctggaaccagtggctagttcttgaaggagccccatcaatcctattaatcctcagaattccagtgggagcctccctctgagccttgtagaaatgggagcgagaaaccccagctgagctgcgttccagcctcagctgagtctttttggtctgcacccacccccccacccccccccccccgcccacatgctccccagcttgcaggaggaatcggtgaggtcctgtcctgaggctgctgtccggggccggtggctgccctcaaggtcccttccctagctgctgcggttgccattgcttcttgcctgttctggcatcaggcacctggattgagttgcacagctttgctttatccgggcttgtgtgcagggcccggctgggctccccatctgcacatcctgaggacagaaaaagctgggtcttgctgtgccctcccaggcttagtgttccctccctcaaagactgacagccatcgttctgcacggggctttctgcatgtgacgccagctaagcatagtaagaagtccagcctaggaagggaaggattttggaggtaggtggctttggtgacacactcacttctttctcagcctccaggacactatggcctgttttaagagacatcttatttttctaaaggtgaattctcagatgataggtgaacctgagttgcagatataccaacttctgcttgtatttcttaaatgacaaagattacctagctaagaaacttcctagggaactagggaacctatgtgttccctcagtgtggtttcctgaagccagtgatatgggggttaggataggaagaactttctcggtaatgataaggagaatctcttgtttcctcccacctgtgttgtaaagataaactgacgatatacaggcacattatgtaaacatacacacgcaatgaaaccgaagcttggcggcctgggcgtggtcttgcaaaatgcttccaaagccaccttagcctgttctattcagcggcaaccccaaagcacctgttaagactcctgacccccaagtggcatgcagcccccatgcccaccgggacctggtcagcacagatcttgatgacttccctttctagggcagactgggagggtatccaggaatcggcccctgccccacgggcgttttcatgctgtacagtgacctaaagttggtaagatgtcataatggaccagtccatgtgatttcagtatatacaactccaccagacccctccaacccatataacaccccacccctgttcgcttcctgtatggtgatatcatatgtaacatttactcctgtttctgctgattgtttttttaatgttttggtttgtttttgacatcagctgtaatcattcctgtgctgtgttttttattacccttggtaggtattagacttgcacttttttaaaaaaaggtttctgcatcgtggaagcatttgacccagagtggaacgcgtggcctatgcaggtggattccttcaggtctttcctttggttctttgagcatctttgctttcattcgtctcccgtctttggttctccagttcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacattgtagttattttcaaatctttgcttgataagtattaagaaatattggacttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaagag

SEQ ID NO: 36354 - DNA, 9363 bp, Homo sapiens
agcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcaggtaggccgcaggctgtgcggtgaggcgcgaggcccgaggggcggcccaggactcgaggtgggacgcgggtgtgacaggagccagctttggctgcttgtcggggagcctcagacctggcggcggcggcttggggcggacgtagccgggggccgcgacccaggttcttccttcgcagtcgttccctgccagccgcgcgccgcctccaggtgcactccaggagcagccgcgccgctgctcacccgccctgtagtccgctccccccagggccgtccccgttttaagaaatggggtgatggggcgtccctacccggcgcctgcaggggctcctggggagcgcgccggtggctcgctgctcccgggtggggcgcggggctggcgctcgagggtgccgtggcccaggcggggctgcagcgagtgtgttccccgttccgcgcgcgtgaagcgtgggagcgaagcctcgggggagggcgggagcgcggctgagctcactgtgaacacccggctgggtagtcccgcgagcaggggaggggccggaaccgatgtgtatgcggagaggtcgcagtcattgctgtgagcaggacacagtggcggctgacctgggagaagttacagagggacggggtgggagagggacgaggagtcgggaatggcccccaggctctcgtcctgagcggtcggctggacgtggggcgccactgaccaccgtggagaagcccgggggaggggaggtgctttctggctgcacactgacctatgttggggtgcccagggcaggatgtacacgctgctgtcgggcttgtacaagtacatgtttcagaaggacgagtactgcatcctgatcctgggcctggacaatgctgggaagacggtgagtgcccacgcccttgcgcgcacctttcccacggcctggcggcgcccccttcggttttgtgctgtcagctgcacgttcactacccagacggaagccaaatttcacctgagacggcaggatagtcaccaccagcctcctgaagagcagagtgttgctctgtttctgtttctgtcttttaaagaacagacctgagtaaggatatttggaagccagtatagcccctccttgatgtgtttcgcctctgcctctctcctcagaccttcctggagcagtcgaaaacccgatttaacaagaactacaaggggatgagtctatccaaaatcaccaccaccgtgggcctaaacagtaagggtctcaatagcaggctgtgggtttggggccttgaggatgccgtgatattcacagtccagctggcccgtggccacagccctgtcgggcccctctcaagtctcatttgagtggcaccagcatggtttgccccatcccctgggagagctgggactgggtgtgtcgaggaccaaggtcatgagccttgcctgtttcctcctctccccagtcggcactgtggatgtgggaaaggctcggctcatgttctgggacttaggagggcaggaagagctgcagtctttgtgggacaaggtaagactccctggccaggaccacccccaccccagccctccagtgccacttctttccagagtgccctttgggcccttcctcagcagttttccttacccactctgtccctcgggttttctctctggtcctgtcccaggttcccgagtggctccctgttttgtcccagctgaacccttagctgaagttgccccaaaagtggtggtaggggagtttcccacttgggagttccctgcgatggggccagtggagaattccagggaaagaatcactaaatgccaaggcgatcagatcagagcatgtattaggggaacctgttgacagagtgcggcatcctcaggtgaccagtgagagaagggcgtgttcactggtcatgcctgaagccgggggggatctgggttcagggctggggctagtttctttcaatgttttgaaacctgaacattatgttaacaacctaaacatcttacaagtgtctgggaatgttcaaaccctggcttgggtttgagcctaagggcaacctcgctggccaagtcagagaggtcagggcagtctgtttctttctcagtcaggacaagacaaagtgtggggacctggggaccctgcactcctccaaagtgagtgcctcctttcggctcagagaccttgctgctgaccaccacaggacacagaaatggcaaagaccagatgtggggacggcaggatggctgcctctcccctgatgaggttccttcagttctagcttaacatttgttcttccatgatcaccagaagactcctcagggtctcacagcggcagtctcctattttgacacaggttttgggcatttctgagatcccagtgtggtgccccttccccacacccccaaggctgcagtttatctccttctcagcctgggccaggcactgagtccagcactgagcagggcagagcctgtggcttcctcgggctccctgccctaggctggcacagtgggtgtggggtgtccccagtgccttggctgccctgatgccatctctagagctgagtgcccaggtcctgatctcttttttgatcctagttcccctttcctaggcgcccccaaagtgtcccctcctgctgtgacttctagccaagaagacatttctcccatggccaagtgatctctgatagatcctgtaggaccactgaagtcagacaggacaagttgagtcagggcctgtgtgtccagtgcgcagcatgcttggggagtgacacagatgatgatgatcttgtcacaggccggtgtctcaggcacagatgctgagacaggtcgaggtacaggatgcacactgggggtcggcaccaggaaggcagggaggacgggagaggagaggtcgactcaggcagcaggatccacagagctgtggttggcccagcagggagccctggaggagaactggctatgctgtgccatgtggggccaggctggccgggacttcacaccatggcctggtgggtccccagtgtgggctgccctgggcaggtgtgacctggcagtgtggctctttgcagccaaagtgggtcccacagaaaccaaaatgagaccatctgctggtgcagtgttctccaacatgaagcaagaatacagtggggccagagatgcctgcactggccacagctgcagccctatgtggacccacacttccacgttggagaggggttcctccaaggtcctgagggcctctcttaaggcgaaactggaagagggagacttaagggggccactgtagcccatccttgctgctggtcttggggctgcacagcccttccttgagtgccctcccaattcactaccacttctgctggggtgcgacttcctggcagtctgagcccttctccagacaccaccgtggtggggccagtggctccctgggtccccagctgtgggacagctgtgggatggcagccccatctcctgcccaccagggtctcctagacatgaggtgcaagtcatgcccatgaggcagctgtggctcgtcattcagcgtgtctgctgagtatgtgctgctctagtggccgggacccctgaccctgctgagctcagagctgggaggatcagctgcagggacccccctaggtcactgggagggaccggaagggaggcccctgctcccaccctggtttcctgtatcctgcatccttgtgcagagccagcaccacagaaaggggcgtcattgcgaattggcctcgtcctggggctggaccctgggttggtgtccacatgtgtggcatgtgccaggacctcagctcctgggttctttgctgtaacactagtctctcaggctggctggcactttgcagttggggagctcccattgctgctggggagaaaaactcagacccacagtccctctgactgctccactggggtcagctggccagccaggagccacgcttggacacctccctcttccccctccttgtggggcaccccacaatgaccactgctgtgacgcctccactggggcgtggggctctgggtcctgcccgcactcagccctgaggtgtcgctcccgtccactgcggccctgctgggctgtgcaccttgtgcctggtaggtgtgatgggtggctctggccacgtggtcccatggtccaggacccggttgcacatgaaccttctgccaccctgctcagaagccccaggagccacgtggagattctctcactgggcttgctgcagcctccacagagccgcccctcctgccacagaggtctccaccttagggtccgcctgctcccttgtgtcagcagcagacagccggcacactgcagggtcccttgaggggttggcggcctctgtgtgggacctgtctgtaggccagagaagttcctgggggtgggggggcctcgctacctgcagaaccctggagggcgcctggccttgggcctcctctccactgtgggaagttcctgggggtgggggggcctggccttgggcctcctcctttccactgtgggaagtgcaggtgcacaggcttctctcctctgtgggaagtgcaggtgcacaagcttgtctggcactgggatggggttgtctggtactccctgctcagacaccctaaggatttcggagagttgggctgtgcctcctggcttctcatgctctcgggtgtgtgtgtcttaacacactgaccaccagcttgtcctacctggtcagcatccagttctaggtctctgggcactcatgcctggacaggagagctggcacagcctggaggcaaagtggcaaatgtgagctgttgtctgctccacgtggacgcggagtttgctgtgtttttttctgattgagatagaggtgcactcatctggtccagggctcagcacttgtacctgaggctgcaggggctgtgccctgtcttgcccaggagtgttgccagcgagcccaggactgaccagcccaggctgcagaggtctgagctcagtgactctggccctgtcctggcagggaaggctcgcttcgtagatggcgctggtcagtcttatccgcatggccacactccctccctgtgcgaggtgctggcacagagccccacaggtgcactccctcaacgggccaggctgtggtctaggttcctccagcccccaaaccctatcttttttttgagacagggtctctcattctcacccaggctggagtgcagtggtgtgatcagagctcactacagcctcaacctcccaggctcaagccatcctcccacctcagcctcccgagtagctaggactgcaggcgcacattaccataagcttttgtacagacggagtctcactgtgttgcccaggttggccgtgaagtgggctcaggtgatcctcctgcttctgcctcccaaagtgttgggataataagtgtgagccaccacgcctggcccaatccctgtctttcacctttggccaccatcaggccaaaggttgccggcaggttctcaggagcagcgtctggggacacctccaccagatctccccgcaaccccagaatgcatcccagaagggtcttgcagttgggggctgccctcttgccccttcctcatgtgagcccctcactgtggccatgacacaggcctggctctgctggcccttggcagggtggggactgagccccaactcctggtgcttcctcccagtattatgcggagtgtcacggcgtcatctacgtcattgactccaccgacgaggagaggctggctgagtccaagcaggcgtttggtgagtgcggcctggctgctctgggagggatggatggtgagtgggggcaggtccagcttgggcagctctgtgcctggggcaggctcagtgtctggtcagaagtgctcctgcctagtgggtgacggggggggggggggcagagggagtggctgtcacagtgtccacgcctgtgggcccctgggcagtcagaggcaggatgctgggtgtgaggcgctgcctctcctgccctccccagagaaggtggtgaccagcgaggcgctgtgcggtgtccccgtcttggtgctggccaacaagcaggatgtggaggtgagccccacccctgcctcccgcagcagcttcccgagtccccagcctcccccacagcaaggggagcaggtgtgcacccagacaccccaggcccagtgactgcccagggggtacagagccattctcaaggcctgccctgcccccagcagcttcccaagcctggttcctctccagacctgctgctgccagccctggaggttctcccacctcagggcaggcgcccagaggcctcttcctgctatgcagggcacctctccccaggagggcggccgtgtctcaggagtgtgtggccaagctgtggggacacccaggtgaaactcagagctcaaagaagtgatgctggggccctggtgggagtcagctctgacccttacctgttcctgctacccttggaggtggcatctgtgccagccccacccccagggcagcccctcaagacccctctgaggtgccactgcccccgggagcactggccacgctgagttctagctgttctcttggagtggctttgcacagaagcagcccggcgtccagagggccaggtgaatcttcacttcctgccttctctggggtggctctgttgcccccagcctgtaaggctggcctcccctacaatctcagccgacaagagggacatctggtacggggcaggggtctcccctcggaggaaaaggggaggggagggctgctttttgaagactgggcaggtggttgtgagcagaagccaccatgactgcagactgcctccatcactgatgcagggctcccacctctccatcatccccggctgtgtgggcccctgggacctgcctccgccactgcccaggaggcctcagtcctcagcgccccacctcggggctcagggtgtcccccagggaggggatggggggtggactccttggagccgtgtggacgtctagtttgtctcaggcactaccagccatgttcagcctcgggctgagcacagggtcctcactgctgtggtctctgtgggagacactgggaccctggtggagctctggctgtttccctggggtgaagggcatacgcccttctgagagtcccgggcccacaggcaggacagggccagacgtgggggctgctcctcacggccttacctcccccagacgtgcctctcaatccctgacatcaagacggccttcagcgactgcaccagcaagatcggcaggcgagattgcctgacccaggcctgctcggccctcacagggtgagtgggggctgcacctgcgggggctttggggaccgagaccccccgcctcacacccgctgtcttcacagcaaaggggtgcgcgagggcatcgagtggatggtgaagtgtgtcgtgcggaatgtgcaccggccgccgcggcagagggacatcacgtaggcgcagccgcgctgccgtcgggacggctggtcccctggtgctggaggagtggcctcctgttggctcccatgctgctgatctggggggtgggtttgctttgctttggggttcttctatttactttgttttctcgaagacaaactttcctctatgtctggaaaagcgtaggcatccggaggctttggaggggagtctggcagcccggctggcccaggccctgcagcggcagcctttccacagggcgcagcggcggcctttcgaggccctttctggggggtctgagggagacctggttgggaattggggctccagtgctcaggctggcttgggctgcatgaggacagccctgtgggaccctcgggagaccccgtggctgtctccgccccatcgaggaggaggcccgtcagccatggctgccatctggcttctgccctgtgaccccgtgaccccgtgaccccgaagtggtctggggctgatcttgccttgaggaagacccaggccatgttcccaaaggccagcgggggccctggattgtgatgcagcctcgggacagggctgaggcctgcgggggaagacctataccccacgcctgggcctggcttcacctcaccctaatcccccgggagggagctgactgatgcaaaaagctgagggggcctgctgggagtggctgtttttatgccccagccccgcaagttggggagtgtttgtgggggtccagagccctcccccagccaggagagaacctcccggaggggttctctgtggggccctgtgtcccctgctcgggagtaaggctggtcctggggtcctccctgcacggaccccactgggcctgccgagtgctgtgttcttcctcagtctggctgtgggcaggagcggcctgcccagtgtcacccagggtgagtgcaaaataaagacggcgagtgtggctctgtccatcccttccctcctggagggtggaggctcctggctgttggacacggtgatggtgttactgggctgctcaggggctggtgggcaggtgaggggctccccaggtgggcctggagagtccaggcactcccttcctgcggatgtgggaaggacatggggtcctgggaggagctgctgggaaggggcatgagtcagggtgggggtggcgcagcagctgcggggctgtgactcacaggagtcgggccctggaagtccccgcgtcctctccaggggaccctgtgtgtgttctgcaggttggttcccaggacctgggggggacctccagccccgggaacctggccgtgctggggaggcgagtggctggtgcagccccccggttgctctgggtgcatcgggaggcttcagagcctgccccagagagggagaagcttcacttcccggaaagcatgggaggcctggaggaggtctttggcaggtcccctctcgggaaatcccctgtgagttgggagtgggaggaattcataagtggggggttagtgtgggccccggcgactagggctggcctgagccccatcctgttcttccagcaatgataccctcccaggccctgaccctcgctgagcttcaggggcccctgccacgtgccacagccactgggggcagaggtggcactccccactgatcctcccagggagggtctgtctgaggtaggggaagccccgggcagcagttctgatggcaggcagcctgagggatctgggcacagcgggcggctcaggtgtccccggctgccctcccagtagctgtgcaactacaaccagttttatgaaaaagctttataaaaataagctttaag

SEQ ID NO: 36355 - DNA, 36773 bp, Homo sapiens
gccgagccggtgcgccgcagactagggcgcctcgggccagggagcgcggaggagccatggccaccgctaacggggccgtggaaaacgggcagccggacaggaagccgccggccctgccgcgccccatccgcaacctggaggtcaagttcaccaaggtgaggcgggcgcccctcccacccgacggccgcgggcccctgcgctgggcagccagactcggggcggcgggggcgagggagcagcgggccgggggtccgccgggcgccgccgagacccgagcctccctgcccgggcgcggctctccagaaaccgcacctttcgcgggacgtctcgggcgggatcgcaggcggcggggctcggcgctgtgagcctcgaagccgggaaaccgaggccgtccagcgcccgcgcggggccgggccgcccgcatccctgcgaggccccgacgtgtccctgcgctgcccgctttgatcgcgagtggaggtgcgcgccgcgttgactcggagcgcgctggttttggggagctccctccccaaaaacccctgcgatgatttccagggtggacgagtctggctttgagagggtcggagggtccgagagcgccaagagagagtccgggaggcagatggcggagctgcagttggaagactggggaagcgggtcctccgagcaaagcgcagcgggcgccttccgtgcttagtttatacccggctcagcagcagaacgaggaggagtaggaaggtgctcgcttactgacgaaacctccccggagcccagaggtcccggtgtttacacacaaggcgcgcgctccggaaggtcgcagacctgggcctttgggaagcggtgggtcgcgaggccgcagaagcgcacggttctctgcctcctcgctctgtgggctgggaggctacagcgttggcagaacggcgagattacctgcccggggcagaaaggaataaaagaagatggtgaggcctccgaggcctctgagctggggctgaggagggccgagagacccgggtccgggagcgcgacccgatggaggacacccccaggctgtctggcgtgcgcgtctgtcgtgggccggtgctggggcactttagaggcacaggccaggccgagagccattgccttaactttccccacctttggcttctcttgatttttgcttttacccatagcccccaactccagctgacaccgcacttagagaatttcctcatccgttttactttaagaagtagcaattatctttctcaaagaattttaatcaagcggagaaagttgcagggcactatgtgtggccttcagatttgggtctcttggcacttaattcccaatgtcggctgagcctctgatcacaagacatttaaattaactgttttcagaaggctctgtaatcaacaaagacacgtcgctgtaaactaaacgctggaaattattcttaatgtagttttatttgtaatatcagcttcagagtgaaaattccaacacgaattctgggaagagtgaaaatggtacccgaattttgtaagaccctaaccccaggtgcttggctgctgctactgatggttaagtggggaggttgtttgttttcttttggttgtacaggatttcaaaatactgtatatagaaaccagacagtaaatgtattatggtccttttactttttatgtttttgagtcctatcagcaatctgaccacatacaaaaagtttacctctttctctatgatttttaggacacttttaaagtgtagatgtagcccttatggagaccttagacaattcacagagcaatggttgcctgttgtcttggtgggtgcgcaacctttgccagttaaagggaaccagtgcaggaatgaggctgagggaagctggtggatcggcctggagtgctgggatcttgagtggtctcccaggcgataaaggccccaactgcctgacaccggctgctggctcctcacccgttgggggactgtgctgctgcctgctctgtcctggctcctggcccatctctgcagagacctccccatagcagttgtggacccaggcagcttgtgtggctgagggtggccaaccagtgccctggcacagtcctcagggagactggactggagaggcggccgagagtgaggccaccaagagtgcctgccgagggaaggagcgggataaactgaagtgcaggactgaggcccagagtgggcgagtggcccggcaggtgggtggcctggcaggagagcagacggtggagcatgggagccagcagtggtctgctattttccaaaattgactcatggtgcttctcgataatggggcacacaccagagttggtccatctgagccctagccccggcagtgccatttcccagggtggtccaactttcaggatgactttgtcaaagccccttcatttgtcctcacatgttaacatttcattctctagggtcatgctgtgtgattctggagagctgagagcccctccagggtccccacacagatctcagaggatagaagtcccttctaatttagagggcctctttctttccttataaaatttcttccagtagcagggattctcttcaaagttttctgatttttaaaacaccggtttttattatctctcttatgaaaaataaaattcccccaaatctccttttctgaaaacatattctttttgagtttagctgagtggcctgttgtcagatggaagttacgggaaatcggcatcaataggattcacttgtatgactgtcatcttcacctctgcctgagacaccttacagctccgtcctgcttccatgtcattctgttccttttgtaaaatgtgaaccaggtctacagctcaatgtagcttaatgctatacctctataaggtttgttgtatgctaatccacaaatcaaagacaacaattccttctagaccctttaccctgatttggagttcaaaacaatacagccagcataatcagtagaccatatttatataccctttccttatatttgtgcttttgttttgttttaatggagagaaaaatcaacagtagaaaccacttacaagattacttactactgtagtgtggtataaagtaaaagattttacaaaattaaaaacatagtgatgggaaaatatggttagagtcaaacagtctgatttttttttaaggttgctggttacagatcaatgtcatgaacaaacagtaattttttttggaggagcatgcttggagatgaagtatagcagtatagcagacatccgatcattgtaatctgttttcagcccccttatttatattctcttctgccaccttctcattttccctcccccttggagttgataccaggaaggacctagaatcagcaattttcactgacagtctctattatctaacccacgaaatttcatctttctacaaatgggcccctcttcctggctgcactttcctccccgcactaacttaactcttcttcctcagttattaatttctcgctgttaccaagtgatgacttgctggatggcaaaagtgaactcttggatttagtttcagctggaagaataaacctgtaattgtagcctggccttttcctggtgcgcttccctgggggcctggcctcacattggagacgctaagcttccagaagccagacaggcaaatcccaatggtgaccgatgctctcagttctggattccaaactggggggcagctggtctctgctcacctgcccagccagagtctgcctcctgtgcttggtccccaaccgactcagaccaggcttcctcactatgagcttcagaggtttttgtgggttttttttttttttaacattctatcaacttttaagttctggggtacatgtgcaggatgtgcaggtttgttacataggtaaacatgtgccatggtggtttgctgcatggatcaacccatcacccaggtattaagccggagctgtggagtttatacaggaagcccaatacagagaatgtaaccaagactcatgcttaggagatggctgccctctctcatctgtcatcactggggagtcaaatgtttcaaatgaatcaatttcacaataattgaaattagcccttgagggacgcaattcttcctttaaacaattcaaaaagaagcaaagtaaagctatgtataccacatgcagatagatgtaaaaacggaacctgatgaactaattctgtactcagaaattactgacggcattttacttgagagacatgcgtgtcagccatttctgccacgggggttcttctgatgctgtgataggctgtgatgaggaagccattccaagttggtgtagcaggagtttgtgtgtcttctggctgggcagccggggacctccgtgctgtcggaatgtgttttgtatattgtctgtcatgtctcttcctagttttttccaaaagccctctcttttaatatgacattaataagacaattagaacttagtgtaaactaacagtaaatagtacatatgtttcagtgcatggacttcgtatgttcttcttagtctgctcatgatgtcttttgtcaaaaaaactttcattctcatctgcattctggatcattgaggttcccagaaaagtgatttctgcgggttatataaacagttatttgcgacatctcttaatgtaacctggaaagtttctaacccagacatttaactttgtacttcaacgctggtttattatcaagcttcggaggtttttctgggtttttttttttttttgacattttatcaacttttattttaagttctagggtacatgtgcaggatgtgcaggtctgtgacataggtaaacatgcgccatggtggtttgctatgaaaatacacattttaaggggaatgtgctggggagggacatgctgatgtgcattggtgaaaactgaagggcgatggtgagatcctcctcaaagtgagctccttggcaatcaatcttgctgagtgttgccactgaaaggagaaagggagtgctcggtgcgtccttacccttcaggggcaggcggactgcttgggacttttatgtatataaacctattgactcttcccccaaagtctattggggtatgagattccattcacagcctctatttaaccatttaacttagccattcctctgtgaatccatgttattgctgaagataataataataatttagaaaaaaatctctaagtgactatagttttatttgaccaaaacttgaatttcgagtctgtcctagttgatctgttggtcatgcagtcctgggactctgttcccctccgggtctcatctataagatgtcgaaggggagagggaagcagcagagaggaaggtggacaagatggataagacgtcacctaaggtccttagcatgttgaaattatatgattttgatctaaacctaattggttacacttcctttcctggttagatatttatcaacaatgaatggcacgaatccaagagtgggaaaaagtttgctacatgtaacccttcaactcgggagcaaatatgtgaagtggaagaaggagataaggtaaatacttaaaataaatttgctctaagtaattcaattatggatgaccaaaggataaggaaacggttcggcttagctataagacagaactggcctatcctgggggcagggcctgggctagctgcgtgaattggcatgtggttctcagacgtgtggcacagaatggcatcaattaccgatgatcctctgcagagaatcattctcccttgatagatgtttctcctactatgaggatgacctcagctatcctcatcatatggctaaaggaaaggttttcttttttcttttttttttttttttatcaattatttggacctggaggcattaaagaatctttccagaaagcatttcccgctggtgtgtttcacgaaatgaagctttctggcagaagacactttagaaaaaaatagacactttgaaggaaaaaaaatagttgctacccgggtgatgcggggatagttaacaatgtaaccaccagatttcttttctcctagaaatttacatgagcatggaaagcggtaacctttatcactctatttgcaagtgcaaggtctatatagtaatacagaagctaagggacttccgaatgtgtcctttatacattgcaaggccatcaaatctattctgaatgtcagtgcagaggtaaagcccttccactgagggcagggagatgtaaatgtttccttagctgctggagtgctggactgatgttcttggtcagcaaactgatgacgttggaagtggatgcagtgaagggcgtgtgcagagtaggcttggattttatcttgcccatgagtttttgtgacagacgtgcaaatgcacactggccccacctatacagacccccctctgtgtggcacctcatgacagttaggctctgctaacaaagaaagtggcacagaggagctcatagaaaaatgtgagggcattggggggaagccatgacatggaatggggtttccactaggagactcccaagtgccccgtacaggtgctaggaggagaacgagacccttgccctgggccttgatttctcccttggtctgagtgactgttctgagccagaggccaccacaccctctgcagctggaaaggtcctggcctccaccccagagcctgggagaagaaattcagtgtcccacatctcccctgccaagcttctgctcacccccaagccagctctggacacacagagactcggtagagtcactcctgactggtgtcccacatccactccctgctgtaccttcctagaaagagagaggcatggaggggccttcgagatgaatgtggcccattttcctgagaaaaagagacagtgacactactctaaatggccctcacttctttccttttagaaagaaggttccgttgtgattattctatcagtgcacaaaagatccagttctgctcccatggggtgggtgaggctgaagggagaaaaacggccttcatgctcctccctgtctgcgaactgttccacgatggtcagttctgcaatccagaaaggaaggaatttccccattctcactcttggaccacaagttcccagctgggatcaaatgccaggcagacacttcccacctgatctgtgaacagcaggctcgtgtgcgttcacactgaggcagccagtggaaagtccttccgtacttgggtccctgagaaaaatactctttaggaaatatttttaaatgctttttataatcagaaacaaacattggtatttggccactgtagaaatattaagatgtaaagaagaaaaaaaatcacttgaacgctcccagccattcaagtgattgaaaaacatgctgctgcttgcagcctgtctgccagcgggacaatctgctgttctctataactgatggccgtggtcccaaactgcagtcacgtcaaaagatgacacccaaactgcagtcacctcaaaagatgacacccaaactgcagtcacgtcaaaagatgacacccaaactgcagtcacctcaaaagatgacacccaaactgcagtcacctcaaaagatgacaccgaaactgcagtcacttcaaaagatgacacccaaactgcagtcacgtcaaaagatgacacccaaactgcagtcacctcaaaagatgacacccaaacttcagtcacgtcaaaagatgacacccaaactgcagtcacgtcaaaagatgacagtctctctctgttgttctggtcgctcagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgtgagtacatgcacttgggggccggtgggggatgagccagcctcactgagggtcctgtccaccatggggtatgggaaaaaagatcacggtcctggttttgtgtggtcgtgggtctgttccatcctctgagacacggctctctggcaatacttgcaggtgttaatgcctctagactgaatccctttcattttgaagtcagacttttgtcctctgcagctcagcttcttgaccaagttgttgtctataggcagttgagctacatcagtggtctcagacttggggcactcacagattggtgaccatgagctgggccatatcctggtaccacctgtgtgtttatgtacttaacttttttcttttttgtataaacttccttttatttattttattttatttatttttttgagacagagtctccctctgtcacccaggctggagtgcagtggcgcgatctcggctcactgcagcctctgcctcccaggttaaaatgattctcttgcctcagcctcctgagtagctgggactacaggtgcctgccaccatgcccggctaatttttatatttgtaacagagacagggtttcatcatgttggccaggtcttgaactcctggtctcgaactcctggcctcaggtgatctaccggccttggcctcccaaagtgctgggattacagatgtgagccactgcacccagccttaactcccttttaaacttaagtttaatctcatcctaagaaacaatattcatgaaatcacaggtttgatgtgctaattttatttttctaatacttaccaaaataaatgccaccacttaacatagaaaaaattgttcccatgtgacctaaaatcattcctcagtcacccctgaactggctagtagcgagcatatgtggagcggtggtgagggcaggatagcctggttataggaaacctcagaataggaaagacctgggttcaaatccccactctgccacttactagctgtgtgactttggacaagttgtgaaacctctctgagatttatttcttcatgtaaaatgtcaccgataatgataactcagtggtgtaagaatgatctatttaagattctaggcagagtccctggcaggcagtaagcactaaatagatgacagctatcattaataatagcagttatcataatgaggtcatgtgaagacccattttctaacctcacctacatgcactgctggccagtaatttctagataccctaggtggggatattgatggagcataccccatgaggctgagctgccaaggcattcatcagttgtaagtccattttttagcaggatcctcagaccctcctctggtcatgagggagtgatcagaggacatctcagggccacgttgggccatgaggtcctttgcatcctgtccttgcccatctcagcctcttgtttttaaaagttgttccaaaccttgaggcccggttgtaggggaggagatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagagtagctccctcccagggtaagcgcttctctctgaggagcctctggtttcttcctgcaacgtaagccagcgtcaaccctcaagctgccaaactggctttttcaaaaacatttctgttttcacccggcatgagctcatcggtcggcaatgtccgtgtggactaatagcaggctagagaggatgtgccctgggcaccccccgccctgaaccctgtccttaagtgtcagtatcatcttaggagcagaggctacaaagccaccttcatcttcaggctgccccattgtcctggcacgactgtgttttgatagcagacagctttggaggatctcagaatgcaaacccagcaaatcacttctgccactggcacctcgcagcccacgagaaataagatccagctctttgccacaacatgaaagggacaagagaattactggcaaacacggtttttaaaactccaaccacatcacaggagagcgccccttgctctccacctcgatatggtttccgtgcatgttcatggagcgtgttctcttgccggctcagtggtttgacagagctgggtgtttatttctgtgctcagtgtctggaaacagatgtgggggatccagcggcccctggatggctttcctttgctggggcacccaggccccaactctgctctttgggcgctcattttgggagctcccaaacggaagccctccctatccactctccttttcaccccaagtgccatttctgggtcctctcgttgtaagccctgccgtgctgttttcctggcacttcccgtcattctttagtatctgagggttctgatgtgttaatttctcaggaggcacattttcctcttaaaatgttaaaggaaataaacttaggagtggctatggtttactcatgattgagccacagtaacaagttgtttaaaggatgactgtttcaatctgtagcgagcacttggactcactcacctgcataattttttttaataatttcccgtctaaacctatcatgacctgggttttgctcagagaaattccataaaactaacctggtaaattcatgttgtcactccagtaagcaaacttgctgaagttgacaataaaaacaaatagcaatgctggctgaatgttcgccatgtacctggcttgttgacctgtaggatttattatctcatttcagagatgagaaactgaggcccagagaggttaagtaacctgtcctaggtcacccagccagaggtggtaatccaggactggaggcagaatcttggctccatgtctcgcgcttaccctcagtgctggatgttgaagtcctctctcttgttccatcccagaaaagagcaaagaataaacttgcaattccactgacagatatgcagatactgtctggaataggtcagtcttagaggcctttttgcactatttgcaattgctaggcttcccctggaaaaatgaaagttcacgcttgagtgaaaatctataggaaccaacactagagtatacttgatgtcacactggcctgactcagtccctgagtggcagctgctgggggcagaacacacaccccaagctagaccagtcctgtggtctttagcaacccagtgcgctgtctgggtccccaggtgaggatcgccaagcccttctctggtgcctaaagggaagttgatgatagtcagtgtaatcatcagtgttctcatgtgaacaccaatccagcactcaccatgggcgggcactgtggttgctgctctgtggacactgactcctttcactctaacgctggccctgtgaggtaggaaccgttattattcttattttacagatgaggaaactgaggcaaggagtgattcagggacttacccaaggcccacttacttaactagggttcagcagatgtagttgcctcctatttaaagggggcttggctcattcctgaagcaaaggggagctggggtagcccgagcatccggagtggctgccctgcagtctttccagacacacctgtccaggagcagcctgtaaaggccagtcgctgtgctggccagaagtagatgcccccaattcagctgctgcattactgggtggccttggccaagtcactgggccgttagcgtccgtgcctgcaccttgaagtgggaatgcagtcatggagctcaaagggtgagacatcggggagtgcgctggggttaaagccctggatctgaggaggggccttcttcctttttcaatcaccatctcactccactgactcttccacaagaatccagccctgggctatgtgtcagggcggccacttcctgcagaggcggatgactggcggtttcagcgctgggctcaactggggccacttgtctgagggacaaaggggttctcttccaccccggctggaaatagaaaagaatccctgccattgagtggctgcacactcgccctgggtaatcacctccctcaccagcagggcagtctgctcccttccgactctgcatccggccggccgggctctgcagtgcaggagggaaggattgcatctttgtgctgggggcgcgacccttctcggctcagtcactttccacagccacactggccagcctggccgagaaggaagagcctacatcttctctttctcttttgttcgaggagggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaaggggcccttcaaagagggtgcatgtctatgttttagcccaccaccctgcagcccactttaggtgttttgaaataaaagcaatcctcacactcagagacaggcctcgctttacatttggtgtcatgctttctgaagaggtgcatctgactgtgaggtctacagagcaatgtcctaggactgtgttctctccccaacttccatctttaacaacctgacagtgcaaaagaaaagcaagctatgtccgaaacagacatcatcttgttattgcaggccctggagacgatggatacagggaagccatttcttcatgcttttttcatcgacctggagggctgtattagaaccctcagatactttgcagggtgggcagacaaaatccagggcaagaccatccccacaggtgagcaaggtggattatagcttcatttgggatccctttggggctatatcttttcattaatccagagccccccctgactgtttccctaaggcaccattcccaaccccactccctctccaaatggtactgccaattcttcttctaagaacttcacttttaaagttgaggtcaaatcacttctctgtataatagacaagacttgaatctggcacccttgttggtttctttcttgtctttttactacttgaagttcctaacctggactaagtgagtgtgtccttccccaccatgtaaccctcttccagatgacaacgtcgtgtgcttcaccaggcatgagcccattggtgtctgtggggccatcactccagtaagtatggcagcctttctcagtagattctatgtagatcctgccccactgccctgtgtcctttggaatcaatttctggtgtgtttttatctgattgcaccagcgttgaacaagcattttcttcgtggcatggaactccatgcttgggggctcttgagatggattagaccccatttctgctctcctaagaccggctttaggcatgccacagaaagcactgtggttcccagccagagtggtcaggaatggccagcattcccaggaaggtggtctcttagctgggccttaaagataagaaagacttgttcaacaaggaaaaggattttccaaggagtgggaatggcctaggcaaaagtgcagaggtggctgggctacttggaagggaacagcaggaaagctggtggggctagagctcaggcaggagcaaaagtgaggaaaagggtgagcacacgtggcaggtggtgtgggccagcttccagcagctttggctgctaaggggccgggactttattcattgggcggtggggatgcttataggtgcccaagaagtgcaacaatgctgcctgtctgtttgggaagcctctggccattgcaacaacagccaggcaggaagctgaagagccaggtggcaacatgaagtgagggttcaaaaagtgcccatggaggcagggaggaggacacgtcttcagcagatgttttagagggagaggtagaacacatgcaacagcatcctctttgcaaaggctgcctattagtaccacccagaatgcagtttaggaagtgctgtgcaggattgcagttctgatcattgcacactcctatgttaccccacataccccaaatccagaccatgaaaagcaagtgtcctccacaaaggcatcgttgagcacatgggacagggtaagagggtggatctgggcctccaaagcccctgtgctctgtcgcagtggaacttccccctgctgatgctggtgtggaagctggcacccgccctctgctgtgggaacaccatggtcctgaagcctgcggagcagacacctctcaccgccctttatctcggctctctgatcaaagaggtgagacatccaaaaagaaaatatcacatgttcttggtaacattcccactcctaggaaccaggccaccgtcacgagatgggacagtggcagactgctggcaatcgagtgggaagggaatgacttccagtgttttgtttggcgactgcacgttctttctcctgcttgtggccactgagctggagaaactccattcctcccagtggtcctaatgagaatgcttaactcttattatgggctcaaacctatggttgaggacccagtggtttgtctagagaattttcagggggggtcaaccaagagggagccaaatatttgggaggttctctgggatttgcattctcagtttatgaaatggtccatttttctctggagaggtggcctcgtcagctctagctgggcggctgcagcagtccgtgtgccgggtccctgctaatcagtgccctctgctctgaatgcaatctcttctccctcaggcagccagaacttagggaaacagaggctcaatgggacacctccttccagacatacctttagtcattccatccccaggttgtatggagcaaagatttagagaaagcaacaggaagcaaagagggacagaagaaaagatccattcctttctcttcttagtcgggctgatatgaccggcaggcaggtccacagttgcttagaagcaaggtgggaacagctggtgatgagccaattttccactttcctttggtgatgtggggcataattaagtcacactggtgagacttaggaatgtgaaaatcccaactgttaagaaacagtgcctaaaaatctaaagactcaagcagcgtgcctaaaatcttgattttctgaaataatgtgttctaagtaagactcagcacaggtggggaagagcatcctccacctcgtttgttttgtgttctcgcctgataaagaggcttagtatatgaaaaacacgaggcatgaacgtgaacgaggtggcagtccctgccttccagaagggcttgctccaggtgagacccaggttgaacaagcaaagaactttaagggagtgataccctgtcaccatttggaataataacgggtctgattaaaaaatgaaaactgggctcacgcctgtaatcccaggactttgggaagccgaggtgggtggatcacgaggtcaggagatcgagaccatcctggctaacacagtgaaaccccatctctacttaaaaaaaaaaaaattagccaggcgtggtggcgggcacctgtagtcccagctactcaggaggctgagacaggagaatggcgtgaacctgggaggcggagcttacagtgagccaagatcgcgccactacactctagccagggcgacagagcaagactccatctcaaaaaaaaaaaaaagaagaaaaaacaaaactgaagctcttggcagatattttgcaggtgcctctgatcctgggcagggcattctgatcaaggtacccctctccccttaacgcatacacacactctccctcacacacacacacaccccacatggaaaggtgctgtgctacaggcgggccatggccaccttgaagcataaccacacatttgcactgcatatcactttgggatggggtccccccccagaaggagaagtgggcatctccccttgcccagcctgcacactgggctggcagcaggggatgagaagcccaggtcagctcccagggtgcccacggtcaactgcttctgggtcctgggtaaatccagcccggcccgggttccctgtggggatgtgaggcagccacggctctctcggcccaaatgtggatccgtggtggatgaagtccgttcttcttcaagtgctatcttgatttcttcccaggccgggttccctccaggagtggtgaacattgtgccaggattcgggcccacagtgggagcagcaatttcttctcaccctcagatcaacaagatcgccttcaccggctccacagaggtaaccctcctcacagggtgctggggaaagtgaaaggggcgtgttatttgacacccgtgagcttttcctttgacaggctttaatatgatttgtttttcttctaaatttgaccatgttttagtacataacaaccagttaaaaaaagtcactggtctagtttccaaactaaataaatatctaatagaactcagaagccttagaagaaaagattgagagataagataaagtagaaatgtaaaatattcatctgtcaaacaccataattaagattaagagataaataacaagctcagagaaaaatagtcgtgatgcatgcagtgctccaagaatttatatccgtcatatgcaaagtgctcctacaagtcaatgaaaaaaaaaaaccaaactgaatggtagaaaaatgggcagttcagagaatagaaatacgacgtgcccattaagcttaaactagtttgctggtaatcaggaaaatgcaaattcaaacaaaatcagactttccttttgcctgccagattgctaagaactgaaatgatactgctgagaatatggggaagcaggtgctcagcgacacttgccctaagatgcacagtgttttggtagcactcatccaacatttaaagtgaaaaacttttcgattcagaagctccatttcaaaaaaagaaaaaactacttagagaaattttctcatgaggcttcagggacatattttcaaggatattatattcattctctggaatgttttacagccgttacaacaaggaaagctgtccatgatctattgttgaagcacaaaacagcaaacggtagaaaattacccacaatattttcccattcgtagaggtgtgtgcttgtagaagtagaaattatctggaaggattcccaagaaatccttactgatggccacctatggggtgggctcggggcagagccggagggaagctgaaggctttctccctgtaattcacatacatctctatgtggaattacttttaatgagaaagtatttcttctgtacttaaaaaagaaaaaaacacccgctgcaatcagtgtccccatccccctccttagttagtccaagccctggtggatgctgttactctccttggagacagacactgccctgtggatggattccagacctcattcagccatcacccatgagcttgctgatgtttaaaatgcgctcacaccttagcattggagaaaacagtctcagacccggaagagcctgggccgcgccttgctagcttctggctctaggcctccgtgtctgcactggtctctgaggatcttcccagctctgaagttcgtggtgctgggctttacttgttgccctagataagtcaccgagtcatgctgggccagccctcccctccaggggtacagtgggcaatgggagagaccccgtgggggccttgagcatgactggtgagtggcttttctgctcatagcgcaccccttcactccctgcctgtctgcggcagcctcagtcttagagtgtgtttccagagaatcggctccttctcatccggaaggctggctgccctcgctacttctctaacacttggaggttccctcagatcacaccaaagagccacacagaaccacccccctactgggctgttggaatttcagctgtttctagtgagaggtagaagagtcaccctgcggtccctgaagccctttaccagactggctggaccagcctgctgggctcagaaggacaggcaccaggacaggttagcgggtggcagccctgttcccagccagctgtgtgggcttccagaggctctaactcacacctgtaagtggagcggcttagaccaaggatcccaggatgtcatggtctggcatgggaggagatgctggcagaggccaggacagtgaagggacggcatcggggcctggagcgcctgggccgagagccaggtggtggcactgccacccgggcttgatcagaatgttcactgatgtttacgcctgggccaagttcagcaacatccaaggtaaattgtgatctgtgttctgtcctggaggttggaaaactggttaaagaagctgcgtcccggagcaatctgaagcgggtgacgctggagctgggggggaagaacccctgcatcgtgtgtgcggacgctgactgtgagtctctgccctcctgggctttgctggggcttcagggcatccatctgtctccccctacttcctggcctgaattcaaaaccaactgagagtaagatgtgtgcacacacagtggggacgcttccaccgtgggcatcctgcccacagtcagccagccgcagacaggcaggtggacatcaaaatgccagctttacttctagcagaaagctgccttctactgccaaaacgatatggcttgagtggcacctgagaggctgcctgtttctgcgccttagcgttaagtttacctgcctgttcctgcagagctggggtcacgaggagcaggtctggcttctcctccagagccccctgggaggagtggggagggcaggtgctgcccactcccagtcattcattctcccctccaagtcacatttcctatcatatgttttaagatccctgaagagtggaggtgctctttccttgtgtctcagacctgataaatcagaggagggcagtagcaactgatccttcaaattacccgctttgcctggttctaggcctgcacccctgccctgggaaagcaacctgcccagcagtttggggatagcttgcgtcttgacagccaaacgacacagcgttaaaatatatgctattgttggctgccatgtccacaagagggaaggaagggctggccgggcattcattcacctgctgacagggtcagctatcaaaaggtgtgacttcccaagtgccttgaaacacctttgccttaaagaatagcctcccagacctgtccacgggtgccagaaattcctgtcgtggagaacaaagcctttcacttcacactcagataaggttggaattgcaaatatccccaagaaaaatgaccctggcacaatttcttactaaggtgtaaatgactgatatcagttcctttctggcagctggctttcacaatgggagaaaggacaggaggaggatacaggctctcaggaaggaaaggggagctgggtgtgaagatggactttccatttcttgcctgggtcagtgttcccttgtggaagcaccattagtgctatgaatagcaagtggtttttggagccacacggagcatttctggcactgtgactcacatttggagtcccaaacagccaggactcctgttttgctttcctgtgccaccgtatctggatacgccacctgcactgaagttcatcttcctcctcttggggaggaaaactgcagctaaagcacaggactaattgtgtttggggcttggttttacttacgagggtcataaaaacatgctgtgtagccacctccttctcctcatcagggcggtgccagtccacaaattacatcctgacataaccagcatcccaggcaagacatcaagggtaacaagccaccattcccctgccccttcgcctcacccctagctccgtcaggagcaggaaatgagtctgttatctcggaggaggggcagttccaagttgggacctggcccagccagctgcaggggtcaagggtgcagagaggtacccccaaaccttatggtgctgtcctgctgccactgaaacttccacaaatgactcagctagataggagcagcctccttctcaaagccaagggcacagtcccttggagcagcccctgtggaattggaacggatcaccttccaatgcccagagccactgccagcctctatgcaaaggaaagctgcatttcttaagaaagcaatagtgcgggggttggtggtgatgaaaccagccaacggttgaacactagaaacccctctgtagatgtaaatgacatcccaataccattcttatccactaagcgtgtcccccaagatcttattctctaaataccctctggcttggtttgaataactggttttagttcaatgtcagctctgcaacttagtcagcccttctaagtcacacacatgatattatcttacttaataagacccttcttttactcaaggtggaacattttggcttctttagaagttctcgccagggggcctacatcaataattaccgaagtttattctataaaacattagtcctctagaaaaaggggaggggaggggagtcctctagaaaaaggcaagtgaaatggagggtgctatgactctctggacttattagcatattaaaggtactgagaagtcctgcagtcagggaattgatttaaccccaaacttggtggaccccaaaatcctttctcccttcctctctatttgggaaagtctgcaaacaaaattaatttctgaaatgcagccatcctggggcctgttttcttgtgtgggcaattagaattgcagctgtcaccagtcctgctttaacaacttaatcgcttcctctcgctctgcccgcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaaaccatggtgcttgtctaggggctgaagcaggcagtcccatggcaaccgcctacagggtccctctccgtgaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggcagcgtgtggcctggagtctcagtcgcagcccgaggccctcaagcccacgtgggttacaggacaaggtgaaccatcagaaatcaaacaatcccagacggagagagcctggggcaggagaatgtatctccaggcagtaggaacatgtctctggaggatgagtttgggaagccaaggacaggatgaaaatgatcataaccacgagatttaatatcctctttaaaacggcacatcctgtatcactttcttactaattatgaagtgaagcagatggataaatatttaaaagagggcagcctgaccatcccatgcattattgaaatggagctcagcagtcactcactttgcttttagccaaagtcctgccccagccatgaaatttcaagtcacatgtccgtgacttacccacttgtgtctatcccgggaggctgccacttcccctactgtgacagcactgcatgtttacaggggaggctgctgtggatctgagctcagatttggccctgggttttatgaaagtcacaaaaacccttccatgcctcagtttcctcatctggagagtgggagtaatcaatgaatattatgagaatttcatggcacctaggaagtattcaattatgggcaggttttatttttaaacaggaggaagctttaaatgacaggttctccagtctaggtggcagtgagtgtctgtgcatgacatcaggctgtcctgtggggatgccctggctggggaagaagggagggcctcatggaggaaggatgcatttctggccatcagtgcccaccctccactggccccagtccacacactccgacgccacgtgaccctggcagaaagcacttcttgtggctaacattccttctcctcagtcattgcctgcccagcctgtgccccaaacccagcggtcagtgacacaaggttgtctaatggcctcggctggatttcagatctgaacgcaaacatgaccacaagtcattattgaatccgccgtgagttttaaagctaatccacaatcagtgggaaatatgtgaactgatccccatacagaagaaacttttttaccccgtcgttatttgtaagtctctttctgtggctcttttcttggcttatgcctgatgtctgagtcttgacttttgaggccagatacaccgatttcttccaagagaacagatagaggcagaatgggtgctgatttcatcagtgcatttatgccaccgctcaaagtccttctgaaagctcactaaagccgtctaacctcagcatattattttagaatgctgttggggtttctttttcttccaaagtgctttttcatctacggtaataagattttactctgagaggacttacagctgtctaaatagtcctgtctgtctcatgcctgtaaaacagctagctgacctagatccgggtccacggccgggctagcgctcacaggaatgctccaaaatcattcaggtttatttggcaactgagcaacgaggcacataaacattatgcaggccacctggccgggcaggatccggcagcgtcctccgggcagagagccgagcacagccttgagccagtcctgtgggggccgtatttccctgtttctggtgttgtgccctgctgcgtcatctcacttcctggcaggtctctcttcctgtactgtaaggcaccagctgacatttcatggaggattattagatttaaacaatgtgttcctacgggctctccagggagtgtggagtttggatgtgtaggttttccacggggacccagcactgcctgcaggacaaacagggtctgccagatggcatatgcccagcagccagggaggacctgcggttgggcgaagcccctgtgtcccttttggcccctcagggaggggaagagcagctcagcagcatctggaactgttaacctgagacttggttcacccagagagaagttgagagaaccttgagctcttccgggatctgttgcaaagctgtttttgttactttttttgagtggagtacacatacacgggtcaaaccccaaaacgcctaaaaacgtctatagtgaaaggattcccgcccctcccgcccccacctttgtacacctggttcttacccttctccccacggtatccccagttcttagttcctcatgtttccctctagaatgttttcgtgtgcatgcaagcagatgaatgcaagtcctgattgcctttgttatttttacacggaagtttccatgatagtatatcatcttgcactttgtttattgttccctaaaaaaactggaagagctctttataccagtccatgggaacctgcctgattctttttcacatgtgtatggaattctgctggatgaagccaccagaatttcagtaacatcttctgattagcatgcaggtatgtgcagtcacacacaaggcctcagagtatgtgatttcacacacacacaaggaaatccctgggacagctttcccaaagtgggttgctaagtgggaacacatttctaatttccttaagtgttgctgaattaccttccatagaggctgaaccaacgtgtattcctactaacattctagaagtttgtctgtttctttaccctttccaacagaatatggatttttgcccataggagagttaaaaatgctatcttgtttcattttaatatgcatctaccgcttataataagcaaggtagaacatcttattatatatttaaaaaccgtttgtatttcctttattatcaaatgtgctttgcgtatttttcttgcaagctgttaggcatttttcttatcacttctaagacctctttacatacatagtagagagattagctttctatgaatatgacttgttaatattttttccaagtttgttgttttgctctttgttatgataattttgcccccaccccattttttttacatactcaaaattatacatcttttcttttttggcttctgcattttgagtcattagaaggcactccaagtttgcaggataagtctcccacatataaaacttttatggttttgtttttcctggttatatctttgatctatttggagtttggcctggtataaagtgtgaggtatggatctgagttagtatttttaaactgggtttggagtttggcctggtataaggtgtgaggtatggatctgagttagtatttttaaactgggtttggagtttggcctggtataaggtgtgaggtatggatctgagtcagtatttttaaactgggtttggagtttggcctggtataaagtgtgaggtatggatctgagttagtatttttaaactgggtccatatttcatgagatgattggtcaagtggcatgcacggtttatgccctctctcctgctcctccaggacagaccgtcatccaattgcaccactgggtttgcttctttttctgtttatgatcattggaatgaaaccagttttcccatctaaaaatcccagctaaagtaaacctagtaaagctttgtctctcccagccaaagaggagggagaccagccacagatcatgataaaggacaagattcccatagatttcaggaagaaggaccagtggagggggcagaaagagcattttccctcttgagcagtctcccaaaagggtgcgcttttgacaactgctcagtagcgtgttcacaagctgtgggtcaggctggtggcacagggcaaactccagccaaggagacgtctagacaagatagcaaaagggagagtctttctcatgagctgttcccaccaccaaccaaggagcagccctgccaccccacctggaggctcattctgctttgtccccaggggtgttgagtaaggtggttagcttttcttctcgcttctctgcaccatgacaggagaattccagtaactattaccctgattcacggtgccaactgagcagggcacagggttgccaggtgatacatggcacccaggtaaacatgaatttcagataaacagtaaatgcacttttagcttaagtatatcccaaatattgttttgggacatactaaaaaaaattatgtgtcatttttctgaaattcagattcactgggcatcccgtatttttatttgctaaatttggcaacctgagtagaatgtaaagagttgggagaagaaagactgtgaccacttcagacctgtgtcactcatggactaactttgctgcatggaaaagggagatagaagtgtaaatatgtcccaaacctccagaggatgagactagtctatctccccatctctcccctgctccaaagagcccagctctgtgcatcagaggaatatttgcctgcaaggctcattagttacatggatcatggcttgacaagaacatgcagagggaggatggctgatcatgttgaaggccactgaaaacatgagatggcagccactgcccagaaggaagccaggctgtacttcttgtttgtgtcttgcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggaggtacaagggggctgtggcaaggctacgacttgcggggcctttcaaacacgagtccttccctagggcccagggatcccagaaatccttgtgatctgagtgtttttttgtttttgttgctgttgttgtcgttgttgttttttctgtgtggtctttcccctctcctttggggtccctagggaagccgttttgtcctgcctctggcgaactccaagcatgatacagcaggtaccttgtttgttctagctagttttcactcatggctcaccctctctgggagcagcaagccctctctgattttctaacacaaccggtccccgagtcagtcatgcagccgcaggtggagaactgttgccacctgtgggttttgccaggaatcagttcaagaacctgtggattcagggcccaaagccgccttcagtgcccctagactgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggagagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttccatttccttttctttgctgtgtcacaaactgtggtgaatattgtgtcattccttcccctggtagttattatggaaacgttctagggtgtcttccttggtagaaaacacagctccaagaggtaggagcacagtcttacaaagtgcctgcagatatccttcaggacaactccgaaaaaagttacctaaaggttttgtgttctgtgcatctatgggttactccaaggctctctggctgggtttctcggaaaccctgatgacaacaagacatcttaaacacaacatatattttttgttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggtgagttgactgtgtgtgtatttcagctctcctgagttgcttcttgctaagttcattattcttctattaactgagagtttctcattgtttacattgtatattatataccaagccctgtctcagtgcttccttccatcctcatgaccatcttctgaggtagctgccattatgtctccatttcagagatgagaaaattgaggcacagagagatgaagtgacttgcccagggtcacacagctagcagatggccgagagggctccagtacctgtgcctgtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaactttggggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttgaactcctgacctcaggtgatccatccatctcagcctcccgaagtgctgggattacaggcataagtcatcatgcctggccctctcttcttttttctccccttatcatttcattcctatcccaatgaaacacactctgtacttgaggatttccaaattttagttgctgatgagaagaatgagaagacaaaagttgagagcaccctgtgttttcatcaaggaagctttggcaaaagactgtttattagacaatgccctgcactgggggctaagtggctgcagtgccaggagccagggggtcttctccagatgactctgagctttcttccattcttttctaggatcaactgctacaacgccctctatgcacaggctccatttggtggctttaaaatgtcaggaaatggcagagaactgtaagtgtttccatcattctgagcctgccgtgggctgaacactagatccactagatttgcaggcagtgacacaggctccaatctgctgacaccccgtcccccccacaccgccgctctgtctgggccagctgtgtccctctagggttggtggggacccatcccttcctctctccagcccacccttcccacttacatcctcagcctgcccccctccaggcctcggcttttgtgtctgcccagcagccatcatgctggggacattcagtggatatttgacaaaagctccctggacggggacacaggcagaactgaaaaagtgtacttttgccagatgtggggtgtcattattcacacaactccccactcacagcagtgaagacaggtaaggctgacccaggtaaggctcctacctgctgggtccttttttctgagcctagtaggggacctcctcccaggaggcatatgacaacacctcctgctgggcctctgcggccctctcagtatatgcaagcctactgcaaatccctccacatgcgtgtgcaaacccactgcaaacccctccatgcgcgtgcaaacccactgcaaaccctccacgcgtgcatgtaaacccactgcaaacccctccgtgcgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctccgtgtgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctcagtgtgtgaacccactgcaaaccccagtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttgtgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttggccatgaaacccctttgcagaaattgcatttcctccctctagtggcctgtttgcatttgagttctgtgagcccctgcttcatcacttcttacacctgcccctccagggacaggcagccagggctggggtcaccagggtcccctcttgggccctccaacagcaacagtactggcaacagctgggatttgctgagcacagactctgcagcaggctcggttgagctctctatgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgcgtggtcatttgtctcctttcatctgctgccttcaaccagctgggtcattagggctggggaacccagaccccacacagtcctcctcccagacgccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcccatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttatggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtcggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggcagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaatacagatgtctgggccccaccatagagtttctgattcagtaagtttattagtcttttattgctcctgcaagaagttaccataacatcagtggcttaaataacataaatctattatcttatagttctgtaggataaaaatctgacacaggtctccctgagctaaaatcaagggcttcattcctttttggaggttctcaggagagaatctacttccttgccttttccatcctctagaggctgctcgcattcctaggctggtggccccatcctccatcttcaaagccagcactgctgctctctgaacctgtttctataatctcattttgctctgcctctcttcttctgccagttttggggacccttgtgattacactgggtctgcctggatgatccaggagagtctccctcttttaaagtcaattgattagtaacttgaattccatctgcaacattaattcttcactctgtagcccaacatattcacaggtttgggggatccaattttggatacctggggagatccttattctgcctacgatagtagggctgggggaggcctgagaatctacatttctagcaagttcagaggtgaggctgatgctgctggtctggggaccacactttgagaaccattgatctaagggaggagatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttctctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgaga

SEQ ID NO: 36356 - DNA, 43622 bp, Homo sapiens
ggggaggaagaaaggcgaaggcaaggcgaaggggtggagagtgatatgaagagcgagagaaaagagaggacagcggacgagcagatccggtaggggctgaaaaaggccaaggggctggagggagggagaggaaggaggaggggagcgaggagggcggggcgcccggtccccagtcgcgcggccaccgcctgcccagcctggctggatttgagcccggcccgccgatcgctggccgaggcgcagctgaagcagccccccagccgcggcgcccccactttccaactccacggttcctgcggcgcgggcgcgatgcagctggcccggggtgaaggcaaggcgcggggcgcggggcgcggggcactgggagcgaggcactggcgcgggatgcccggcgcaaggtgcagggcgcgggccgctctctttccgcgtccccccacctcgccaaagtttttccacgatggtccctaccccggctgggtcagccccgtaatcctcgcctgtctcttgtctcctctttcctccccgagccgcggggctcccggggcgcgcggacccccgccaggggccgtgtaggcgcggagccccagccggcctgccttgggtccgaagaaagttgtggcttggagctagtcctccttctacgacccctgggggcgtccttccttctttttgagcccgcgatgggaaggcgctcccaccccatccccggggtctctgagacttcctggcgaggtggggcggcgcggcaggtgcagggctggggagggcctgacagccctggagagtgcccgaccccagtccgccgccgtcttctaggcggattccccagaggcaggtcccagtccccggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctctcgccccgagcgaggcaggtgccgtgggcggccccggctacttctgcatttcgagcgcttactttgcattcagctctaagtcggagagctctggggacagccgagagtgccagtggcctcatagggagactgagggttctgtttcacctcgggcgccgtgtgggtctgggctgtccacagcacctctgcgcctcagtgataggagaagccaagcgcgaggcctctcaacagctgcgtgcactctatttcccaggtatctggaatcccggcgcctagaacgtgtttttcgggagagcaaaggctgtgtctacggcagcctggggatatagtaagtaccttgtaaatgatgaatgaatgtatgaaccaatcagctgacaaacaacaatttgtcctggagggggacccagttcctgccacagttgatcttagtacaatgggaggaaagaattagaaacaatgattcttttaaacagccgggaagacagagccaggggccttctttcaggaacatctggatgaggaatctgcagctaggcttattttactaataaatccacatttacttaccaggcactttttctgcaggtggtctgaaggattaaagaagcctcgcatggcgaagatatatcgggttgtttgaggagagttaattttcaaaaaaaccaaaacacttgtgttcaaatatagtgtcccagggacacagtgtgacatctacctgggtggtggccatttgggatcagagacccttgcgtgggggctttgagggtgggcagtagctgtgttttctcctctggacaggtcagcctgatgcctaggctgtggcagtccagcaggcctcacaggggtggaagagggcctcaaatgatggctgagcttggagagggcagtagttttggaaagagcgggtgttcttgccctgggagaagatggaggcatagcgtgcagcctgcctgggcacgtggagtgtggactggtacagcttgggttccctgtgctggggaggctggaaggtgagttccgctcctccttcagcagatggaggagcagaggtggaatatcagggagacatatggtaagtgttggggtgcagcctagacatatcccaagtgctccactcccctcatttttattctgttgaaattgggttggaatggtgatggcccctttgaggagcctggctgagaggagaccagggatctgaggtcccttttcgtgccttcctccaggggaaggggactgtgtgccctccatatctggccaactggggctgcgcccacatctgctgtatctgcagccacatcatccccacttccctgagcgtggcctcactctgtccctagtgctctgcggcccacctctctccatctccacatggcttctgtttggaggttcaggtcttctcgccagtttgtgccatcttaggagcccagttggtgtggcggacaaccctacaccttgttttcaatcctttggatgctctgacccacctgagacatcccagttgctattggttttgctttgacttcttggtctatttcctggtgccccggagccaggcttcgtgtctgcgttccatacgtgagctgcttaggaatggctgagcgagtcagctggagaagtgcccagggtgtgcatctgctgcctcagagggctggacgacgctgcttgccagagaggagacctgtcatcaaagcacaaaagaacatgggcctgattattactttcagtcctctttaggatattttggcaggaagtgtccttactgagtgggaggtgggggcagaaaggcagggtcaggttgccagagagtctcacggagaggctgggagatggactgagtgaccccaagagtagtcccaggactcatctcctcctctcttccagagcgagaaacagggcaggtctcagcagtgtgcttggaatggaacaagatgtttagcctctatcttcaatctgtagtagctgagaactgccacagctgggtttataaagcaaggggtagaaattccctcctgctacctccctaatactcttcacaacatcgtccagttgtttactgtaatgacacactgtcctatttaaacacttccctgtctccaagaagaagttttattttttatttatatttattattattattattttttgacatagggtctctctctgtcgcccaggctggagtgcagtggtgcaatcatggctcatgcagcctcaacctcctgggcccaagcgatcctcccacctcagcctcttgaggagctgagaccccaggcatatgccaccacacccagctaaatttttatttttatttttttatagagatgaagtctcgctatgttatccaggctggtctcaaacacctggcctcaagccatcctcctgcctcagcctcccaaagtgctaggattataggtatgagccactgtgcctggcccagaagaatgtataaatgtcctcaaggtggagtgagctcccacaggtctcacggctggtttcatttatttggcctgcttgttggttactgtggaccacatggccgtgtgaggcgggggttggtgaatggggcaggaggcaccagggaaggagggtggcacatcctctgacttgggctatgcagccagtgggtcattttttatcacttctgggatggcagactctaaagtctgtcatcacaggttgatgctgctgtttgcggtgacagcttggggctggggaactgctgctgctcaaggcagctgtggcagaaccagagagggaccctctcatccattcctgtggaacgggcaaaatgacttccaaggccctttcctgttccttcaattggtgaaaattggcagagaaatacctgtgctttctttgaacatgtcgacccaaagtgatttggcaaagtagatttccttcatcagcacggtgctttaaccgtagttggcattcagtgaagtgtgattaactgctcatttttataaatgtcatgaaagagtattggatttggagtttgaattgcatcttaccatttcctagctgtgggatactgaataatgtaatagatgctgtcagtctcctgcccatgttccactggtctcaaccaatgactgatgggagaaggtgtgcaaatactccagcttcctcgcctctcttttgagataagtttggggcatgttctgtgctgtctctaagaattcccttgcaggaccgaatctcaattgctcatagtgttagcttgctcacttcctcatctcaagtacatttcaagtacaaagggagtgtactttgtactttgtacactccctttgtacttgaacttgaattcttgtttcacgatctacttttgggtgaaaccaacctaagacaggctttaacttatagttaaaagtcattaaaagtctcagtttcaggctgggcgcagtggctcatgcctgtaatcccagcactttgggaggccgaggtgggtggatcacctgaggtcaggagttcaagaccagcctgaccaacatggtgaaaccccgtctctactgaaaatacgaaaattatccgggcatggtggcgggcgcctgtaatcccacctactcaggagcctgaggcaggagaatcgcttgaacctggaaggcggaggttgcagtgagctgagatctcgccattgtgctccagccttggcaacaagaacaaaacttcctctcaaaaaaaagaaagaaaaaagaaaagaaaagactcagtttccacaactgtaagatgggaattataataagtatctcacagcaatattgtgagggtcaaatgggctatcatgtgcttagcctggcacatagcaagcatgtagaaaaccatttgctggctagaagcaggctatgatggatttcagagtgtgtattatggtggaacatagagagttacagtgctttggagagaggctgctcttaggttaggtgaggaaactgaggtcacctgcacatggtttgtattcctaggttgtgaccagcgacgtgctggtgaatatttaacacccggctcttggtaggggctttgggggaagccctgctttgtggtgttttccagtttatatgatataaataaatattcccactatggctgacttcactctaccaacctggtatcagtgaacactcagttgggaagagttgtgcgccattggcacttgggagccagtaggatctggccccagcacacatcgggccatgactaagtcagcatgtgaccccagtgattttaatttccaattctgtacatgcggaggggaggataagatttgtattaggcatccaagtcatgggatatgttcaagcgctgccccaaaccggttgaacctcacctgcatgcgagacacttctggggtgcatttagtgattatgattattattgtgtttttttttttgagttggagtctcactctgttgcctaggctggaatgcagtggcacgatcttggctcactacaacctctacctcccaagttcaagcgattctcctgcctcagcctcccaagtagctgggactacaggtgcatgccaccatgcccagctaatttttgtatttttagtagatatggggtttcaccatgttggccaggctggtcttgaactcctgacctcaagtgatccacctgtctcagcctcccaaaatgctgggattacaggcatgagccactgcgtctggctaatgattattgaaatgtttatgctgtgagactctggttctcagtttccccatctccaaggcaagggattaaatgattccatatgtcccttctaacccttgatctctttcagaagagtcattgccttgtccttctgtctatacaagaacaaaacctttaatgacaaaaaacctttcctgtggactacatgtgtgccacccaccatgagacacccagcactggcccctcctagagtccttcctcctgggaattcagtggacattaacccagtataatcctgcctgtcttgtatatcagtgtcacctcaggactccggcatggtgtgtctccagaggaggcctggagaggtggggagggagggactggttttttttggaacggatggtcccttcctttctgaatcactatgcaaagttatagacacccaagtagagtctgctcatggtttgcattcctaggttgtgaccagtgacgtcctggtaaatgtttaacacctggctgtttttggaaggaggtttggagaaaagtctgtgtggagaaagagaactttctatgacagaattcatcatcttggtgtaattttactcttaatgctctgttgacaaccctcccaaacaagtccctgactcagcagttccacccctaggaattctgcccctagggatgtaattggataaatgcagaaaagtatgtgtatggggatgtccctcgcagcattatttataataatgataacactccatagtgacaaatggagaccaacagtcatacattagttaaccatggcatgtctatactttggaataccaagtggctacaaaaacataggctgcaggtgtgtagctattaacgtggaagaatatgatatatatgtatttttgagatgtagtttcactcttgttgcccaggctggagtgcaatgccatgatctcaactcactgcaatctccgcctcccgggtgcaagcaattctcctgcctcagcctcccgagtagctgggattacaggcatgcaccaccacgccaggctaattttttgtatttttagtagagacagggtttcaccatgttggccaggctgcttttgaactcctgacctcaggtgatccacccgcctcggcctcccaaagtgctgggattacaggtgtgagccaccagaatatgatatatttttaagaagcagcttaccaaactatgtgctatttttacaaactgtatcacccatctatattagcatctggaaggatgtatggtaaaatgtcaatagtgattatctctgggtggtggaggtttgcgagatttcgatcttcatcttttttcatatgtaataatttatttttatgttttattgtggcaaagtacgcataccataaaatttacccttttaaccgtttctaagtgtacaaattagtggcattaactccattcacaacgttgtacaacccatcaccattatccatgtccagaactttttcgtcgttccaaacagaagctctgtacccattaaacaataaccccctcactcctttctccttccagctcctggtagcttctagtctacttaccgtctttatgaatttgcctgttctagctacctcatatcaatggaatcaaacaatatttgtccttttgtggatactaatcttttcatttatctatatatatttttcgtttttgtttttgagacagggtctcactctgttgccctggctagagtacagaggtgtggtcatggctgactgcagcttccgtctcctgggctcaagtcatcctcccacctcacctcagcctcccaagtagctgggactacaggtgcacgccaccacactcagctaattttttattttttatagagacaaggttttgccatgttgcccaagctggtcttgaactcctgcatgcaagccatcctcccgtctcggcctcccaaattgctgggattacaggtgtgaaccatggaacctgacctatatttaaaaaataaaacaaaaaatgtttattttacttctgcaattgaaaggaaagccccgggagacagctgtggtatttggcccctggaggttccatctcaggctgggtcatgtggtcctgactatccttcctggcctgggcagtatcagggtgctgcctccatctcagcctcacaggacaaaagtggccagggtgcagacgtgcagcaccactggcttgggagctgaccacagcatggcttgctggctgctggcagctggcccttggggcccagacccactgctgcttaatctcagggttttctgtgtggtgatgagtttggaaatgtgggctcacgattcgccatgactttgagggagcaggtgccgtgcagagagagagattcaaaccaggtagaagtggagttgtgtggacactagcttccctgaagctcgagaaggaggatctctgcctttctatttcaagcatcctttgtgtgtgcccaacgcttgccctgctaaatacccatcccagtggctgtagggctggttgttgaatgttttgtccatagtgtggcatggggtgcaggggggactttaactggtggagtccatgaggcctcaggtactctggggagatgggtggtggtagcctcagataatcagtgccccttcctaaagtgccgtgtagggtcttacagctcatcacacagacatttagggcaaggatggctcttttgtgtacagtcggggccatggtgccacgtagttggggggctgctgaggcagagtttgcccgcaggtcagctcaggaagctgcgggacccagaacagggaaaccaggtcacgtgactctattcaggggtcacgggagtgggtcaggtggcttttctctgggacatttgctctgaggcaaatgctgtgagttccttgttaggtgagttccccgaagcgcccacggctcctccagtgagttggtaaaagcgtgagtctgggagggcgctcagggtctcttcacctggccctgcccagtgggtggctaccttattaatcttaggtagtcgtccgggtgtacagaggtttgatagagccgcctctgcgggccacgtggaggagcagttctgcttttcatggggctgactttcctttagggttggtcagctgtgcccagggcagacagaggaggttgtgaatgtgctactgtggcaaacttcccctggaaacggtctggaaaccccccgatgtgccatttctcctggcactaggaggggtctgagatctgcagtgagcggggaatttccccgcacacgttgttggatgcgttaactcaaggttaaaggagggtggagggtggatgtcagatatgccgcaatgactgccgccccgaccaccctggagggctctggacacacccggcacttcctttgctcttcccactcactgcttttcaagtccaaggaacctgccggggtctgggggtggaggaggccagcgatcctagcttttgggttttcagtcctgtccccaggtggcgagtagaggaaacctcaagatctccgcacacagagctcagagtctcagcctatagcaccaaaaaaggaagaatgctggggttcccttgaggaaggggatgtgaagtcagagatgagtctgagtggcctgtgacttggaaaccactcagtaaacaggaagtgtcgataccaaagaaatctgagcttgtaggaaacaggggacccggaggcagcccctccttacctgcctggatctgtctgtctctgtctctgcagagctgggagacgaaccctcagatgggccatcgggagcacttggggacacaggcctcaggccctccctgcagggtggcctcccttaaatcctgtagttattggacaggaggaaagcttaccttgctcttccccaggtaggacattaaaactaccctataaactggctcagctttgagaaatgcaggtcagggagtgtcttgtcttatttgctttattggggccagtgttgtctccaccaactttccactctccccttgggtcctacagtcacatggaatgtctcacttggttgaactggagcccacgagggactatgtcttggctggttagcattctaggtctttagtttctctgagccagagtctaattctacacataccaagcacacacaccatacatgtggatacacacacatacacagccatacacaccacccccaaccataccctccacacacacacacacacacgccacacactggactctcactcacacaccgggagctatgctcacacccacgcacacacagctgcttttttctggagtctgtgcttcctttatgcttcctttttcgtcccgctccagcgccctgcctctctgattagtggctaagcgctctgaatttccttctgcaacatccatcctaaaggtcaggcacttgtggatgccagtggggcttccctgtaaacatgtggctgctcctccggtctgcgaggccattgtctgggtgggcccagcggtggccttctgggtcactcacctggccaccctcccactggggtggagctggaggcaggcctttccggcaggagtcccaggaccgcttcctcccatcttccacagtcgcgtctgggaacccaggcctgtgcagacagcttgggcagggagggctgggccgggctgggccacagttggtggcagaagagtggcggcttcgtaggctgacatgcttgaagaaaccccagcatggcccttgctgtgtttcagttcctcctgtgtcggtgggccaggcaggggcagctccggggatgggagtgcggtagcttgccaggaaggggctgtgcctgtcagttaccaagcatcggggtttttctgggaatggggtggggatggtctgcggggcctgtgaatgggaggggtagttcattgtcccctcagtgtcccacccagtgtgtgataagggactgagagtcagtggctctgtgactgcaagtgcccacgtcctggacctgcggctctgggcctctctccctggcccctgcagggtctgcttttcccacagcttgtcctctgggctggtcactcactcgcctcccatcccccagacctcccagcctgctgtgggctggtagctggagccagcctgcacctgctactcgcatagtggccctctcagatccagcgctcagccagagagccacaggagcactgggctgcatgtcggctgtgccacctgggacaagccacctaacctctgagaccttctgtttcctcatttgtaaagtgaagtcttccccctgaggttcttggagggactaagataaagcatctagagcctgctaccaccagcagcatcagcagcagccctgggcgcttattagaactgcaccttctcagaccccaccccagaattactgaatcagaaactggggcaaagggacctgcaatctgtattttaacgagccctcggagagattccaatacacactcaagtgggagaacctctcctccagaatacagttgggttggctgatttttggctgaaagcactttcttccttatcacctcaagagaagctgtagtctacaggggttccgcttggcacctgcaccgccctggatttgagcctcagctccgccccttctagctgtgtgtctttgggcaagtggcatagcttctttgtgcctcaactgttcaactgcaaaatgaggataataaagtttctttcgtaatgaggttggtgtaggggttaaaggagtccaggcagtgatggggcttctgttccataaagcaggaaggcagaaggcagagtatgccatttccttccgaggcagcccacattttgcccatgcccaggacaggcttgggtttgggaagcatgatctggcatctcttgccatctctaggtcttggcagggccccagcccgcagctcaagtctccttcctcgtgtggtgcaatggggctggggtttcctgtttgccatccacaccgcttcctgccccactacaaggggtccgaagcgcagagggatcactatctcctctgccattgcttggttacaaagcagattccctcaggagacctggccagttggtctttaacactgtagtggaaagcactgtgtccagcaactttcttctccaacccaggagatccaggttgtcctcagagggaggggcagggctcagagaagaggtgtgcacaggccccaaaagaggaagctacaggcctccagtgagcgtttcctttgcatcagacttggggcctggggctggggttctggcttctgtgacatggtgccctggcttgcaagaaggagccctttgcgtcagctcagtgcctgcacacatagaccctgcgggacactctacactgtcccctttctccttggaaatattagtagtagggagagggtgctaaatacccaactcagtttgcttttagaaaattccaccccttcctttcttgaagggctgctttgaaatacctatggtggtgtcctcaatctacacagctctttccctaccaggttccacagtggcgctcagccctggatgtacactggcatgacctggggaggctttgaaagtgcttctgcctgggcccctcccctagagtctgatgtaattgatctgggctgcaatctggatgtcaggatttgatttgatttgattttttaaagaaggggattcactccatctcccagactggagtgcagtggtaccatcatagcgcactgcaacctcgaacttctgtgctcaagcgatcctcctatctcagcctcctgagtagctaagactacaggcattaactgtgcctggctaattttttatttttttattttttgtagagatggggtctcacaatgttgcccaggttgatcttgaactcctggccccaagctgtccttgtgctgtgctgcaattacaggcatgagccaccatgcctcgctgacatcaggatgtttaaagcaacccctctctctacccactccctgccgctgctctgggagtctcatgagcacctggagtcagaatcgctgtgacgtcgggtgtctctaagccacctcttcccactgccccccatccttggtttcagtccaggctttggcaagtgctcagccctcccactggtcaggtggtggctctgtggggtctgccaccctgggaattctccatggaaagccctctcctccccaagcctgtctcagagactggggctgcctggagcctatagaacaactgttgctctccctccctcacccccactgggagctgaggtgggggtggttggggcctggcccctgctctacaaccagaaagacaattcaggaaacaaaaaacaaaagtgaccaccaaaggcagctcttcccctctctcaccctggactttcctgccagggctgcccctcccttggaggacttcccaattcataaataagacgagaggtgctgggtctccaggctggaactgaaaccacgtagggcgagccagggtcctggggatgctctgagaccaaggaaaggtggcacgttctccaggctccctgatcatggagcgtttggaggaagcaagacctaagagcagaggggattctgctgtttttggtgggagctccagacgcctttccctcctcctagagcgtcttgagaacttggtgtgtgctctcctctcaggaagctgaggctgtgatttttgggcttggccagccctgcatttgttcttggagaggcctcctgtgggaggctggaaacacctgcaagtggcatctgtgggaaggaagggaaaggatccttcatgcaactgctgcagggcttcagctggtccagagcttgggtgacgctgaccccgttccggcagcctaggctccagcgccaggctggtcctgagtgggcagctgtttcctcccaacttgagagtgggtgggggacagtgacagacccagtagttgcttcaatctcagatatggagcaggtgtaatggatgctgctgtaccacccaggtccccttaatctattgcatgctgtgagtgttgacagtgctgggtcttagcggcacacgtttcctgagaattgctcttgcagggaaatgcctacgggctgtccctctgccaatgattgacatgcagcggtccagaagcgccacctgcccacctccacgtaggacaactctgggggcccttcacaccacagagctccccaggggatcagctgtggctgggctccagctgaacgcacctcattcctagctcctcccactgcccccgtcctgcctcccccactcccttacaggtttctcctgaaaacacctgcacaataaatcacatgctttctttcaggctctgcttctaggaatcccctggcctaaggtagcaggttagtgtccctggacagactgctgatcccatccccttcctggaagcagtaatcatgataacccgggtgcaggagaggcacaggctgggagctgggggctgggggccagagaggaagctccaggcccaggaggggagagaaacaccagcaggggacttctgtgtggggtacgtgctgtgctgaagggcaggccgaagtgggagtgcctgtccctgcattgtccaggggtcatttatagggggaggtaagttttgatgagggtcgaggctagaacatgtgaatctgggtctgagggggagcatgggcacactcacagagcataaaaagtaggctccgaaagttctctgtggctgggatgtcatcatattaaatggccagaggaccttccctttgaaaagacgtcctcctgggtcttagggaaggtcttacccccaagctgtctttcaggcagtcaggaagtcatgaatgggtctccaagtaaccagctgaattccactgacaagcagaatgcattgcccaggcatttaatggagctgaggagaatttggaacattctgccaaagcatgaagccagtgtcagagggaaaacttgactggttggtggccccaacagggttccagcatgacaggaacctgggagactcatgtctcaactaggcaagcccagctgtattcacatctccagctattttggcagacatgctttgtggttagtagacattcaatatatgctttattttctaaagtgttttttctaaaaagaagtactgatttagaattctagagggagtaagtaactatgttcatagaggaagttcagtagatttaaatatgttttagacttccaaagagcagctccatattaaaaatgatttttgagagatagctcacacctgtaatcacagcattgtggaagccaaaacaggaggattgcttgaggccaggagtttgaaaccagcctgggcaacatagtgagactccatctttacaaaaaataaaaaattagccaggtatggtggcgtgtacctgtggtcccagctactcagaaggctgaggtgagagaatcacttgagcccaagaggtcaaggctgcagtgacctgtgatcgtgccactccattccagcctgggtgacagaatgagaccctgtctcaaaaaaaaaaaaaaaaaagatttgtgtaaaatttgccctttctttcttgtcccctttctgcccctcttctcctttctctgtgtggtagactatgaggtgttttagttctgtgcctagatgctggctgatgtgggaagcccctctttcctccttgcctcagtttccctcctacaagacataacaaccattagtctgtattcccaaggccccgtgggaagtcatgatcgtaaatggttcttaaaggcattttggagcccaggagagcaccataaattctggataataacaggggaggcagaagcattgcaaccagccagctgaacgaatgaatccctgtctccaaggccacagataatggcaggcacccctggaggaagtgtccagttgaatccaattgaatccacattcctgttccacaaaccgtcttcctctgaccttccttgtgtgaggaacaatgctctgtttaaggaatatcagagttaactgtgaatttccggccctctgttagtgctgctgctgtttgccttaaggtggatgtgaatgtagcttagtatctttagctggctgcagggagacagtgctttgtgaaggtggttggaaagtttgtgaagaaaggtgcagatgcccagagtggggcaaaagagggattgggtcctagaatcacctacctgtaatttcagttcaactttgggttaggctatgcaaatattttcttaacacttttttcccaagaaatgtcaaagtaagaaaaaaggtggggagaagtcaggccatagacaaagatggggcaacatgaccccataggtcggagttatagctatggccttggtgagatcacccaacaggtagagagtggctgagccctagaaaattcccacagtcggggccatcagactatctgatgtgtatcaatctggtaagtaaaaagtagggtcatgagggaagttgaacaccttttcatggatttattaattacttgtattgagttttccatgaactactgtgcgtgtcctttgcccattttatgaatgagcatagaacctttttcttactgatttattaaagctctttatgtattaaggacattagccctttaccatatgttttgtaaatatttttccccagttttcaatttgcctttttgactttgtatagtttccttttttttttttttctgaacagaagtttaaaattttcacaggttggtatcaatttcttcagcattttatttttcaatgtttaaatttttggttcagttatttcttttggtggaaggagtaagctagcgatttcacttccctgtcttcccccttccaaacgccagcgaattctctagtgatattttaaaaaattaagctacctttcccctgctatttagaactgctgcttacattccatgttcccagatatatttgggtctatttctgtatgtttattgtttcattgctctggctatttttttctgtagaaccagatagttttaagaatcaaattctctaactggtattctcagtagatttaagaagacatggtattaaaaagaattgtcttaagagcaggacagatgcagaactaaattaccaaatgataggttatgttggaggcaaagaacgaaagagagagtcctggagaaaattcaattggtgagttagaagattagctggagaattctgagaaaaataaggaaatggagggtagctgccggggtggatggatgcatagtgctagagagagaagagattgcagaagaaccaagaatggaccggctgcagtggctcactgtaatcccagcactttgggaggctgaggtgagagaatcacttgaggccaggagtaaaagaccagcttggttaacataacaagaccctgtctctataaaagaaaaattaagaaaaaaattagctaggtgtggcagcccatgcctttaatcccttcgggaggctgaggcgggaggatcgcttgaggccaggagtttgaggctgcagtgagctatgatggctccactgtaccccagcctgggtgacagaaccagacaccgtctcaaaaaaaagaaccaagaatgggaggaagaggggaaataatcaaagaaagatagaataacatttccctggctgaggaaagactccagtgttggagagtgagaagggctgccgacagcaggcaccgttcacctgatttccactccaaccaggctgcgcgatcagctctggctgagttcccccatgacctttgtgtggtttaacagaggctgctctgggttccccttccttgggctctgaccaccagctcctggctctgctggccttggcctccttctcaaggccccttgtttcctgggcttccttggtaccatgtctcctgtttttcctctttctccagggactccttcctctgcccatgctgaccaactgggttaatgggaaccctgctctaggccctgtccccttcaccccttctgttctttcccgatgacctcatcctctcccctcacttcacgtgccaggaattgctctcctgggccccaggcctgctgtacttctggttatctgcactggaagtttccatgggtctgcctgaaactcagtcctggtcctcacttcagcaactgtgaaggtggcacctctgcctacgttgcggtcctcgccagcagcctgtgcgtcaccaggactctgcctgtcaccccacgtttcatccggcagcacaccctttccccaaagggtgtgctttccacatcacgactttcctcttcttcttcgaactctctagagtctgtctctccaactcgggctccggcctctcaactggtccccgggatgctcttctcccggattatttctccacaaagcaaggcattgggtgggtgacctttccaaaatgtacatcagatcacatccctgccctcggaattccccttgttttcctcttgctgccgagaaaaatgactatagtcttggtggtttaaaacaacagaaatttaatacttatattctggagtccagaagtcttgaagtcagtttctctgggccaaaactaaggtggtggtagggctctgctcgcaccaggggctctgaggcaaatctgtgtccttgcctttcccagcttgtgagctgccttcaaggttcatggccccttcctccatcttcgtccacagtgcagcgttttcagatttctccctctgctgcagttgtcacgtcgccttctctctgctgtggcagagcctccctcttataaggacactggtggttacatttagggccccccagataatccaggatagtctcttcgtttcaagatccttcatttaatcacatctgcagagtccctgttaccatataaggtaattttcacaggctccaggtcggggcccaggtgtctctggggccattcttcatcctccacactcacatggcccagcattgcccaccagatgaagtccagactcctcaccaggtcggggttctgctcgtgccaccccatctcgcacagctccgagttgcctgctctttctgcctggacctactcgcccctcatctttgccaacactgaggtctcagtttagaggtctcttcctccagaaagccccccaggaccccaccctcatccgtaggtgtccttcctgtttgctaccatagcactcaccctcccttgacagagccctctgcccccacacatccccctcctcctgcaccatgtgccttgtttccttgactgctgagccaccatcgtgaagcacgatgcttggcacgttgtagacacaataaatgcttgttgaatgtgtaaatttatacatgtgtagaaggggcaactttttagaaaaagggacactgactagttacgggtaattgtcacttaagaaagaaaagttttggccaggcatggtggctcaggccataaacgcagcactctgggaggccgaggcgggcagatcacctgaggtcaggagttcaagaccagcctggccaacatggtgaaaccccgtctccactaaaaatacaaaaaattagctgagcgtggtggcacatacctgtaatcccagctactcaggaggctgaggcaggagaattgcttgaacctgggaggcagaggttgcagtgagctgagatcgcaccactgcattccagcctgggtgacaaaaaaaaaaaaaaaaaaaagaaagctttctcactagctcgactttcctttttttctttttgcgcgttacatgtgtactccggttttcatgatcagattattcttccttttttggaaaagtaaaaaaaataataaaatttaaaatttagagagaccaattgtgttctcagggtcccacttttggggacactggtagggtctgagttttctgaatggaatcacccatggtaaccggcagtaacaagttaccaaaacttagtggcttaaagtacatttatttttattttattttattatttaatttaatgaatttattttgagatgggcttactctgtcgaccaggctagagtgcagtggcgtgattgtggctcactgcagccttggcctcccgggcccaatttatcctcctgcctcagcctgcctagtagctgggaccagaggtgcatgctagcacatctggctaattttttattttttgtagagatgggatctccccatgttgcccaggctggtcttgaactcctgggctcaagcgatcctccctcctcggcttcctgaagtgctgagattacaggtgtgagccactgcgcctggccttattttattatttttttaagagacaacgtcttactctgttgcccaggctagagtgcagtggtatgatcatagctcactgcagccctgagctcctgggctcaagcaatcctcctaccttagactcccaagtagctaggactacctgtgcgtgccaccacatccagctaatttttaaatttttttttgtagagatggggtctcctgctgttgcccaggctggtctcgaactcctggcctcgaatgatcctcctgcctcggcttcatgaagtattgcagtcacgggcatgaaccaccatgcctggccaacgctaattgattatctcacagttctgtagttcaaaggtctgacacgaatctcactgagctaacatcaaggtatcaacagggatgtgttcttttctggagactctaagacaagtccattttcttgcttttccagcttctagaggctgtctgtgtccctcgggtcgtggatccttcttccaggaggtcgaatccttctcacattgtctcactgtaatactggttcctatgcctccctcttccacttaaaaaatatattgtgggctgggtgcggtggctcatgcctgtaatcccagcactttgggaggccgaggcaagcaggttgcttgagtccaggagttcaagaccggcctgggcaacatggcaaaaccccatctctactaaaaatgcaaaaaactagctgggcatcatggcatatgcctttagtcgcagctacttgggaggctgaggtgggaggatcacttcagcctgggaaagtcgaggctgcagtgagctgagattatgccactgcactccagcctgggtaacagagtgagtctctgtctcaaaaaaaaaaaatatatatatatatatatgtatatatatatatacacacacacatacacgtgtatatgtatatagtggtaaaatacacataaaatttaccatcttaaccattttaaagtgtctagttcagtggcattaagtaacttcacatgttgtgtaaccatcactgccgtctatctccagaactctcttccttttgcacactctgtacccattaagaaactctccatttccccttcttcccagcctctggcaaccaccgttctactttttgaagaatcaccattctataaaatcagtctctgattttgactactctaggtacctcataaaagtggaatcatatggtatttttctttttgggtgtggcctgttataatgtcttcaaggttcacccatgttctagcatgtgccagcctttccttcctttttaaggctgaataatattccactggatgcgtatattccattttgtttatctgctcatccttcagtggacacttgggctgcttccacctttgggctgttgtgagtaatgtgattttgcccctggggacacttagtagtgtctgtcgacagttttggtcatcatcactggggtagtgctgctggcatctagtgagcagaatccagagatgctgctaaacacctgcaatgcacaagacagtcccacgacaaagaacagtccaaggccaggggcggtggggcacacctgtagttccagctactcgggaggctgaggcggggggatcgagggagcccagggatttgaggctgcagtgagctatggtcatgccactgcactcccagcccaggtgacaaagtgacatcgcttctctccaaatagaaattaaaaaagaatgggccagctccaatggtaatagtgctgctgggcgcggtggctcacgcctgtaatcccagcactttgggaggctgaggcgggcggatcacctgaggtcaggagtttgagaccagcctggccaacatggtgaaacccttcctctactaaaaatacaaaaaattagcctggcgtgatggcgggcacctgtagttccagctacttgggaagctgaggcaagagaatcacctgaacctgggagagggaggttgcagtgagctgaggtcataccactgcactccagcctgggcgaagagagtgagactctttctcaaaaaacaaaacaaaacaaaacaaatggtaatagtgccaaggttgagaaatcctgatatatatatgtatatatatacctatctgaataaatatttatacatgtaaatgtgtgtatgtatatgcatattttatacttacatagattttaaacaaaattagacccatagttttgttacctgtgtttttgtaatgtattgttataattaaattgtctttcacattgtaatattttagtggtgtctgtagacacatactgtgatttctcgcactcggctgtatttgggcattttcaggtggtttacccatcctcagtagacctcagtagaatcgggctgtccctgagataactctctattctgtgttgtgacggtctcttcagagaggaggactcatcagtcatccttggaaccaatgtggctgtcagtgtgctctgtggctggggcatttgtgcttggattgtccaagggttgtcgtctttcctttggatgtttgttctcagaggctgtggcaagccgaggcagcagccagcagtgttgcccctcacagccttgggtcagtgttagctgtggatctgggtggggaggaacggagagccatggcgtccaattttgtgccccctccccaccccaagttctgctgagttcccaagcacacaacttgactttaacctctgtcttctccttccaaatgtaggcctctccttccgatgaaaagagaaaggaagaatggactacagccaccaaacgtccctagtcccatgtggacaagataaatacatttccaagtaagacgttttgctggagtgttttgtcctcagtgaccagtcccgtgctgggatgttgtgggtggacggcagccgctggcagagggccccccactgtatatcagactggtggggctcctgcatgggggaaggagccaagcagctgaacttggacttgtaagagcgtcagggctgctgctatagataaaaacatgtcccgagagcctggcctggaggtgaagtaaaggggaagtcaagacgcagaaactttgggggctcaaaagatgtggtatcctggaagacttccaggaggaggagttggctggtggctgttcgctatcttctgaatgtttgtgtctcccccaaattcctatgtggaaacttcaccccaaggtgctggtataagaggtggggcctctgggatgtgattagatctaagtacccttataaaaggccaagggagattgtttttcctccgcggtgtgaggacgcagtgagaaggcactgtctgtgaggatagggctgtcaccagacactgactctaccctgacgttggacttcctggccaccagagctgtgagaaatgaatttctgttctttagaagccacccagtctatggtccggcagccagaatggactcagacactgctccccgtcctgtccgttgtgttcccagggagtcctggctggagtagtgtgtccctcggctgctctgggtctggctaatgccctctgaatagaaggggacaatttaattgctttctgtgcactaaagtctcttgagctcaggctttttgctaatgtgactgggcttgagccaaaatagacccttgaattggaagttccagcataagatttctctatctcttttttttttttttagaaggactctccctctgtcacctaggctggagtgcagtggcgtgatctcagttcatggcaacctctgcctcctgggttcaagtgattctcctgcctcaacctcccaggtagctgggattacaggcatgcgccaccacacccagctaattttttaatttttagtagaggtgggctttcaccatgttggtcgggctggtcttgaacacctgacctcaggtgatccacccgccttggcctcccaaagtgctgggattacaggcgtgagccaccacacccagctgggatttctctatcttaacgaaatatttaatttatctgggactaaattgttggaagtccttaggcacacttgacacatgttttgtgacatctgaccattcttatctctttgtggacagatttccccagggacttctaccaaccaatgattttctctcccggtttcagatctgtgtgttcaaaagtaccaaacggccttttgtcttaggtgatttcgaatcacattttccacaaatttatttcagcttgcatagaatcatgctgctttatctaggtttaacttgtcaggattttcttggcatttccagtgggtcttgactcctggcgtggtccaaaatctctccactgaatggctgggttcagagaggctgaactctgccacctcttacttgagactagacaaaagcgcacagtggccccctccacctctcgcccctctcatcccacctggagtgcaaaacatgcactttcagatgaaacttgacttgtgcattctcagggttgatgagggatttccctgatcacaaagggggtgaaatctcctctctggccacgtgcagtagagctgtactcccagtgcagccacttggaaaacttggtggctaaggaggtccagtgctgggcttcagagggggagtttctaagggtttttattttttaatttttagaactgaaaaagtattgccagggcccagaagccacctcatgcccacttcttgtcactactccccaaggtgaaccactatcctgaattctaacactccattttgaactttctgtcaatggaatatgatctgtgcttttttgtgaaagaagctagacacaagaaaagcacatatcctataattcccatgagtcacacacatgcgtgtagttgtgtagttcattcacattctcttcgctgataattttccgttgtgtggctattgcttcctttatgcacccattctgatgctgatgggagtttgcaagtttttttttttttgtttgtttgtttgtttttttgagatggagtctcagtcttttgcccaggctggagtgcagtggcgcgatctcagctcactgcaacctctgcctctgaggtttgggtgattctcctgcctcagcctcctgagtagctgggaatacaggtgtgcaccaccacgcctggctaattttttgtatttttgttagagatggggtttcaccatgttggccaggctggtctcaaactcctgaccttaagtgatccgctggtcttggcctcccaaagtactgggattacaggcatgagccactgcgcgcagccagcttctgagtcttgtgaaggcctatcattattgtcctttcctcactcacagcgtgcttgagggagaaaaggccacagccatgcaggagaatcgctgtgtgtgggctctgaagtgctcgcctcagtgaatccatggcttattaacacctgctcattcagcttgagtttgggagtattgtcggtagacgaggcctgccttggtgtcctggagttgctccttactttaagcattgttctggggtggtgctcactcttgactttgatcctgggggaagatggttatggggtggtggtggcagaactctgtgtgcatgtgcatgtgtgtgtatgtacatgtggacagttacccaaagtggggtgactgaaggccaggtgagaggtgagagaaagagggaacaactgcattataagtggcttcagctgataatgttatatctcttctatttttccccctaagaaatgaacttctcttgcatctgaagacctacaacttgtactatgaaggccagaatttacagctccggcaccgggaggtaaggagtccccagggacggccctgattggctagtccagggcttgtcaccatgtgtcctgggtctgaaggtccctgaggtcccaagagaaccctgcctctcctgcttcttatttaggttgctagtgagagtccttggggttctttggaagaagactccaggcccagttttgttccaaaaaggatgaatgtttcagagatgtgttccagagacattcctgtagaaatgtggcagggctagcccagtctcatgggggagattctccagagggagctttcatgaaatgacctttccaggtggctcccaagcagacgttctctcgttgggcaattcgggaaccccacccagtcctctgtgtttaaacatttgggcccaagtcctatcactgcagtgacctgggcaaagcacataagctctggatgttagcagagtccccactgatagtgggcccgtccccacacttggtcatcctaggttgcttttgttactcatctgattcccatcctgaaactgagcttactcatcctgtatccatttctctaaagcctgttatcagatagatgatgagttataaaggagtctggtagggtactttatactcaagcgcctgtgactgataaaaaggtccctatgtgtaatgccctttgaaacacattttcaggttatcaagctgtggcgatttaaccatagaaacagataacagatggtggaatttcagctgctagggcaggttgcttggggacagtatgtgggatgtagtggcctattctgtgtccctcaaaccactccacttagacaaaatcctgttttgggttaaattttgacctacaattgtgtaaaggaatgatgcccaccttgaccaggggaaggccatgtaaattgcctatgtttacataaagccttcctccctgagacgcctaagcaccgtaaaattgtttcatttctctccttccctcttttattccttcctccctctttgaggatgattttggggcccaagttagttagttgctcaatgggctgatgttattttcacctatggggcttgtcctgaagatgtgttccatgacccagatctaacacttgaatagcccataaaacatggctccaaaaaggtttttctgagactagagggaggagaaccgattcttttaggaactgcccttcaagcttttactaatcagcagctgggccatgcaagattttagttcttaaatagctttcctgggttatgtcctatagaataaatgattaaaagtgcttcatgattaaaggatttcatagtcataagcgagtcccaattcttcgggatagaacatataaatgcctctagaatggttttacatttaatgtctaattagtcagcaacctttgagtataaattggggactcctgcaagatttattcacctgttggagagttgtcatttagcccgttagtttattacagaacctgggacattctgctgtttggaaatctgattagcacagcctctcccagctcatgatcacttgacacccttttaaagacagcagttcatctgctagaggagctagtgttctgtagaataaacttcggcaaatgttgctttaaatttccttcaaccaccaggttggattgctaaacagatgttgtagctaaagagacatcattttccgtagtaggggatgggacgtagctaactccagttcttgcttctgttaacaaggctaatctcacttattttaagaaatgtattccgctttctttaaaagtcattaggataaaaagaaaaacaatgctttttataatttatacctatgtatttgaatttcacagcaacttttgtgctgacctgtgaggtcagcttcaggatctggagtagttgacgtcagaaagtatctcagagctgcggtgtgaactgggcagctgcccctatcctgtgaatacagtctgggggcccccagccaggacatgtgaagaatgtgtcatttgtccctcagcatggtcttggcttctgtgggggcttttctaggctcactactctgattgctttgtgggcaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcaggggtgagtgaggagagacggggcagggagatgactgggatgcttgggtgttctatgtgttctcaagcagataaatgctgccttcttccagccagccctgaccctggctcctcctcctactacctctactgcccacctgccttagccttggaatgaggaacaagcagcagatgtggttgtgattgagcccccttcctgtcactgcaatcactgatgaggtcacaggaggggagctgctgagtcatacgaggggagctgctgagtcagagtcctcccttagggagaactcaggagtctctgagtggagctgctagtggctagtgaggcccagcctgtatatttctaacagggcgccccatgccccagcaccctccccactgggaccactcctcatagaatagccccactccaaagcatttatgacttgaaccttctgaccaaagctctctgaatcttgggggaacctagaagaggaaaaggaatgtcaggctctgtcagagtcagccaagcgagatcagccaggggtctgctccctgcagaccatacggggagccagggtttggtgagatggtggtagtctaagttcccaccagaagggctgggaagacctagtccatccctccttatcctccatggctgaataagccgccaaatgcgccgccaaatgcctctagcaaggcatgccctctttattgtctttctgggacttgagttttaggatcaagtgactagcctgtctccatcctgaaacctgctgatgctgactgccttcggccccagcctgggtggagtgtgctcgcctctcagccaaaaccacagtgacctttttttctggtttaaatgaaaaccaagccctctctgttggccacattgaacattttgctaaactccacagccaaatctatgtttctctacaattgagagaaacctactatgtggccagccctggggctggtctggtttctttccaaggggatttaaggaggaaaattgttgcccaccccataggtgctaggatgtctggttaaggttctttggtttcatctaactttgcaggtttcatgctctgcttttcagcactatcaccatatttttgttttgttttgtttgagacaaggtctcactctgtttcccaggctggagtgcggtggcttaatcacagcttactgcagcctcaacctcctaggctcaagtgatcctcccaactcagactccccagcagctgggactataggtgcacaccgccccaccccgaccttttttttttctgttgcccaggctggagtgcagtgatgcgatctcggctcactgcaacctctgcctctcgggttcaagcgattcgtgcctcagcctcctgagtagctgggattacaggtgcccaccaccaaacccagccatttttgtattttttggtagagagggggtttcatcatgttggccaggctggtcttgaactcatgacctcaagatatccaccttccttgacctcccaaagttccgggaccacaggggtgagccaccatactggccctacctggataattttcatgttttttgtagaaatggggtctcactatgttgcacaggttggtctcaaactcctggcctcaggcaatcctcccaccttgacttcccaacgtgctgggattacaggtgtgagccaccatgcccagctgtacttgttacactgtactgtatttgttatactatactgtatttgttatactatactgtattattgctgtatttgactgccaatggccaagcccatttcacagcctgaccctgacccccagactattctattccctaagtgagatgatttttaagatttcgtttgagcctgtggcctttggtttgggctgctaaagggtccttcggtccgcctgcttcttctcccttctctgcggcatcaagctggtcctggctgactctgcaaaatactttggtagaattttcaggaatggtaaatggtgtcatttagatgtcagctataatacagtgaatgcctagactgctgtcttaagaaggatcctgaggctgtgcgtggtggatcgtgcctataatcccagcacttcgggaggctgaggcgggtgatcacttgagctcaggaattcaagaccagcctgggcaacatggtgaaaccctgtctctacaaaaaaataaaataaaaaaaaaaaataaggatgctgagaccggttcctgcttcagcaagaatgaaggctttaaatcagggagtgggagtcgctgctctgggtgccaagtgttcaccattccccagaagctctgaccaggtccattctgtggttcagaagtatatgagttaaattacaataggaagttctttcagattttccattttaattgtccttccttaaaacgatcctccccagaacatgaggtttatctctactgggtcccagggagcccatgctcttctcaccatgggttgttcctaattggtcaaatatgattctcctttctagccaaatcctctgttgattttggatgtttttctgagctgctccctttgtcctttttggctttgagaagttatttgccagttatgatggcaaaccagggtctcagcttggactgcctgcttgtaaccctttcttcagcttggatgaggactccatccttgcaacgctgagaacactgtcagtgtcccttccaaagctgcccctgcccttgttgtggccaacttattactttccattccttttgaatgccagaagcaattatgagttatttcttcaacagcaatgagtctaaactggaatcttaccctgcaaaacgaatggccactattagagttttccaagtaagccatagaatccatacatgcttagaagcagtgcaggcaacacgtgggttttgttccttggtattatccatcctgggcttgatgaattggttgggtgtgttactgcagttgctgcaaaagaacatcttctccctccggaactccccctgccccacccactgcttgacctgggagctgggccagcctttcacgggatgctccgcgcagcccatctgcacccttcatcacctgatgtgtgccagtacccagcctggcactagcaaagtgctcccctttcaggagtggggtccagcgggtgcgggggcgtctctccacagggcttaaactagtctcccccctcccctttgtcttctccactcccagaaccactctgaagcccctgactgtgcccaaagttcagatctcagaggtggatgccccgccggagggtgaccagatgccaagctccacaggtacatgtgagtggaaggtacttccagctagggaccaactgtgtgaagaccgctgtgatagatgttgtaaactgttatttatttttgagaatataaaatgtatatggttcaagatacaaagggagagaattaagtcacccacctcatccacccacctagaagcatcccgagaacatccttcgtgggatagtccatgcaaatataagcaaaacacactgacatgtctttatgggtggatgtagtttctttccccctcccctcccctcccctcccctcccctcctctccccttcccttcccttcccatctccctctgtcactcaggaggatgcagtgcagtagtgcaatcttggctctgcttcctgggttcaagtgatcctcccacctctgcctcctgagtagctgggattaaaggcatgggccaccatgcccagctaatttttgtatttctagtgctgatgggtttttgccatgttggccaggctggtcttgaactcctggcttcaagtgatctgcccgcctcagcctcccaaaatgctgggattataggcatgagccaccgcgcctggttggatgtagtttcttttcttcccctagttatacaagtggtagcattgtgcagatcccagtttttatttatcagtttatctgggggaatgtttccatatacatttgtaaagaacttccttattctttacagctctgcattctttcactgtatggaaaaaggataatttatgtaatcactccctactggtagacatttaagtcattttcagcctctgctatgacaaacgagtttgcagtcggcggccttatacatgtgtcacgtcacacatttgtcagcgtgtaggattctttcaagtggactttctgggtttaaggccatatgcatttttaattttcatagatattgtcagtttgcaaaatcttttttatattacgtggattaaatatattttaataagagcagattaacctacttgtgattaatgtcagtattgtatatttatacacatacaaggatagacatatgccatgggaaccccacatatttttagatacatgttctgttaaacattattttttctaattttttattgtggtaagatatacataacataacgtttaccatcttaaccatgttaagtggtacagttcagtggtattaaaagcactcataatgttgcgcaaccatcaccaccatccatctccagaactctttccatcttgtgaaactgaaactctgtacccattaaactcccaatagctccccacatccttctctctttagctcctggcaaccaccattctactctctgtctctgtaattttgtatgtacctagaatgtacttacagtgtacctcaattatatgtggtacacttatatgaggtacactctaagtatctcatataagtggaatcattcagtatttgctgttttgtaattggcttgttgcacttagcataatgtcatcaaggttcatccgtgggtagcatgtgtcagagtttgtttgcagtatcttgttagctcttatatcatgcttatcctgtgccaggcactattctaagtgctttatgtatactaactcatttaaaccctcagcaaccctctgaggtgggtgttattattatccctattttatatataaaagcaccgaggcacagagaggttagtgatatatggcaatcatggagcagggatttgaacccagggagtccggctctgaagtctgttctctgaacttttccttgtataggttctctgtaaattctgcattatgtttttcccccagcagaaaatattatttgtataaaatatatatttgtggagacagtgggtgctgtcgcactggccacaaattggggaccatgtgccatgtcccaggtccagacagacagagttcatttccctctcctctctcagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataaggtaaggtggacagggggacggggagggtggaagacctcttcctgggtagatgccacctcagggctacagccatatggtgggtggtgtggatgcctgggaagccaagtgtttgctgctgtttagtctttgggttgtgggtgggctgcaagccctgctggcttcctgagggctgagggaccccaggtcagaagcctcaaagtccccctgtgggttccccttaaggtggtgggtgaattcagtggggctgtacaaagcagtccctgctgtagccttgaagaccccataaacgcagctcatcagtctctcccaagaaaatccacgtgttaccctcttcctgcacactgtgcccccagctggtgtatggtctggcttttcccagagctgaagcagagctgcaggtctcagacctggggtgtcagtgcaccacccaccccaccccatcttgctgatccctcctttcctcctgctttgttcaaatcctacccccggaggcaatacatggtgggagagtggtcagagacagccttgtgctgaagtcccagaggaagggtctttttgagcgtggagcatgaactgaattatgcaaaccccgagggttgctttgtctacaaagcctgctgcttgccagtctgccgggggctcccagggagtacattctgagtatcgttgtcactgtgccctgtaccgcacctggattttagcactgggtccttgttcccactcccaccctgagctgggcccttctattgacagacatccgtgttcacaccagcctatggctctgtcaccaacgtccgcatcaacagcaccatgaccaccccacaggtcctgaagctgctgctcaacaaatttaaggcaagttccctttgctgagtggccacagatggggtcacagctgtgccttgggactcctagagtggttgtgcgaggagctatggaaattgtgtgttttgtgggatgctgagcagagggcttcggttctttagatcctcacgatccaggacaaagtccacagaatcagcatcagcatcacctgggtgcttgttagaaattcagattctcaggccccaccccagacccactaaatcagaaattgtgaggggtaggccagggacgccgtctaacaagcctgcaggggatttggatgcctaccgaagtttgagaaacatcagccctcaaatcctttatgggctactttagaaggaccctggggcctgctgactggttttgggctcagtgcgaagattgacttctgggacacagttgggaaacctactttgaaatatgatacttaaatagacgtgcaaattatagtgcaggagtgcttttaaagttctgttgctctgtgttttccacaatctcttggagaccagagatcttttggagaccaggtgttcttatttttaatggaagccagtgtagcctaacaacctaagaacacaggctctgggttcaaatctccactgagcacctgctagttggatgaattgggcaggttacttaacctgcccctgcctctgcttcgtcatcataaaatgaggataatgggacttcactatggtatcgtcgtgagcattagatgggttgaagcctttaacatttgtagaactatgcctggcacattgcaatagacgatagctgttatctatcctagtcgtgtgctacagaatgaccaatttggtcaatgatgcaccacatatacgacagtggtcccgtaagattataatccattttttatggtaccttttctgtgtttagatatgtttagatacacaaatgcttaccattgtgttacaagtgcttacggcattgagtacagtaacatgctgtataggtttgtacactaggagcaataggctatataccatatggcctaggtgtgaagtaggctatgccatccaggtttctgtaagcacactctatgatgtttgcacaacaatgaaattgcctagtgacacatttctcagaatgcatcctcgtggttaagtgcatgactgtattattgataaagtcatctgccttctcgatcttctcatcacttctgagagttgtagataaatagctctcccctcaaaacagcctaaaattgacttagctttgcattgctaaagaagaggaaaagcctcgaagttgggatgtttaaatagaaactttcaacaagaatcttttgctcctgcttcagattgagaattcagcagaggagtttgccttgtacgtggtccatacgagtggtggtaagtctgaagaccacagtgtactttaaaacttctaattaactcaaaatagcaagttaaaaaaatacctctgcctcctttgcttgttgtttgagttttggaaacttccaaatgttgtttgccttcaaggctgatgggcttgctgtatgagtctactagggattgccttatatggccagtaaacaaattctaaacctaactgcctattaaaagaggaactagattttcttaagagacagataaacccaattcctccaaggagtttgaggcatggtggtattgttgaggggtgaggagtgggaggaagttgcttttcacaacacctatggaatagttcacttataaatcagtctcctgacgtatatggcggcatctcctaaggtgcctttggacccctgcattaaccactacttaatgtgagaaaggcctctcagggctgctcctgggtgtgtgtggttgcagagaaacagaagctgaaggccaccgattacccgctgattgcccgaatcctccagggcccatgtgagcagatctccaaagtgttcctaatggagaaggaccaggtggaggaagtcacctacgacgtgagttccctttgggtcaggcgatctgtcctcaggagggtggggatttggttggaccacctgtaactggggtatagaatgacttttttgaccaacgaccatgcccccttttacttcttcagcaccaggttctctcgaagccagcttttgcagagtaacaaacatctccaaatcatagtagctgacaacagcaaacatttgcttttttgcccatgattctgtggtctagtagcaatggctctactctaagtatgggttgagttcaagtctgcactgtgtgactcacccagaggcccaggcttttggggcagtagttactgcacatgggtgtggtcctcatggcagatggcggagcatgagaaaccaggccaaatcatgtaagcatatttgaagcctccactcagatttggtgtgtcatgtccacacacattccactggccaaagccagtcacatggacaagctcagcattaatagggtagagaaatgtacttatcccagggagaagagttgatagagcagggtggggattcttgtggggaaagggaagccattttttaactttttttttttttttgggatggagtctcgctctgttgcccaggctggagtgcagtggcacctccctggttcaagctattttcctgcctcagacccctgcgtagctgggaccacaggtgtgcaccaccatgcctggctaatttttgtatttttagtagagacggggtttcaccatgttggccagctggtcttgaactcttgacctcaagtgatccgcccgcctcagcctcccaaagtgccgggattacaggcatgaaccacgatgcctggcaccgtttttaaactttaactcaccccatagccacccacagcctctccaaagcgagttcatatttggatgcttgtttgagccttgagacccaaatcgtcatctggaaccctgattccttccattctcttaggggagaacaaaggggtttattaaacataatgggttcagttctttctctgcatcactgtgtcaaaagaaagtacttttctgtgtttggcttcacctcatcatgaattgaatgcatgacatgaaaaatgagaagttatgagatggtgtcacgtaagcgaagcgatcatcgcagactccttcccaccctggtgaggaatgaggcttggctgctgcctttaaggaaatcctgggtttctgaaaaaaatagacttcccaaggctttgtgccttgtataaggacaaccctgaaaggaattggaataatgctgggaagggcattcacccagacttgcttctttctctctaggtggcccagtatataaagttcgagatgccggtacttaaaagcttcattcagaagctccaggaggaagaagatcgggaagtaaagaagctgatgcgcaagtaagtgtggcttctggggcactgggtgcacttctcctggggcctcaacagaggggcctctgctgggtcctcgcagggactgtgctgagctgctgcatgggcctgagtctcggctttctttggagggctgcccattgacaaacctggatttcaagtgaggacgtgacagttaagtgtgttcatctacttcttgtgtcagcttctcgttttgatgtgggacatcaaagtgtctcttgtcctccctcttatggaaagactctgaaaagaaggtgttggtttaaaatttctttggggtctagatgcagaaatagggaaggtgactgtacgctggtttcttaagtatacgatcaggctcccagcaggagacagatgctcactccgatgagggtctttgacgggtgtttgaagaagggactatttgcgaagacttgggcagagtctggggtaacctcaagggatagtgcagtccctggggctagtgttaccaccccttgcctgaaggggtgaaggcaaggagtgctaaccaagacccggaggttccagggatttcaggaaggctgtcttagccgtggatgtagcctgagctactggcctccaaaatcctctcctctcccccttcctccctttgtaacatttatcttctggaaattgcatttggattgaaaaataaagcggctttctgggaaggattttgtgatttctttgctatgtttagtcatagaagagactgcctttcatagatatggtggaattaatgattcatttttgccactggagaataaagccgctgctggatttgctgtatcgatgatcataactagtctgataacacactgaacacttactatgtcctaaagtttttgttgttgttgttgttgttttgttttgttttgacacagagtcttgctctgttgctcaggctggagtgcagagatgcgatctcggctcactgcaacttctacctcccagactcaagtgattctcccgtctcagcctccccagtagctgggattacaggcatgcgccaccatatctagctatttttttctttctttctttttttttttttttttttgtatttttagtagagacggggttttgccatgttggccaggctggtcttgaactcctgacctcaagtgatccaccctcctcggcctctcagagtgctgggattgcaggcgtgagccaccatgcccagccaactatgtcctaaactttaaaaatagctttttctgtgcagcacaaatccctgaacataaggaatatgtccattgatccctgcacaacagtgcccactcctgcagctgcagtgccacggctcagggaagtcgtgggaaaacagaactccccccaagccacggacctccacgcctagtagctgctatggcctcttctgcaaaatgcaggttctgttataaggttgaaccatacgaagttgccatttttgtaggatccccaagagggtcaactgttagcaattttatatcatctagcctaggtgagggttcatgagctgctgtgcatatgaagtactatgcatagtgtcttggacatagtaagcaaacgcactgaattcgtagaatgcttattattgctgttgtttttttttacctttttttttttttttttttttttggctagatgttctacccatagtaaaataatctaatttggatttggcctctttatttcctctcatcgtgttgtaggaatgaacataagcaacaaagtagctaaagaggggtcagtaatggaagcaaaggagcagggcacttgactgcactgttacctggtgtgaccttggtgttacccaggtggccgggaaggtcctgggcaggggtgtgttgctggctgctctccatctgagcctgtttcttgtctccaggtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 36357 - DNA, 2185 bp, Homo sapiens
attcttcccctctctacaaccctctctcctcagcgcttcttctttcttggtttggtgagttgtgttggcctgactggcatgcaaggggtgtcagaggccagggctggggaaggagaaggggaggctggtgggggccagatgtgctaaagagatccagatgtgagattctgatgtggaactctgggtggattgtgtgcgtgggtgtgcatggcacacacacacatgcacgtaagacggaggaaaaaacaaacagaaaagtgagcaagtgactgaatttgagctctccaggtgcttctgagatgtgggcttgcacacgctgttgctatagtacgtgttggtatgtatgtgcctgtgggtatctgcactggctcatgtttgctgggttgcgcactcgggagcaggaagcaaaggaaaggcagaaggcaactgtgggcctttgtctggtggtgtgccccatgagcctctgccctgcacgcagcagcccagctcgagaaggtgcatggcctctgcagcttctcttccaacccttgcctctgccacctcactttgcccctccccatgctgagagctaagcggctgtgctggttttttccactgcaggcccctgggcaggcctccagcagccacacccagttctgggagggaaaagaatggcaagggcggggcctttgtggctgagctgtgggagtggatagactgagtgaggggtggaaaaaatgctgttgttgaggcaaggcctgggaggccctgggagtttgctgcccgaatctccagagcttgcgcagcggatcttgcaaatgttcactgcccagagcatgtgttccccactgtgcacaccctcccagccaggtgcgggggcccactgctctgggctcccccagggagggagcagagtctcgccaagtgctcctggagggatgggagtggagcctggcattctgaacacatctctgaggggtgggattaataagacggtctctgtgcctcctgctcccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttgggggtgagtgggtagtgcctgagtgagtccccacgtggggcatttcccacagaggagggcagcagtcttgctctagagcattagctacagagggcatctatcagtggggtggctgcctggggtggaaacacattgaacaccaccactcactgcctggccccatgctgaaagagggctgagaatgaatgggtcagacactgccaggtgctttgcacaacttaactgaagggaagactaagctcagagtgctaagtaacttcccaaggtggtcagtgtacacaactgccatccggaccgggactgtctgactcttgccatcactccaacagtggacactgtttgagtttctatttggcttgtagatgtgaagacacagatgtggagatgatcacaggcctgcagacgttcccttcaaacaataacaatgtatatttgtatcaaacataacacagtttatatattgttttcatgactattactacctcatgggattattagaacaaccttgggtgaaaatgtagtggtcccgtcatttttccattgcaccaggtactcagacttccttatccaaggagcaccttctccaccctagcttagccttgagggttggagttccaaactggacctcccaaaggagcctccctgaactctggtctgggagtagaaactgggtctggtcctggctccacccactgggcttctgttttctatctgtagcctcttctccctccagaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 36358 - DNA, 6006 bp, Homo sapiens
cccgctggcccaatggcagcgtcctacagtgtagcctccgcctcccgattgactggcctgcttggcaaggcaagtagcggcggcgcttcaaggtgggtgttcacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaaggtggggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcataggtgagaagacggaggtcaggtcacatcatctgcccaaggtcacgcggcaggctgggggacagttccaggagggccttgaagctggggaaaggaatgtggtaccgaggactgttcaggccttgaagagtttccagcagggcagggctgggttccgatcctcggcccacctccttatcgtgtgacttccgacaagtcacttttttatcttttttttgagacaaggtctcactctgtcgcccaggttggagggcagtggtgcagtctgggctcactgcaacttctgcctcctgggttcaagcgattctcctacctcaacctcccgagtagctgggattataagtgcccaccaccacacctggctaatttctgtattttttggtagggacggggttccaccatgttagccaggctggtctcaaactcctgacctcaggtgatccacctgcctcagcctcccaaagtgctgggattacaggcgtgagccaccacacccagccctagcgagtcactcaacaaactgagtcccagcgccttatttgtgcctccctcgtggagtccttgtaaggataggatggcagcgctttccacccctgggcacggttcctgggggaggagagctaacaaagttcgctctcagtgcatgctggcgggggctggtaatgttgtttttggttagatttggggaggatgaagggaggagcagaaaggtgggaaacaggatctctgggagggagaaaggaaggatggatttaaaaggtttcttaggtgaggcagaacttggggtccacagaaactgaattgtagctcagccaagctgaatcagatggaaagctgggaggcgctgggaacaggaaagccatctgtgcctctgacagcaatggggtgcgagtagagggcaaagtgacacatgtcagtggagacttgggatccttgcggtgccagtctcagaagaggatggttcttgggcacaccccaccctccatccctttttatgccaccagatgcgctgcctgaccacgcctatgctgctgcgggccctggcccaggctgcacgtgcaggtaggaccaaagaagcctttgctgggggtaggggagtccagtctcctggtatgacgtcacgcccttctttttgcaggacctcctggtggccggagcctccacagcagtgcagtggcagccacctacagtgagtacctgggtggcctctagcctcaggtgttcctgactggtcctgctggagtaggggaagagacctgagttccagtcctggctttgtcaggggcgttcttctctgagcctgtttccacttttaaaatgattatggtgatggagactgactctgattcacaggggcagggtccatcattgccgaggttagcatgtgtgatctcagagctccctgggtgtgatggggagggggttgccaggtgtgagccatgggtacctgtgcctattgccagtccctggtgaaggcaaaggctcaagccccccacctaccccccttgattcctctttcaagccctgttgggcagggaagtgcgtctgggctccaatggccacccaagcacagggagaggtaggcacggacgggctcaggccagaggcggcctccagggtccttgctgaggctggggagaggtgtggtgagtgtacagcccctttgtagcccagcagttgcacctggaagtgagggccaggctgctctccctgaggctccagggagacagtgtgtgaggcctcttgccatggcctccctgcccgcctctctgcagagtatgtgaacatgcaggatcccgagatggacatgaagtcagtgactgaccgggcagcccgcaccctgctgtggactgagctcttccgaggtgcgtcctgggcatgaggggacagggaaggtgccgggtgggcacggatgcatgggggaggagggtgcccctgcccaccacacccgtgctgcccacaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggtgagcccctgccccaaccggccaccacgccagcccctgccactgggagagggaggccaggcagccctaggcccaaaccctagcccctgcttgatgtgcgtccccaggaagtccctttccccctctgagccacttccctcgtgaatgggaatgatgagggcttgttaccagagcacagagtcagtgagttggcagagtgaagcttccagccctgggcaggcgcctgacacacagaggttcccccttggggtctggccaagggtgtgacccctgggcctctgagccatggggtgacacctgaggccatccacgcctccctggatgtagccaccgtttccggagtcctgcttgtgtgcctgttgcagcttcccttccccagtggctgctcccctgaggcccggctttccgttctcttagtgggtctcgtgcttacccgtgggggccaggcctgccagcacgggaacaatatgactcggtcagagctctggtcagacccctgtgtgtgcctggcaggagccccggcagccgccgccgctactttctgtgtgcacagcaacccctcccagtgttctgtgactcgggtggctcctgtccagatcctagtttgtcctctggagcactcccaggtcctccaggccatgagctgcggccctgatgtctctactccagccacggactgagagtgcataggagtgtccccaaacagcagtcacgatggtcacaaccttggcttccagacagtgagtgctgtccacagacagacccggtgctgtgccatgtgtgtgactcacagcctctcctgtaatctccacaacccctcgaggaggtcgaggttattgtctccatctttataagcactaaaggatgagcctgccagccacaggtcccactgtgagttgtggacactacatttctgggatgggggcatatgagagtccttgccaagcacatttgaaggttttcccagccagcccctcccccagcgggctacccaggaactgagagttaggacgtgcccttgagtttgggctgtgcccccacttgctgtgtagctttggggagcccctcaacctctcggaaccttgtttttctcatccatcaaatggagagaagtagatttaaggcacaggattgcacccaacagtgtaggcattcttggcgatgttgcaggttcggctccagaccatcggggtaaactgagtcacacagctgttttggttttccagtgcatttaaaagttagatttagaccgggcacagtggctcatgcctgtaattccagcactttgagaagccgaggtgggcggatcacttgaggtcaagagttcgagaccagcctggccaacatagtgaaaccccgtctctactaaaaataacaaaacttagccgggcacgttggcaggtccctgtaatctcagctacttgctaggctgaggcacgataatcacttgaaccgggaggtgggggttgcagtgagccaaaattgaaaaaaaaaaaaaaaattagggccggttgcggtggctcacgcctgtaatcccagcactttgggaggccaaggtgggcggatcacaaggtcaggaattcaagaccagcctggccaacatgttgaaaccccgtctctagtaaaaatacaaaaattagccgggtgtggggttgcacacctgtagtcccagctactcaagaggctgaggcaggagaattgcttgaacctgggaggcggaggttgcagtgaactatgattgcaccaccatactccatcctgggccacagagcaagacttcgtctcaaaaaaaaaaaaaggatttacactgtactgtaggctgcgaagtgtctaaaacacaatgtatataccttaattaaaaatactttaggggccaggcacagtggctcacacctgtagtccaagtgctttgggaggtcaaggtgaggggattacttgagcccaggagtttgagaccagcctgggcaacatggcaaaaccccgactctacaacaacaacaaaaaatacaaaaaattagcccctgtaggcccagttacttgggaggttgaggtgggaggatcgcttgagcctgggaggttgaggctgcagtgagctatgagctgcaccactgtactccagcctgggtgacagggcaagactctgtctcaaaaaacaaaaacaacaacaaaaactttattcctaaaaagtgctgacccagagataagaagcaagcacatggttggtaaaatgacatcagtgagcttgctttatgcagggttgccccaaaccttcaatttgtaaaactcaaaatatctggaaagcttggtgaggcgaggcgggactgtaactcagcactcaccgcagggtgagacccttagggcagcgggtgctacactgaacaaagcggtgaacagccccctcgtgagagggggttcttggcagatgacgccagcagctgacaaacaggcaaggcaggccgggcacggtggctcacgcttgtaatcccagcactttgggagtccaaggtaagcggatcacaaggtcaagagatcgagaccatcctggtctacatggtgaaaccccatctctactaaaaaatacaaaaattagctgggcgtggtgatgcacacttgtagtcccagctactcagggggctgaggcaggagaatcacttgaaccgggaaggccgaggttgcagtgagccgagattgtgctgctgcactccagcctggcgacagagcgagactctatctcaaaaaaaaaaaaaaaaaaaaaaaaaccagcaaggcagggacgccagcagggcacgtgctgaggagacaggcgcgagcaccagaggtgcagggcggcctcttagccggagtccaggaggcctttgaggggagagggcttctggcagaccccaggggtggggatgagcagtgacaggggccctgggggctgggatgtgacagggcagcgtggcagtgtctggtggcccctcccgcaggccatcaccatcgaggctgagccaagagctgatggcagccgccggaccacccgctatgacatcgacatgaccaagtgcatctactgcggcttctgccaggaggcctgtcccgtggatgccatcgtcgaggcacgtgaggcccccgggtgggagggggcctgaggctcctcagcagggcctaaccaccgtccctgcacctcaacctgcagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgaccccacgg

SEQ ID NO: 36359 - DNA, 6006 bp, Homo sapiens; identical to SEQ ID NO: 36358

SEQ ID NO: 36360 - DNA, 9180 bp, Homo sapiens
tgggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggtgagggactctgtgggaagggggaagcctctgctggccgggcttgggagaaagcactgcatgtccagtcacactgcttccaggctttaggatgcctctaagcaaagggagaagggaggggctgagtcctgccgggagctgatagccagctggtggggtgtgtctttgctgagtcactgtggttttgcttttttttttttttttaagcctgtaagtgctgaatgtgttcatgacaccagtccccggccctattataagtagtaatacaatgaaattttatcctcaatgatactctctccacttatatttcattctaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggtacacctcagtttctttttttttttggagacggagtcttgctctgtcaccaggctggagtgcagtggcgtgatctcagctcactgcaacctccacctcccgggttcaagcgattctcctgcctcagcctcctgagtagctgggactacaggtgcatgacaccacacccagctaagttttgtatttttagtagagacagggtttcacagcattggccaggatggtctcgatctcttgacctcgtgatccgcctgcctcagcctcccaaagtgctaggattacaggcgtgagccactgcgcctggcctctttttgtttttaagacggaatcttgctccgtcacccaggctggagtgtagtggcgcgatctcagctcactgcaccctctgcctcctgggttcaaacaattctcgtgcctcagcctcccaagtagctgggattacaggtgtgtacccggctaatttttgtatttttagtggagatggggtttcaccatgttggccaggctagtcttgaactcctgacctcaggtgacccacctgcctcggactcccaaagtgctgggattacaggcatgagccactgcaccagaccccacctcagtttctgaatcctggagtctcttcatttcattccctgtcatcattccttcccccaaaatgaaatgcttcttttccaaatctcagtttgcaacttagtttttctgaccccatcaaggatcacttgtgggtctgagatacctgggagctgtaaccccataggtttttccctgaagggtttctggctagtgcacttacttgatttctgagctcccttcctacgtgtttcaccatcctaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattggtgagcaggaggagcaccagctcagtgtgctggtccttcatcagcctggtggctgggatggtccttacctagggaggtgggacagagctgggtggtcagaaagagactgtggctggtacctggggccattttgcctgaagagagtcctgggcgccataagtgggttctgactcgtttcctccacagtgaacttgctgactgagaaggcaccttggaactctctggcctggactgttaccagttacgtcttcctcaagttcctccaggggggtggcactggcagtacaggtatgagagactccgccctcaccctgctaggtataggtccctcccacaggcattccctcagcatccgcctctcccagcattcctccccagcccccatgtactctcagacctttcacatcctggtgctgggctgacgtccctcagctcccaggccctactgaggcgtcccccggctccctgcaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcaggtgccgccccagtggaaagggcatgtgggagggtggagccggagaagcagggataggggcccgtgggaggaagagaacagaccccgcctgagaagctgccgctcccaccttggtgttttttaaagtataggattattgtatacatgctctcctaataacttaggtaatgcgggcagagggcaaatctctttcgagctgcacttactttttcagagcttcccactctgtttagtatgttgggttctgctctttttttgagacagggtcacgctctgtcacccaggctggagtacagtggcataatctctgctcactgcaacctctgcctcccgggttcaagcaattctcctgcctcagcctcctgagtagctgggattacagatgtgcaccagcatgcctggctaattattagattttttgtagaaacagggtttcaccatgttggccaggctggcctggaactcctagcatcatgtgatctgcccacctagcattccaaagtgctgggattacagttgtgagccattgtgcccagctgggttctgcttttttgcatttttacatacatattatatatgcagactcacagaactaatatggcattgtggaggtttttcctaaaacaaatggtattgtgacatagccatcattctcagagttgcttattaacagaacattatggagatatatttttcttccatgcctgaaggtctccctcattcattgtaattgatacagagaattctgtagtttgagcatggttgatttagccacccacctcttgagggtagaattaattaagactggttccagtctgttgcttgaaaataaaacactaccctgaaatgcctagaggcagggttgctgggtctaagcccccagacctttcttattcacttgacctgccctcctagctacctggtgttcaatgtcatccccacgctggccgacatcatcattggcatcatctacttcagcatgttcttcaacgcctggtttggcctcattgtgttcctgtgcatgagtctttacctcagtgagtgctgctgggagacaccgtctccctgaactatccagggactcccttggccatgagctgtgcccccactcaagtgacccacctatgggaggctgtggattggtggacttgaatgggctcctagtgctcgtcatgtgatgggcgggtctcttctgtcaaatcaaaccttaacctagctgaggggctggggaaggacattcttgtcacgttaagtctgagccgtggacacaggtcaaggaagcctcgtttgtgtaacaagatgcagcttgctttcatttaccaaaagcgttttctacacatgagactttgtgcaggctgcagaggtgcctccctgtggaatctgggtgtccgggcttgagcataggcttagtgtgtacatggcaggtagtggacattgacatttggtctctgcttttggggatgatgtcctattctgctccccatcctgtcactctccagccctgaccattgtggtcactgagtggagaaccaagtttcgtcgtgctatgaacacacaggagaacgctacccgggcacgagcagtggactctctgctaaacttcgagacggtaacagagggcccggtggcagtggtgtgaggcgtggagatgtggaggagtgtaaccaggaccactggggctgacagagagctgggggtgtgatgtttgtgtgtgatgtttgaactcaggaaggaggattgagagttggggggaatgacccgagtgccatgtgctgtgcccatgccaaataaatttggtttgaattcatcaggtgaagtattacaacgccgagagttacgaagtggaacgctatcgagaggccatcatcaaatatcaggtgaggatgctagtttgaggcctccggagaataatgccctggcctggtagaattttcagggccaagagtgatagtcgagtgttggggtagaaggggcctgggcccaggtttggactcactgatggccattgtgtataggacattcctcttcctgtgttattgccctcagggtttggagtggaagtcgagcgcttcactggttttactaaatcagacccagaacctggtgattgggctcgggctcctcgccggctccctgctttgcgcatactttgtcactgagcagaagctacaggtgaggcaggatcttggatgagagagtggggcacaaggaaaagggggcctgaggcctgtgtctggtcaccaggctcttcggtaggaagtgggcagggtgacacaagaagagcggcctgcaggccccccgtgacatgctctgcttccttgattgccacaggttggggactatgtgctctttggcacctacattatccagctgtacatgcccctcaattggtttggcacctactacaggtaatctgagccctggccctcacctgtccagggcacattattatttcctggctactcagagaagtcctaaccagcacctttttgcaggatgatccagaccaacttcattgacatggagaacatgtttgacttgctgaaagaggagacagaagtgagcgaagggagaggagtagggtttggggagggaggagctgtgtggtgtttctcgtgcttggaaaacacaaagctgagaacctcagcacacatgggtggtgcccttccaggtgaaggaccttcctggagcagggccccttcgctttcagaagggccgtattgagtttgagaacgtgcacttcagctatgccgatgggtgaggccttccttttgcttcctttgcttttccgttcatttgcacactgccttcctgcttctcagtgctctgaatccctgcttttggaaaagagcctgggcaggggaggggcagggcctactagcagctctggtgatggaaggtgcctgctgagcaaccccacctttccttgcaggcgggagactctgcaggacgtgtctttcactgtgatgcctggacagacacttgccctggtgagaggagacccagccacttggcccagatgcctcaagcttccctcattcagtgcccatggtagcttgtgacccaggctgtggagtcagagagcccagtcacgataggcaaccggattgaatggtgcagcctccatggacactggtgacctcttggagagggaacctcaaaagccagtgggcctcggccggctgcggtggcacatgcctgtaatcccagcactttgggaggcttaggtggccagatcacctaaggttaggagttcaagaccagcctgaccaacatggtgaaaccctatctctactaaaaatacaaaaattagccgggcatggtggcgggtgcctataatcccactactagggaggctgaggcaagagaatcgcttgaacctgggaggcagaggttctagtgagctgagatcgcgccattgcactgcagcctgggtgacggagtgagattcggtctcaaaaaaaaagccagtgggcctgagatttttcccatttccaatgcaacaggtgggcccatctggggcagggaagagcacaattttgcgcctgctgtttcgcttctacgacatcagctctggctgcatccgaatagatgggcaggacatttcacaggtagggttgctctggagaagacggtggtttaggggtctacgtgtggaggaatgataagggctggctgtccagagagaggagatgtcacccttgcaaaaaaactagggccattctagcatgatataacctacagtcacacaagtaaagtagtcatgttaaggatttgtatggtgccataaaagctacaaagggctgggcgcagtggctcatgcctataatcccagcactttgggaggccgaggcaggtggatcacttgagcccaggagttcaagaccagcctgggcaacatggcaaaacaccctctctacaaaaaatacaaaaattgctgggcgcggtggctcacacctgtaatcccagtactttgggaggctgaggtgggcggatcacaaggtcaggagatcgagaccatcctggctaacacagtgaaaccccgtctctacgaaaaatacaaaaaatttgctgggcgtggtggcgggcgcctgtagtcccagctactcgggaagctgaggcaggagaatggtgtgaacccaggaggcggagcttgcagtgagccgagatggcgccactgcactccagcctgggcaagagtgcaagactctgtctcaaaaaaaaaaaaaaaaattagctggccatggtggcacacacatgtagtcccaccaggaggctgtagtgagctatgatcatgccactgcactccagcctgggtgacagagcaaggccctgtctcaaaacaaaaagcaaaacaaaaaaaaaaaaaaaaaaaaggtacaacgatattctgtagccaggtgtggtggctcacacctgtaatcccaacactttaggaggtcaaggcagcaggatcatttgagtccaggattttgagaccagcctgggcaacatacctggcaaccccatctcaacaaaaaattaaaaattagcttgacgtagtctcaagcacctgtggtctcagctactcaggaagctgaggtaggaggattgcatgagccaggaggtcaaggctgcagtaagccgagattttgccactgcagtccagcctgggtgacagagtggactctatccaaaaacaaaacaaaacatctgcagcaatctggtgaagcaggaagagaagatggggaaacagagaggagtgatttgcccacacggctaggatatggggcagtgatggtgggattattaccacagcctcttatcccacgtgcttccggccagcccaccctgcctcccaggccttgggggtatctcataaggcagagtgtgtggtcttttggccctaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaaggtgagagattcctttgcagagagtcccctcccctcctggtgttgtcctgctaatccctgacccctgttccctccgtttcgtaagaaacgtgtggtgggtaatatccacagggtacaggacacaggtgggcgagcggggactgaagctgagcggcggggagaagcagcgcgtcgccattgcccgcaccatcctcaaggctccgggcatcattctgctggatgaggtgcgccctgggtctcctcccctccttcctgccttgtgtatgctcaagccgttcctcctgggcactgtccccacctagaacagataccatgaattcaaatctcacaaaacacactttccagttctcaagcccaaacaaggctcttgtgtattcttgaggcctcagccagcagcctgcctccttccattgagggttttgagtggcaggagcagttttacctggaccctctctataggcaacgtcagcgctggatacatctaatgagagggccatccaggcttctctggccaaagtctgtgccaaccgcaccaccatcgtagtggcacacaggtacaggactacaggcctggggcggctggtgatgtggcccgctttgggtggggtagtaggcgactgatctttgacttctcaggctctcaactgtggtcaatgctgaccagatcctcgtcatcaaggatggctgcatcgtggagaggggacggtaagagacacatagatcaaaaggacaggtcttctgaattgggggctccaggaaagggggcatgaagtcccaggggcttctggaggggacctcccttcccatcccgtcctctctgtgggctggtggcaaggaccctcggggtaaaactaatggttaggactcacacttttctcctcaccccagacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 36361 - DNA, 281595 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtgagtgtccccgcccgaaacaggtcaccctgcagccgctggcgccgcggacgcactctcccggggccgcgcccgatgctgcccaagccctctgcggctgggggcgaggggagcgctttcctacgccacgcggtccacgccggggctttctgctgcgggtggcgccgcccccacgccggccgcgtggtccctgcctgcgccccggggcgcggcgcagggggacgcggggacgcggggccagtggctttgctactggaggccctgcgggcccttagggctcgggggaggaggagcaggaggtggggaggcggggaacccaggctgccgaaagggggagtctcttgcccagcgggagaagcgactgcaccccttacacgcccacccttcgctggctcccgcctcctgctctgggactcgcagtctcctgaactcaaacgcaccttttcctttctttttaagtaagcagcttacgaacagtttcctttatctgatctcagccaaagcctaattagtgtcctggacctatgccatctcccagtagtgtccccaccccttccgatattccttacgagacagctcgatccaactccacgtcccgttgtacctctctgtgtcccggtgtctctgtatcttttgtctcagtgaccagggctctccttttgcctctttgtgggaatctcactgtgtgtccatgtgggtcgtggtacctagttatggcaagtttcatgtgggtaaaataacactattattatttttcatttatgaatggggaccctgttcttgaacaagattttccaggatttgcttttaactgggacatgcaccgccacgactggagtctgtctttgaccagcttctttcccctgtttccaatactttcacttccacgtaggaggacagctcggaggtggggtccctggaatcgctaaccttcagagaggtgatccatggtcttgatgcaggtggttcctaccaggagttctaccttcttaaaaccaccccagggctcctgagctgggagggcccacagccctacccattttgtgcaaggaaacaaacggagaaagactcgggtgacagtagtaactaaaatttccatcttggcctggcgcggtggctcacgcctgtatccctgcactttgggaggcagaggtgggtggatcacgaggtcaggagttcgagaccagcctggctgacatggtgaaaccccgtctctactaaaaatacaaaaattagccgggtgtggtggagcacgcctgtaatcccagctactcaggaggctgaggcaggggaattgcttgaacccagtaggcggaggttgcagtgagctgagatcgccccactgtactccagcctgggtgacagagtgagactccgtcttgggggagtggcgggtgtgtgtgggggaattccgtctgctaactacataagcctgaacctttgaagggcttcaatctcacttggatgattattagatcttctgtttcttgacctctgccgcctcatctttcccacatgttgatattgccttttattatgggacaacctagggtgggggtctccaattttttgggttccctgggccacactggaagaattgtcttgggccatacataaaatacactaacactaatcatacactaacactaatgatagctgatgagctaaaaaaaaatcgcaaaaaaaaatctgatgttttaagaaagcttacgaatttggcagcccatgggcctcaggttggacaagcttgacctaggggattccaagaggatgagtcgcttactcttgtttcgattgtggtacactcagtgggtgtaggaacttctcttggttgtttggcggcctttctcttaaggagaggggcacgtggaggaggaaggaatatgggtgtggtttctgcaaataataacttgaggtagacaaatggtctcctcaacttcaggcagggcaaggaactttttttttttttttttgagacaggatcttgctttgtgcaagctgtgacccaggctggagggcagtgacacattcatagcttgctgcagcctccaactcctgggccgaagcaatcctcctgcctcagcctcccgagtagctggggctccaggtgtgtgtcaccatgcccggataataaaaaaaaattttttttgtagagatagggctctctatgttgttgctcaggctggtcttgaactcctgggctcaagtgttcctcccgcttcggccacccaaagtctgggattacagatgtgactcctgcctccttatatttttctccccctgcattttcaaaatgtaggtggcagggaaataggaagtgatgcgctcccattgatgacttgagtaggtgttcatttccggtttccctgatggaagggaaggagctagtagacctctgttttactccgaggacacttaagctgagagtggttaagttgcctggactcacacaacaatcaagtgtcagagcaggctccaaagctgggcagactggctccccagcctctttggagctgctgtactgagctgcttccagttcaggtgctgtcggaaatgcatggagaaggcgctccctgttctggaaggctagagtttctcaagggaaattcttaaagtacctgcagttggagatgatgcatgtgtaacaactattagtgtgctttagggcagctgttctcaaagcatagcactcagagcagcagcatcggcatcacttgggagattctaagagatgcagattctccagcatccactctggactgattcagtaaaactggaaacactgggtgtgtgggtgggggtggtgaggtttcaagtgctccaggtgatcctgatttgaggcgcttactgcttccagctactcctttcattggagtattattacagtattatgcttttctttatttttaattgttaaaatttctttatttcttttttttgagacggagtctttctctgttgctcagctctgtcacccaggctggagtgcagtggtgcaatctctgctcactgcaacctctgcctcctgggttcaagtgattctcctgccccagtctctcaagtagctgggactataggcgtgcaccctcacacccagctaatttttgtatttttggtagagatggggttgcaccatgttggccaggctggtcttgaactcctgacctcaggtgatctgcccgccttggcctccaaaaatgctgggattacaggcatgagccactgtgcctgggccagtttgagggattttaaagtctgaggcctcatagtgagaaaataataataatcatcatctgaggaatgcggagtccttttaaattatcaggcccagagagacattaaaatgacacagcagtcacctcgtagttcccacccccttgagctatttacttatcactcgaaagtacttcatattgccacatagctacagattaacctaacagtgccccaaggacactgtaatccacagctcaggagtttgagctccagcgatctgcctgcctcggcctcccaaagtgctgggattacaggcatgaaccaccacactgggtctgtagtaaattcttgagttatattttgtgccttagcctcctgcttttaggtcagtatttgtgtacccttcccactgccagtggaaagctgaaatgagcccatccaggaagtggctgcctggagacagggcccaccttgtagggaaaaactgctttttcaccttcttgttgagtgtttgcttttcttctcaaatatcatctgctttctgaacttgtgaactggcagctgcctacctaaatgatgccaataactggcttactgacttttattcaaagtattttcccgggattttggtgtatttatagcataatttggacttggagtctaaaaggagtcatgcattatggctgttggcaattgtggatttttaaaggtagtattttcacctatttctttcttttttctttcttttttttttttatgagacagagttttagctctgttgccaggctggccgtggtgtgatctcggctcactgcaacctccgcctccagggttcaagtgattctcctgcttcagactcccaagtagctgggattacaagtgcccaccaccatacctggctaattttcatgtttttagtagagacagggtttcaccatgttggccaggctggtctcgaactcctgacctcaggtgatacacctgcatcggcctcccaaagtgctgggattacaggtgtgagccactgtgcctggccttccattttcttttagctattgtttcatttctaacaataaaggcagctagaatttcttttggtatttgatatgagatagtccccattttttccccaaacagctcgttttccccattatcatttattgaataattcctcctctttcccgttagtggaaataagtggcatagcctatgaactgtggccagctgggcacaagatgggtcaatccctgagactctcctaggaattgtcctgctgccccctggtgcccggcaggcactttgcattcctctgcccacacctgatccagaggtgatctggggtcagcagcagggtggaggctaacaacgaaggacttttccctaaatatgggcattgagagggatctccagatgcatctggcccacagaaagtggttaaatccttgctcccctgttgctggccatatctcagtgggtgaagtgtcatcttgcaaagcctgtgctgctgtggaaactgccactggtgaccagacagactctctggagacctgccctagagagctgatgacatgactatagaagcaaacacaagtggctgagggcaggggatggcttagagaggaagggtgtgtgaggccctcagtcaatgcatcaaatgtttaattttatattttctttttctataataaaaaaaatatttttcttgtagagatgaggtctcactatgttgcccaggctggtctcaaaatcctgggctcaagcagtcctcctgccttggttttcccaagcgttgggattacaggaatgagccactattcctggccatttaattttgtgtttttgtgtgtgtgtgtgtgtgtgtgtgtgtgtgtgtgtgtgtgtgtgtgtgttttgagacagggtcttgctctgttgcccaggtgggagtgcagtgatgcaatcatggctcattgtagcctcaaattcctaggcttaagtgatccttccagctcagcctcccaagtagctgagctacaggtgcacgccaccacacctagctaaagtgttttttttttttttttttgacggagtctcactgtcacccaggctggagtgcagtggtgtgatctcagctcactgcaacctctgcctcctgggttcaagtgattctcctgcctcagcctcccaagtagctgggactacaggtgcctgccactatgcccaactaatttttttgtgtgtttttagtagaaatggggtttcagtatgttggccaggctggtcttgaactcctgaccttgtgatccgccctccttggcctcccaaagtgctgggattacaagcatgagccaccgcacctggacacctagctaattttttgaggggcgggggacggagtcttgctctgttgcccagtctggagtgcggtggcgtgatcttgggtcactacaatctctgcctccagggttcaagtgattctcctgtctcagcctcctgagtagctgggactacaagcgcacgccactgcatccagctaatttttgtattttcagtagagatgggatttcatcatgttgaccaggatggtcttgatcttctgaccttgtgatctacccacctcggcctcccaaagtgctgggattacgggggcgagccactgtgcctggccagtaatttttattaatacatttttggtagagaccaggtctcgctgtgttgcccatgttggtcttaaactcttggcttcaagtgattctcccgccttggcctcccaaagtgctgacattgcaggtgtgagtcactgtggccggccaaatagtaaatttctgtgtctgcagaatcacagtctcttggggttgagcatcctgaaatctgcattttttaaagcattatttcctggttgattcagatgctgagatttgggagccacgtttctcaggtctttctcagtctttggtgtccaattctacttgatcggtgtctgggaggccaaggttactgccttgatcctctgcggtttagattattcatttagcaaacatttgagtgccttatttttattttattttttgtttttaattttttaatttttgagatggagtttcactcttgttgcccaagctggagtgcagtggcgtgatctcggctcattgcaacctctgcctccggagttcaagcgattctcctgtctcagcctcccaaatagctgggactacagatgtgcgccaccatgctcagctaattttttgtacttttaggagagatggggtttcaacatgttgtccaggctggtcttgaactcctgacctcgggtgatccacccacctgggcctcccaaagtgctgggattacaggcgtgagccgccatgcccagcctggactatgttttctaccccaaccttgtggtcagaggtgaccatgaaactgagacctggccaataggaagtggttgcaaaaggtgtctcgcttccacgactggaacacaaaaaccagccccatgcaacgcctctccagctgaataaagaggcctcctggagaggaggaggactgagaggaggccgagccgcaagatggtgaaagtccagctaggagtaaatgtatggtgttgttcaccaccctagatggcccaaaaggggactatagcatgacaataggcatggtcttggtttcttgttttcttttttgagacggagtctatctctgtcttgcaggctagagtgcagtggcgtgatctcggctcactgcaacctctgcctcccgggttcaagcgattctcttgccttagcctcctcccaagtatctgggattacaggagctcaaaaccacgcccggataattttttatttatttatttattttgtatttttagtagagaaggggttttgctgtgttggccaggctggtctccaactcctgacttcatgtgatccactgcctcggctggtgattttgaattaagccattgagaatcagggcttgtttaatagctagcattatttgcacgatacagtggctgcctccctcattgtgtgagctctttgagaacaggaatggtactttattgtaatggatttgcacctggcaagaaagaaggcaccctgccttctttcatggtggcacatgcctgtaatcccagctacttgggagaccgagcaggagaatcgctttaacccaggaggtggaggctgcagtgagccaagattgcaccactgcactccagcctgggctacagaatgagactctgtctcaaaaaaaaaaaaaagcaaaagaaaacgtagtccaggctgggtgcggtggcttatgcctgtaatcccagcactttgggaggccgaggcaggtggatcacaaggtcaggagttcaagaccagcctggccaacgtaatgaaaccccgtctctactaaaaatacaaaaattagctgggcgtggtggcatgcacctgtagtcccagctactcgagaggctgaggcaggagaattgcttgaacccgggaggcagaagttgcagtgagccaagatcacgccactgcactccagcctgggcaacagagcgagactccatctcaaaaaaacatagtccgtgtgtccagcagtcgctgctgcaggagttcatcctgaacccgtgttgggtgtgctggagtagaagtatggaaaagctgtgtgagggtggggattttgtttttgtttttgttttttgagatggagtctctgtcgcacaggctggagtgcagtggcatgatctcggctcactacaacctccgcctcccgggctcaagcgattctcctgccgcagcctcccaagtagctgggattacagatgtgcaccaccaggcctggctaatttttttgttgttgttagagacagggttttgccatgttggccaagatggagatctctggggaggggtttaccttcctgttggagcttggatggagaaggtgggaaatcgttcctggcaggggatgagatgtccaggtcacagaactgcagttggagaaagtgttgcctgagacgtgtggcgaatgaccacccctcagtcgctatgtcgtccctgccagccggtagcgtttgttacacccaaggttgccctcccctctttcatcccagcagatgttcagactttgcttctcccacttccagccccttactcatgagtacttacagcccttttgtggcctgcgacgtagctccttgttccatttctgggttccatgaccacttccgtgctggtctgtttcaggcctagtccctgtctgctcttttctctgcgctagctcctatcttccccttttccttagtgtcatagaattagtgggttgaaaggaagagatcttctagcccacactcagtacaggaatcccttccagatactgggcagtggggaaatgcattatgtgactctcatgactttagattcgaatgccagaattatgttgtattgagccacagttttctttccatgcaatttctacttgtgtttacttacttctaagaaaagcattacagaatttaatgaagcaaagaatgatctgtgaatcaagcagctcctagaaccaaaataggttcagagccgctctcctttgtttttttgtcaacacgcagagcaagttggctacctcccttcatatgctcgcctcatagtattcaaagacagctatcatggccacattaaatctttgtttctttgtttgagacagggtgtcactctgtcacccaggctggattgcagtggtgcgatctcagttcactgcaactttcacctcctgggctcaagccatccttccacctcagccccctgagtagctgggaccacaggtgtgtgccagcatgcccagctaattttttatattttttgtagagatgaagttttgccatgttgccctggctggtattgaactcctgggctcaagtgatcctcccgccctagcctccaaaagtgctgggattacaggcatgcgccatggtgcctggacaggagtttatttttgaccctgttaagtttgagatgcctgctacacattcaagtggagatgttgaataggcattcaattggtcatgagtttggggctcatggagaagtttatcttattattattatttctttaaatggagtttcactgtgttgcccaggctggcgtgcagtggtatgatcttggctcactgcaacctccaccttctggttcaagcaattctcgtgcctcagcctcccgagtagctgggattacaggcacgcgccaccacacccagctaatacttgtattttagtagagatggagtttcatcatgttggccaatgtggtcaggaagtttatgtcaatttgggcatcatcagtgatacatgcagttgagctatattggacacatggccaattgacctcacagtccgcagggcttgtccccatgtaactgctcttctatccctatgcaaattcattttgtagatgctaacgtttagcagctcattgttgctgttgaaagttcttggaacactttcgtagtctgaatgctagaaaggatgggtcctaggaatgtcctctaggttgtggcagatccactaatcaacactgtggttgctagattaacttggccacaagtgtcaagagaggtcgtgtcatatggaggtctgctttatggaagtcaagaggtattggagtattggatcacctgggcacttctgtcttttttttttttttgagacaggatcttgccttgccagccagccttggagtgcagtggtgcattcatagcttattggagccttgacttcccaggctcaagtgatcctactgcttcagccccccaagtagctgggactacaggtgcgggccaccacagctggctaatttttctaattttttgtagaggtggggttttgccatgttgcccagactagtctcgaactcttgagctcaagtgatccacctgccttggcctcccaaaatgctgggatgacaggtgtgaaccgtcatgcccagcctgggcagtcattcagaaaccctaccaagaaaagggttaaagtcatttggcatggtttcctctttttttttttttgagacagggtcttgctctgtcgcccaggccgaagtgcagtggcgcaacctcagctcagtacaacctctgcctcccggggttcaagcggttctcctgtctcagcctcccgagtagctgggattacaggtgcttgccaccacacccggctaatttttgtatttgtattttttatttttatttatttttttgagatggagttttgctctttttgcccaggctggagtgcaatggcgcgatgctactgtgcctggcctcacgatttcctcttttttttttttttttttttttttttgagacagagttttgctcttgttgcccaggctggagtgcaatggcacgatcttggctaactgcaacctctgcctcccaggttcaagtgattctcctgcctcagcctccccagtagctgggattataggcatgtggcactacgcctagctgatttttgtatttttagtagagatagggtttcaccatgttggccatgctagtctcgaacgcctgacctcaggtgatccacctaccttggcctcccaaagtgctgggattacaggcgtgagacaccacacccggccatgattcctcttaacacaagctggctcttggtgctgcttttcatgaatatactctcaaattgctcccttcaaatgattgttgatgtgcattatttcttttaaccttattagctttattttttctaaattctttttagattacatagcagtttcttagccctcaccatgattggatcacctggacagccataaaaatatggatgtctgttccccttataggccaattggaaaaataatttctgggggtgggatccacgcatctatctatctatcatctatctatctatctatctatctatctatctatctatctatctattttttttgagacagagttttgctcttgttgcccaggctggagtggaatggtgtgatcttggctcaccgcaacctctgcctcccgggttcaagcagttctcctgccttagcctcctgagtagctgggattataggcatgcgctaccatgcctggctaattttgtatttttagtagagatggggtttctccatgttggccaggctggtctcgaactctcgacctcaggtgatccgtcagccttggcctcccaaaatgctgggattacaggtgtgagccaccgcgccccgcacatcaatattttaaaaaggttctctacgtttctgatgggcactgaagcccaagaaccactgatcaactgcttgccaaagtcaaaaatatttctgtgcatatttccatttttctggccaaaggttcgctgcccctttttcaggttcctctcaaaggacttgtctgatctcaaagcatgagaaccattaccacaataggacttactcccctctgtgggtgctcagccagtggctgagggagaagggggattgctccgtgccagggatgttgttagagatgccgggttcttcgatttttatagtaaccccttgttgagggtggctctgctcttgtgttacatacaggtgaaggaaactgagagagtccaggtagcataatgagggtcacccaggcaggacatgatggagttgggaactgagtcaagtctgacaaattccaaagcatgagctgcagcctctgcgtcactatgtttattttctcaccctgggtcagagattaattgagctcatgagagtacttgacaggaaatctcacacttgtgaattcagagctcgtgagcataaaattgctcttctaatcacttgcttttatttgctgatctttattggtgcattttattggtcaggatgtgattgagattatgtaataaacccaactgaccgcttcttttaacttctgctattgaagtaatccctcagattactgtcttgagagacggagagtgcatacagtccaacagtgtgtactcttcctctttaaagacagtagaaaggtatccatcttgttttaaatagtagcagggaggtttatcaatggcttaacatggtaggctgggcctggagagctctcaatgtaacagagctcaaatgtggcatttacatgaattctaagttgattaagcgacacaatttgttcaactataaaacataatacattcttaatagattttacctattattgtatatgtaagttcctagtacatattaggctgtaggtaaatgggatgatgagggttcttgctaaatttatcccccatccttttttttttgagtcagagtcttgctcttgagcaacctccaccttctgggttcaagcagttctcctgcctcagcctcccgagtagctggaattacaggcttgtgccatgacacctggctaatttttgtatttttagtagagatgggactttgccatgttggccaggctggtcttgaactcctgacctcaggtgatccgcccacctcagcctcccaaagtgctgggattacaggcatgagccactgcgtccagcctaaatttacccttttatcatgccttttttattgtcttaagtctttaagtcttatttaagtcttgactcatttgcgacttttttactaaattgttagctctattaaggcagaaaccagtatcttcaatgtcttaatctctcagtgactggtttaacatcttgcaattaatatgcttaattaatgtttataagctattactttagtcttaatctcaatttcttgaatttagagttgctgacacctgtgtcttaggtaggaccaagtgagaagctagttattgtgacagcctcagactggagccagaagacccatgatcttgtatatattagctgtgtgtgaccttaggcaagacacatgaccactctgggcttcagtatcctattctatgatttagaaaaattaaacctactcatggcatgttttaagaactatattttaaaaatacattataaaatatttatttatttatttattatttgtgtgaggcagagtctcactccgttgcccaggctggagtgcagtggtgcgatttcggctcactgcaacctccgtctcccgggttcaagtgattctcgtgcctcagcctcccgagtagctgggactataggtgcatgccaccatgcctggctaattttttgtagttttagtagagacggggtttcactgtgttagccaggatggtcttgatctcctaacttcgtgatctgccagccttggcctcccaaagtgctgagattacaggtgtgagccacctcatctggcctatttatttatttatgaggtctttctgtgttgcccaggctagagtgtagtggctattcacaggcacactacatcctcaaatttatggcctcaagaggtcctccttcctgatcctcccaagtatctgggactggctccaagaggtgtattttaaggaaaaagtttttttttttttgagacgaagtcatgcccttccacccaggctggagtgcaatggcgtgatcttggctcactgcaacttctacctcccagattcaaacgattctgctgtctcagcctcctgagtagctgggattacaggtgcctgccaccatgcccagctaatttttgtatttttagtagagacggggtttcaccatgttggccaggctggtcttgaactcctgacctcgtgatctgcccaccttagcctcccaaagtgctgggattagaggcgtgagccaccatccctggccagttctctttttttggagacagagttttgctctgttgcccaggctggagtgcagtggcacaatcttggctcactgcaaccttctgggttcaagtgattctcatgcctcagcctcccaggtagctgaaactataggcatgtgctaccataccgggctaattttttgtattttattagagataggtttcaccatgttgcccaggctggtttcaaactgctgagctcagccaatctgcccaccttggcctcccaaagtgctagagttacaggcgtgagccatcgtgcccggtcaatgaaacaataaagttctatacacttatttttcttttcttttcttttttttttttttttgagacagagtttcactcttgttgcccaggctagagtgcaatggcatggactcagctcactgcaacctctgcctcggggttcaagcaattctcctgcctcagcctcctgagtaactgggattacaggcgtgtgccaccacacctggctaatttttgtatttttagtagacaaggggtttcaccatgttggccaggctggtctcgaactcctgacctcaggtgatccacctgcctcagccttctaaagtcctgggattacaggcgtgagcctccgcgcccggccttatacactaatttttctccctcacctccaatcaagcagggaaagtgaatatggaagtaggtcagtgtataatgtcccatctctggtgaatggagaagtcacctgtttgtaagtccccccagaaatgaagatctattaaaaaaacaaaggccacaaagggaaatttaattcatactcagaagtgggccactatctatggaagtacttggaaaataataaggtgcgttattattacatctttaagaagttttcctgggctgggcactgtggctcatgcctgtaatctcagcactttgggaggccgaggcaggcggatcacctgaggtcaggagttggagatcagcctggccaacatagtggaaccctgactttactaaaaatacaaaaattagctgagtgtggtggtgggcgcctgtaatcccagcttctggggaggctgagacaggagaatcgcttgaacctgggaggcggaggttgcagtgagccgaaattgtgccactgcactccagcctgggtgacagagtgagactccgtctcaaaaaaaaaaaaaagtttttctggaaagcagtttcacagcagagcaacaaggctgaaattgccccagtcagcctttgctggctgacttccctttttccgttaatagcaccaccacacccagtaactaaggcttgcgtcctcagttatctgcacgtagggaagagtctggtcagtgataaaaggtagttggtcagttgccacgtcttgactggaggcacgcaatgattccagattccaacccagtcaatacactgcaggctttatctttacaaggcatagctctgctgctttctgttccagaacctttggtggcatcttctttggcatttaatactctccttttcctggtcctaacttagctttcctacattctcagatatccattgttcctggacagtcaatatatgatgcctttcccctgatcacaccttatatttgctgtcctgttcccttagctcatgttatataccctggctagagtacctacctctcagctcggctgctaaaattctccctgaaaacccatccattaaccaacttctagtccattattcagaggatatggaactgctatttatttatttatttgagatggagtcccgctctgttgcccaggctggagtgtagtagtgtgatcttggctcactgcaacctctgcctcctgggttcaagtgattctcctgcctcagcccccaaaatagctgggattacaggcacccgccaccatgcccagctgattgttgtgttttagtagagatggggtttcaccatgttggtcaggttggtcttgaactcctgtcctcaagtgatcctcccgcctcagcctcccaatgtgctgggattacaggtgtaagctaccacgcctggcccctatttatttatttatttaagagacggagtctcactctgttgcccaggctggagtacagtggtgtgatctcagctcattgcagcctctacctcctgggctcaagtgattctctaatcacagccttttgagtagctgggattgcaggcatgtgccaccatgtctggcttacttttgtttattttttgtagagacgagatctcactatgttatccaggctggtctcaaactcctggactcaaatgattctccttcctcggcctctcattctgctaggaatacagacatgagccaccatgcctggcctggaactactgtatatttagacattataattatgtactgcttcctgtaggcaggggggctattctaagtaccttaccaataaatattattaaatactaataacaaacctttggggtgggtactattatttcccacggtcacacagcctttgagtggcagagcctaggttcaaaccaggtaggtaacttagcacagagtccctgctctcagctgcagcgtcatgtacctcttgattataggtgctgggaatacagtgaccctggtccctgccctaaggggcttatgttccagtgggagtcaaaccatatacatttttgagtctctgctgtttgccaagcacaggggacaggggtgtctgccgaaaaggccgtgtcatctgtgtagctgctagacactgtcagttccctgtgggcagtgtccttgcctgtatatgtcccaagtacctgacctagtcctggcacaaagtggctcagttggctgggcaaggtggctcatgcctataatcccagcactttgggaggctgaggcaggtggatagcttgagcctaggagtttgtgaacagcctgtgcaacatggtgaaactcttgtctctacaaaaaatacaaaaattagccagtcatggtggtgcacacctgtagtaacagttactcaggaaggctgaggtgggaggatcacctgagcccaggaggttgtggctgcagtgacacatgatcgcacccctgcactccagcctggacaacacagtgagaccctgtctcaaaaaaaccccaaaaaacaacaaccaaaatctcaaacaaaaccaaaacaaaaaacaaaaaacctgcctcccaggttcaagtaattctcctgcctcagcctccccagtagctgggattacaggcatacgacacatgccaccacgctcggctaatttttttgtatttttagtagagacggggtttctctatgttggtcaggctggtctcgaactcccgacctcagatgatttgcctgcctcggcctcccaaagtgctgggattacaggcgtgagccactgcacctggcgccactctttttttttttttgagacggagtttcgctcttgttgcccaggctggagtgcaatgacgagatctcggctcacggcaacctctgcctcctgggttcaagtgattctcctgcctcagcctccctagtagctgggattacaggtatgcaccaccacgcccatagagacggggtttctccatgttggctaggctggtcttgaactcctgacctcgggtgatccacccacctcggcctcccaaagtgctgggattagaggtgtgagccactgtgcctggccccctctcttaatctctgcattctgctgccactcagcatgagatgctcttcagaaaaaatatccttctggctgcaatataaagttaggggagggcaggaatggagggaatgagttaggagctagctacagtcctagttgcttgggaggctgagatgggggcattgcttgagcccaggagttcaaggctgcagtgaggtatcattgcaccactgcactccagcctgggagacagcaagaccctgtctcaaaaaaaaaaaaaaaaaaaaaaaaaaaaccacagaaaaacttcaaggtggctctaggattagcagcatcagcagcagcctgtgttttaatcagtcctccaagtgattctgatgcatgctgatgtttgagacccactgccacaggaccagtttttaaacttttttttttttttttgagttggagtcttgctctgttgcccaggcaggagtgcagtggcgctatctcagctcactgcagcctccgcctcccaggttcaagcgattctcctgccccagcctcccaagtagctgggactacaggtgcgtgccaccgcgccaggctaattttttgtatttttagtagagatggggtttcactgtgttgaccaggatggtcttgattcctgaccttgtgatccacctgccttgggatcccaaagtgctgggatacaggcttgagccactgtgcctggccagtttttaaacattttgatcacgttctacaagttttacatatgtaatgaccaagagatatattctctttctctctctcacacataacatatttaacatactttaggctggacacggtggctcacacctgtaatcccagcactttgggaggccaaggtgggcagatcacaaggtcaggagtttgagagcagactggtcaacatggtgaaaccctgtctctactaaaaatacaaaaattagccaggcatgatggcgtgcacctgtaatcccagctactcaggaggctgaggcaggagaattgtttgaacccgggaggcagaggttgcagtgagtcgagattgtgccactgcactccagcctgggcgacagagcaagactccttctcaaaaaaaataaaaaataaaaaaataaaagaaaaacatactttagtaaaagtttcaagaaacagtgtcctgtcttaggaaacatgtgacacactggtattttcgattctgtttcattaaacaaagtgctttgagacctgtcagaacccctgctcttgagcaaatcaagaaggttgctgtgctgcaagggtgcacttccaaagccaccttcagtgggactttcctgtctttgaagaagcctttcacttccagagcttgacccagggagtccttgtttctctaagtctggacctgctcctttatcacccatattacgggctgaattatgtccccccaaagttcgcatgttggagtcctgatctctagtacttcagaatgtgattgtatttgaagacggggattttttttttttttttttaagatggagtctctctctgttgcccaggctggagtgcagtggctctgttgtccaggctggagtacagtggtgtgatctcagcccactgcaacctccacccctcccaggttcaagcaattctcctgcctcagcctgacgagtagctgggactaccggtgcgtgctaccacatccgggtaatttttgtatttttagtagagacggggttttgccatgttggccagcctggtctcgaactcctaacctcaggtgatctgccctccttggcctcccaaagtgctgggattacaggtgtgagccatagtgcctggcctgattgtgattttttttttatggcagcctgagcagactatattacagcccacaagcctcacaaagatattgcctggagttagtgccactggttgtcattttccagagctgctttgtagggcagtaatgtgtcctctgttagactgaactcgccaaggagtttgaccctctattccacctgcttattatagaactactccctcttttcctcatatttcttgggttgagtttgggtaagattactaaaattcttcagatgtggaaccaatcttcataaacacttcagaatactttgcttccttctgaattactacagacaagcagtctgggaggtccaagtctgtataattattgttcttaacattctgtcactcattattgttggtgttcgtttctcaatgccagatgaggtgtgtcttgggcaaaagcctgtccagtgtaagctgttctgttctttcaggcagaatcactcagacttatgctctcaactttctctctctctttttttttttttttttttttttttgagagagtctctgtcgcccaggagtgcagtggtgtgatcttggctcactgcaacgtccacctcccagattcaagtgattcccctgcctcagcctcccaagtagctgggattacaggcttgcaccaccacacccagctaatttttgtatttttagtagagatggggtttcaccatgttgccacagtgcctggcctgaactttctcttttacagccacatgcaaattacctgaactatctggcttttgggaaaaccctgtgcaagttcttagcatccagtattaaaagaaaagagatggctctgttctcttagcaactcaaaatcctcttccttctccccctttaaaatataatgtagtccttgtttttccttaaaataaatattttaaagagaaaattggtccatttgaagaagccaaaataggatctcttcccctctccttgttgctgtctctctcgagtggattttggtcatttctgctaagtttgcccagaaaataggctgaagtctgtggaagggaaattccacaaagctgcctcatgtccacagttcctcgggaggaattcctttcctgtaaggaggaggcacattttctgagagtcccttccaggaaggatgaggtgcagcaggaaggaatcccacagagagccgtctcacagacacagaaaagggaaggaattgcctttgacttctgggaattggatggttttttttttttttttttttttaatagaaggcaaaacagcaaatggcagctactagtgactgactatatcaggttttggaaaagtgggcagtgagggttttgttgattggattgaactctgcttggcaaaccatagatgaccctgagtaagccttaggccttttttttttttttttttgagatggagtctcactctgtcacccaggctggagtgcagtgtcatgatcttggcgtaccacaacctctgcctcctgggttcaagtgatcctcctacctcagcctcctgagtagctgggattacaggcacctgccaccacacctggttaattttttgtattgttagtagagatggggtttcactatgttggtcagggtggtctcgaactcctgattacaagtgattcacctgccttggcctcccgagccttagcccttttgattccctgacatcaaatgctacttctcttggatagttatactgtgagaagttggtgacgggcaaaacgggagcccaggccagtgtcagaaactcacccagagtcgcagggacaaagctgttgtgtgggttcttccctgtgagaatcttaaggatggaaatggtgagcacaaaccttggcatttaaggaccgacaatgctgagatgttgtggtgggtccttgagtagggctcaagtgtccttccagggtggtggtcccagggaattgggccagaaacaaggccacccagtctcagctctgttgttcctggggggccctgtggctccaggagctcgtgaacatggcgaaccccacttccccatcccctttctgccttctcttctgttctcttgacagtctctgttttctacccactggggtcagcaaatcagccccttttaccggtttccacaaaaatccacaaaaagcactgtgaggacttggggatttcttgaagatttgggttgaggtatttcaggagggccttgcctcgcccctttccactccatcttcctctctgctccccacttctctggaataagaggtactgccctccttatttcagcgctgtcattctgatcactctaggaccggttgagactttttcgtgaacagtttcctacctttttaggcaaccatctgtaagacaaggtagaatgctaccataaccatgattaacatttgcaaacactctgccacagtgcagccactttctttgtctccagctgaagaaattgaggtgcacagaggttaaatttgatgctcaaagcaatacaactagaaaatataggaggctgggctgcctgattgattcccagcttagagattgaaagtcacatgcgaagcgctttagcagatagagaagggggagtcatactccagtgtgcattttagtttgtgcttttctgtccttgaattaagaagtgtgacgtgtgcctccaacagcatagcatgctacagaaatggatttcttttcctggggttgataatctgctggccaaatctttatctctgtagtatcctgtgtttcctggtgcattttagcatttggttaaattgtagggaaaagggtttgtgttctttatatctggattgtctattagatcacgtttttttgtgttgttatttgcgtctttttttttcctggaaggaagtgattggctgtaacagtttctctcccactccggtctctgaggaaggaaaaaaaaaataccttggtttcatatgaaattagactaatagaatttctaattatctgagttcattgagttgttgtcagtctgtgtttttttttttttttttttttttttttccgagacagggtcttgctctgtctctcaggctggagtataagtggtgcgatcatagctcactgcagcctcaacctccctgtgctcgggctcaggtgatcctcccacctcagcttcctgagtagctgggactataggcatgcaccaccatgcctggctaatttttgtttttgttttgtagaggcagggttttaccatgttgcacaggctgctttcaaactccctggctcatgcaatccacccacctcagcctcccaatgtgttgggattataggcgtgagccaccgccccttgcctctctgtctgggcttggtcctcctgggaacctctgccttgatcacccatctagaagaatggaggacctctgccgtttcagtcatccttttcacctgtaccagttggcccaggagaatcctggtttatatcccttatcacactgccactattaagctccccctttcactcctaagagtatcccaggttagatgatatgaccatgaatggagctgaagttcatattatacataatatgaagtatacataaggtatacgggccctctaaagccatggggcataagcacaaactgtgggcacagtgatgtaaatatttgctaaacttttatccaaagtaatgattggtaaaaacctggtagcatctccacttgagcagacatcttcagaaataacctgtaacctgtgctttatacataagaacaatggcatgcggcgttctctcctccgtccctgggttgaccgcggtggggtagggggtcagacttgccttctccagtggggcaagtccccttggtggtgactgtcctggctgttgttccaatctgagctagtttcttcataagtcaattgaaggtgcagtattaccctgcagggtggaccaaggaatgtgttagccatgcttgctgcctttctccaggacctgaagccccgccaccctctcctggggtccctttttctctcccttctgcgggacacgttttgtgatctctgcgcaaacagaggcaacacacttagtcattaaggatttttctgtaagtgcattagccttaggcttcagcacttgctgttctctttgcttggaacttgttgaccctgctcttgtcactgggggctttgtcctcctgggaaactctgccttgaccacccatctagagtaaacgcccccattcactaccatggctccctactttctttgtggattttttttttttttttgagaagtctcactcttgttgcctaggctggagtgcaatggcatggtcccagctcactgcaacctccacctcctgggttcaggcgatcctcctgcctcaggctcccaaataactgagattacaggcgcccgccaccatgcccggctaatttttgtatttttggtagagacaaggtttcaccatgttggccaggctggtctcgaactcctgaactcaggtgatccaccctccttggcctcccaaagtgcttggattataggtgtgagccactgtgcctggccttctgtgtggatcttactgttactctgaccccctctttttagtgtgattgcctttccctctcccctctcccttccccaatgtgaactctgtaaaaatgatcctaggtctagaacctataagagtgcctgttagtggtgggtgcttaagagttaatttgaattaatgaggttaataattcttgtttccctatagtcctgttgttgagattcctggttagaaaaaaaagtgagttgtgggttgtatactttgtttatttatttattgtatttatttatttttgagactgagtctcgctctgtcgcccagtctggagtgcagtggtgcgacttcggctaactccaacttttgcctcccggattcaagcgattctcctgcctcagcctcctaagtagctgggactacaggcgtgtgccaccacactcggttaatgtttgtgcttttagtagagacagagtttcaccatgttggccaggctggtctcggactcctggcctcaggtgatctgcctgccttggcttcccaaagtgttgggattacaggcgtgagccactgcggctggcccgtgggttgtatccttttttattaataaaggcatctctatatgctgtggtttgagaggggttgaaggctacttcccatgggaatgagtgaggaagagcctattgcactctggtgtctttgagggaaagagaggcgggtggctgccttctctgctcttgggttccacagctggggattgggaggttactcttttatcaattggttttttctttttttctttttttttttttgaggcagggtctcactctgtcgcctaggctagtgtgcagtggtatgatcacagcttattgcagcttcgttcactttttttttttttttttttggagatgggtcctgtactgtctcccaggctcgagtgcagtggtgagatcatggctcactgcagccttgacttcctgggcttaagtgatcctcccacttcagcctctggaatagctgggaccacaggcgtgttccaccatgcctagctaataaaacaatttttttgtagggactaggtcttgccatgttgcccaggctggtctcaaactcctgggcttgagcaatcctcctgccttggcccctcaaagcagtgagattataggcatgaaccattgtgctcagccctgagatttgttttaaaaagtgccctgagattcactatggagtattccctcttgatttatttcctaccaagtaagccctttaacagaccatgtatggcagctttttgaagaatgttttaggtctttctaaatatgcagctattcaggctaaggattggcatgtttgtaattgacctaatgattcaaagaatggactggttcagctggaattttcctaaaatctatcccattgacagagtattgcacaattagaaaagtgtatgatttataattagcgtacccactttaactctgaataacaggcataaaggttattatattttgaatcagtgttaacagttttagacagctgttctttgttacttgatttttttttttttttgagacagaaacttactctgtcacccaggctggagtgcagtacagagatttctgcccactgcagcctgtattttgaggcacagttgtttttgctcattagagtgctgctgagagagttgatttcctagttctagagtcaccgccaagagtcctaaacattttcctataagagagatggtaaggatggttacaaagaagtaggcctgatttggtgtagaaaattggtttcatgttcaaagccaacaaggggatgggggagttttggatcagacctttgattctggcgcagagccacaagggctttgtgtgttttgtttacagagcttaagcaatctcagttattagcttgcggataattaccagaaatgtgaacttaaatctgtgcttatttatttaactccttgccttttctcctaagaatgtagggtggtggcattataaaaattaaagaaaaagcaaggctccaccactttcatggtgattctactttacctgcagtaaaatcacagcatgatggccaaattgcccttcctctccaaacttcataccatttactataaaataatttggatcatagggtgatgtaggcctggggctgaagtctgtgtcagaatgttcctgtggaggtttatatgttaaaaattaaaatgaaaacctgttttattttattttttgagacggagtcttgctctgttgcccaggctggagtgcagtggcacaatctcggctcactgcaacctctgcctcccgggttcaagtgattatcctgcttcagcctcctgagtagctgggattacaggcacccaccaccacacctggctaatttttgtgtttttagtagagacagggttgtaccatgttggccaggctggtctcgaactcctgacgtcaagtgatccgcctgcctcggcctcccaaagtgctgggattacaggcataagccaccatgcctggcttattctatgttgttttttgtgatggtcagtgagatgtggccacaggaggaggcagaggaggtgctcaggaaggccaaggttattatactcacaggtcttagagacgggaagcatgtcatgccctgcagggccacatggggaagcatcagtcttggtcccccctgtaggagcctgaaggggcaggagtgaggggagagcctgggccatggtctttcttgagctttcagggacagggcaggggagtgcatgtgaacagtttagaattggctagtttgaataattttggcaggctgtaagctacaggcatggtttctagttgcttgttatcaggctctggcatgatataggtgaagaaatactgcttcctggggtggacaggctagataaagacggcatagctctgggttggttggtttgcatatcagagctgtgctcctggctgggcccttctggttctaagaactggccagctctgggaaggacagtctctccccagccagagaggtttccaaaacgtcaagacatcatagtatgcacaaagtaaaaaatataaacagtacaaaggccctgaacagggtcaccctgctgtatgagaaatctactggcctggctgaaggggaaagttgcttgggcagaacagtgaaaagctaaagcaggcttgttagttgtatgagtctgttttcacgctgctgataaagacatacctgagactgggcaatttacaaaagaagaggtttagtggacttacagttccatgtggctggggagacctcacaatcatgacagaaggcacggaggagaaagtcacgtggatggcagcaggcaaagagagagcttgtgcaggcaaactcttatttttaaaagcatcagatatcgcgtgaaccccggggggcggagcctgcagtgagcctagatcgcgccactgcattccagcctgggcaacagcaagactccgtctcaaaaaaaaaaaaaaaaaaacaaaccaaaaaaaaaacccatcagatctcgtgagacttatccactatcacaagaacagcacaggaaagacccgcccccatgattcaattatctcccattggatccctcccacaacatgtgggaactgtgggagctacaagatgagatttgggtggggacacagagccatatcagtagtgtaaacctggagccagcaggaagaggcatttgacagagcaggagggtccatggtgctcagtcaaagtcttaggacaaatagtccccatggaacagaaggcaatgcacctggccttgttgcgtttaattttaactttgctgtattttcaatgatctgctcctccagggaactggtggcacaccctgagtctgctaggtgggctaaagactcacaacctgagggaaggggccaggaaagaaaggaagccatggcctagagggtgttatttgggaccccacgcccatccaggccgacagagctgcggtaaggctgagcaaaacacactcgcacctgaacctcactctgacgttgtgggaggccctaccttgtcaaagctgaaagaaacgtcaggaaaagaaaatgcccccaaataattgtaacacatgtgctattggtttggcgactttggtaaaaggtttggaagtttcagggaacattccagataagcagggaccatcttcttcataaattgctctttgaattaggataaaaaaaatcaattgccatagataaaatttctgggatttttatgagcccaacctgttttccaggttaattatgcctaaatatctgtttgttttctttcttgtcatataaagtcattggggtcctgtagggggtgtgtgtgtgtgtgtatgattttgtgttaggtagcaggtgtttaggtttgtccagcacatgtttattttatttttttatttttttattttttgagacggagtctcgctctgtcacccaggctggagtgcaatggtgacatcttggctcactgcaacctctgcctcccgggttcaagcgattcccctgtctcagcctctcgagtagcggggattacaggcatgcaccaccacacctggctaatttttggatttttagtagagacagggtttcaccatgttggccaggctggtctcaaactcctgacctcaggtgatccacctgccttggcctcccaaagtgctgggattacaggcgtgagccaccgtgcccggccccacatgtttagtactagatgctaaaatcaatctgtggccttgtggagtttataatccactgaattaatttagattaattcacaggattaatttagatttcatgtttgaatatgaaatttgtggtcatttaaacagaaactgggctggaaagtacttttttctctgtctgtgaaaggtttttttagggcaaatgaacagtataaattagattgcttagagaatgttgtaaacacattttaccacagacactttatgtgcacaaagaggcttggcgtgttggctcacacctgtaatcccacactttgggaggccaagtggatcacctgaggtcaggagtttgagaccagcctggccaacgtggtgaaacgctatctctagtaaaaatacaaaaaattagccgggtgtgctggcgggtgcctgtaatcccagctactcaggaggctgaggcaggagaatcacttgaacctaggaggtggaggttgcagtgagccgagatcgtgccattgcaccccagcctgggcaacaagagcgaaagttcgtctcaaaaaaaaaaaaatatgtgcttaaagaacatgctggagcatttcctctgaggaagttatctcaggtactagagattaatcagcctgcacctctttgtgtatattcaataatttagattttttgtgagttcaaactggctttttcttaaagttggtggggagaggcatgtgatcagacttcttgggtggttaggagctttttggattgagtcccgtctgttttccaggctgttggctaatggtgattaaaggcccagggaatcctgcttgtctccttccagtttcgtgcagagctatgtcacgctgcgtgctctgtttctgttaggaccaatgtctgtttgttatataaatagaaaaggaacataaagctaaggaaccaagaaggttccattacagatcagtgtctcaacgtatccttgaggtttggtacaagttctccgcttcctgaaatttttggacaaacattgtgacattcataaataccggactgctaggatattgagggctgaggtaacgcaaatacttgctgtggttttatagagtaataatctgttaatcatagctgtggccttagagaataaacaacctctgtgtaggcttctttgtaagaatggcacagctgacggggacctctgcgaaccaaaggccagcgtgtgaccttcttatcctctgcttcctaggccagcagtgactgcctttggagatctcattgtttacagccctgtctctgactcagggtggcagattatgtttttggtagagcccagccagcccctatcacattgcacactaatgtaatccgtcggcagctgtctctgtattcattatttagctgcactaactggagttaatcatagatctgagctaaactttgttatgggtcaagagagaaaggccatctggctatttcttgggtcgtcttgggtgtatttttccactgcttatcatttgaccaccatctgttttttgagacggagtctggctctgtcccccaggctggagtgcagtggcgcgatctcggctcactgcaagctccgcctcccaggttcacgccattctcctgcctcagcctcccgagtagctgggactacaggcggctgccaccatgccaggctaattttttgtatttttagtagagatggagtttcaccatgttaaccaggatagtctcgatctcctgaccttataatcgtctcgcctcggcctcccaaagtgctgggattacaggcgtgagccaccgtgcccggcccatttggccaccatctatgaggcatctgaaagaagagaaactcatgcgtggtggctctgcctgtagcttccctactcagtgtggtttgcagacagtagcattgccatcatctggggctggggagaaacacaggttctcatgctctgtcccagacttagtatcagaatctctactagatctcatgcgtgggccctggccagccccctgttgtgtgcttggttgacgctgggctgctgctggtagacctccctttctcttctgtgccacagggtctcaccaaactgcaaaggaggtgggtaataaagtcaaaccctgtgccaggaatgatgggagaaggaagggtcagacccacaaatgggccaaggaatggattaggtgagctaagctgtggttgtagttcagcagtcactattacgcccaccttttcttattcctttcctatttttcttttctttctttttttttttttttttcacagcctggtaatgtggaatatttacttttcttaaatcactgtattaaaagatgaaaaaagtcattttttctcttccccttcccacagtcattgttgattagagaaaatactaacaaaatatattaatttaatttccaactacagataacaccaatattaatagttgggtgactgtccctcttttcatggagaaaacctaatgcctatcaaatgcccaacgttgaagagctatacaaatgtggattttctggtcgtcttcctccctcccttcctttatcctctcttatgacagaaaattacaaacatgtacaaaagtagagggaacagtaatgaacccctgaataccagtctgtcaacaatgatcaattcccagccaatcttaaccctccttctactcatttcctgccctagaagtgttactttttttggcacatctgatgagtgaagtgaagaatggtatttcattgctctgtttttcttttctctattcttttcttttcttgcaaaaccccacactgtcaccatgcatttgttatgtaattttcagatgtatctgtaggaaatggtcagtatacgattatatatacactgttaaattatccattgaaatcacattgtgtaccttctcactacattttttaacctttatgttataaagcagatacagaatattatacaaacaaatgtgtaacgtggataataaattataaggttaacatcctggtaagtagcaaccagatcaagaaataagattttgctggtccctgttctgtgtcctgtctcaattccaggctcctcccttccctcagaaagaactgaaagtcaacttcaaactctttgtggtctgtattacttttaaatcttgatcaatgttgtgtgtatatatatatatatatatatatattttttttttgagatggagtctcgctgtgtcacccaggctggagtgcagtggcgcagtctcagctcactgcagcctccacctcctgtgttcaagcagtcctcctgcctcagccaccagactagcaggtgagctgcttgtgctgctgacaggttgtaggctctgtatttggaagatttaggtatggcaaatcagggtggcccagcccaccctgacttctagtcaaccagctacaaattctatgcttcccatgacccccttgggttcaataatctgctagaatgactcacagaactcaggaaagtgctacacttacaattacagttttactacagcaaatggctgccaattggaaccaaagggagagtcccaaatacaaagctttcttgtcccatctccagggagttgagacctgtcacttcctagcctattagtgaaggggtggccttcccctccacacctgtgggtgtttctcatcgggtgggacgagagactgagaaaagaaagagacacagagacaaagtatagagaaagaaaagtgggcccaggggaccgccgctcagaatacggagaacccgcgccaggacccgcgccccaggcaccggtctctgagttccctcagtatttattgatcattatttctcggagagggggatgtggcaggacaatagggtaatagtggggagagggtcagcaggaaaacatgtgaacaaatgtctctgtgtcataaacaaggttaagaaaaaggtgctgtgtgctttgatgtgcacatacataaacatctcaatgcattaaacagcagtactgccgccagcatgtctcacctctagccctaaggtggttttctcctatctcagtagatggaatatacaattgggttttacactgagacgttccattgccaagggccaagggacgagcaggagacagatgccttcctcttatctcaactgcaaagaggccttcctcttttactaatcctcctcagcacagaccctttagggtgttgggcaggggtacggtcaggtctttcccttcccacgaggccatattgtagactatcacatgggagaaaccttggacaatacctggctttcctaggcagaggtccctgcagccttcgcactgttttgtgtccctgggtacttgagattagggagtggtgatgacttttaagaagcacgctgtcttcaagcatttgtttagcaaagcacatcctgcatagccttaaattcattaaatcatgagtcaacacagcacatgtctctgcgagcacagggttgggggtagggttacagattaacagcatctcaaggcagaagaatttttcttagtgcagaacaaattggagtctcttaggtcttcttctttctacacagacacagtaacagtctgatctctctttcttctccccacatagtagtgtctgacaatgcccagagtattgccagccaggaaatctcatccaggttttggtgtctggagtttttattggagcttcattacatcggcacgattgacgggctcattggctgtgggattgatctcagtctccagtaccccctgccctggaggttgggcaatagcagttggctccaagcccagccctctcatcacaggattggtctttgtgatatgcacagcccccatcctgagtcatctgttagcatcagctgctagggacccactatgttatattatgtccctgataatttatgttagtgtaaaccatcagggaccacacttctattacttggagcattccaaggatttagaagaaccagggataaaacccagccaaattctttattatatgacttccttcccctccactccttactcttcatttctctggccctgtttactttgaccacccagccccttgtcaccatgcctgtagagctttgcagaagacaagtcaggggagctggtgtattagtccattttcacactgctgataaagacatacctgagactgggcagtgtacaaaagaaagaggtttaatggacagttccatgtggctggggaggcctcacaatcctggcagaagggaaagacacatctcacatggtggcagacaagagaacttgtgtagggaaactccactttataaaaccagcagatctcgtgagacctattcactatcatgggaatagcatgggaaagaactgcctccatgattcagttgcctcccaccgaggccctctcacaacacgggggaactgtgggagctacaattcaagatgagatttgatggccaggcgcaatggctcacacctgtagtcccagcactttgggaggccgaggtgggtggatcacttgaggtcaggagtttgagaccagcctttccaacataacatggtgaaaccccatctctactaaaaatacaaaacaaattagctgggcatggtggcaggtacctgcctgtaatcccagctacttgggaggctgaggcaggagaatcacttgaacctgggaggtggaggttgcagtgagctgagatggcaccattgcattccagcctgggcgaaactccgtctcaaaaaaaaaaaaaaaagatgagatttgagtggagacagagcgaaactccatctcaaaaaaaaaaaaaagagatttgagtagggacacaaccaaaccatatcagctggtaatgcagtgcacagaaacaggagagagcccaggggccaatgctacccaggcacctcaccaaagggataatgccccatttactaatgggggaagatggcctggctggctcccgagagcctgtcgcttgttggtgcgagggctctgaactctgctgtctggactagtctcagccctgtcacatgcaaactgcgtgccccaggacagctacatgtctgccatatgcctgagttttcccatccttagggaatggtgataacagcactgtatgagtttgctgaggctgccataacaaattcctacatacttggtggtttaagacaatagacatttattctcttaagttcaggaggccagaaggtaaaaaatccaggctgtgttcccttggtatggtggggacaatattccttgcctcttccagcttctggtggctgccggccgtccttagtgtccttggcttgtggctgcatcacttgagtctctacctgtgtttacatctccttctcttctcttctgtctgtcccaggtctcccccgcctctttcttggaaggacacttgccattggatttaggacccacttggataatccaggatgatgtcttcactccaacatcctcagtttaattccatgtgcaaatacccttttcccaaataacattcaattctttaccaggaaaggtaatactcacaggtactgggggtcaggacttgggcatatctttttggggccaccattaaacccccttcaggagcctacttcacaggattgtgaggattgcgttaaaatgcttgaaccagtgcctggcacacactaagtgctgttagtgctggcgactgggggggacagatacagcccgaccttttgtgtaatcttggccccttatttccccccattttagtctttcccccttcacagttatctaagtctgccttgggtaagcatatttaattttcatgctaagacatattttcaatctgtacggaagccatgcacttgcctctccttcagagctgggattttttttcattttgctggctgtgagcacacacacgcccacaggtgcctaagcctcttgtatgtgtgttttgaactgtgtcctctgagttctgtgtctgggtgcatgctctcctcttagcgtgggtctccttcccctgtgtagcacttcacaatgttaggcatttgtctgtgatagcagctgttcagtaatttcctacttgcccaaattcctggactcaagcagtcctcgagcctcagcctcccaaagtgttgggattacaggcatgagccactgtacctggctaatttcatgttttaccttgttaaccttttatttttatacttttaatctttttttttttcttattgtgtcatgcttttaaaccagtactctagagttttaatcattgtctttgaaatactttaacatctggtagtgtcttttaactttttattttgaaataattcaacctgacagaaaagttgcaagagtggtgcatacataccactcctgtatatccttcatccagattccctcctgttagcttctaccatagttgtcaatgtctctttctctgtttatattattcctttgttatctgaactacttgaaagtggattgtagtctggatgtggttgttcccacctgtaatcttagcactttgggaggctgaggtgagtggatcacctgaggtcaggagttcgagaccagcctggccaacatggcaaaaccccatctctgctaaaaatacaaaaattagtcaggtgtggtggtgcacacctgtagtcccagctactcaggaggctgaggcaggagaatcgcttgaacccaggaagcggaagttgcagtgagctgagatcacaccacttcactccagtttgagagaaagagcaaaactctgtctcaaaaaaaaaaaaaaaaaaaaaagtggattgtagatctgaggccccttatacctaaattttagtgcatgtttcttaaataaaaaggcactttccatcatagttatagaacacccaacaaaattcagaaatttatcttcaaactccataaccagtttccctatattaattttttgggcccaggatcctataatgtatttagcgctcatatttctttagtatccttcagcctcgaacacttctgcagtcttttattgtctctcatgtccttgatagtttgaaaaatattcaggtcatcacattctagaatattcttcaaagacacaaaaaaatgtgatgtgacttcatagcagaaataccataaaaataaatacagtatcctcagtgcattgtatccggaggcacacagtggtgatggtaactgttatcactctgttaaggtcttgtctgccacgtttccctgttctaaagttgattatgcaatactttatgcttttaggtaagtgttttatggggagataattggaggctatgaaaatatcttgcttctcatgaaacttttacccactgattttagcaaccgtggatggcttttcaataactgaatcacttattactgtggaagttgccaaatgatgatttttttttttctgattctattgttaattctgttcttaattggttggcattctacagtaagaaatattctgttttccccatttattcactcatttatttatagcactatggacttatgaataattttatttattagatttgaatccattacacttatgatttattttggtgctcagattgtcccaggtttggccagtgggagctcctgggtcctttggacatgttgtcgggattctttgaacatttcattacttttgtggcacaaaaagatagttcagacatgtcttgtacttcttctgccccgatcttggattcagccatttctcaaaagagcctctgcattaaaaagaaaagttacatattctttttcataagtggatactatatttagaaagagtgctgggtactatgcattttttttttttcttttttgagacagagtctctgttacccaggctgaagtacagtggcacgatctcggctcactgtaacctctgcttcctgggttcaagtgattctcctgcctcagtctcacaagtagctaggattacaggtgcatgccaccatgctgggctaatttttgtatttttagtagagacggggtttcaccatgttggccaggctggtcttgaactcctgacctcaggtgattcacccaccttggcctcccaaagtgttgggattacaggcgtgagccactgtgcccggcctaggcatatttattgttatgggatctcattgcttctaggaactctaagcggacaaagctagaatgtatttgcatacacagatcaacacatattatttatatatttgtgtgtatgtgtatatatatacacacacatatacatatacagttggttcttgttactagtggagctctataaagtctccacaaacacaggactagtgaatactgaaccattgcttccaggcgaaatacagggttaggttcctatgcgcctttggtcacatttttgtcagccatttaatatataaccttgttttatgcatgtgtctgcttagagacaccttttttaatatataattaatcattaaccttgaattaacagccagcagcactatagttcatgcctgaaggaagcttctgtaacacacgtttttttctgtagggcacattacacccgccttgcgctttgatgcactagactgcacttgagcatgatgcttggggccactttagacagcgaagtcacccacaaaagtccccaaaatgtgaagaacatggtactgaacagcccacaagaaggacagttgtttctactctaagagcgggaataagaaggcagagtgtcagctgggcgtggtagctcacacctgtaaatccagcactttgggaggccaaggtggctggattgcttgaggtcagcagttcgagaccagcctggccaacatggtgaaacctcgtctctactaaaaatacaaaaaaattagccgggcatggtggcgtgtgcctgtaatcccagctactcaggaggctgaagcaggagaatcgcttgaacccaggaagcggaggttgtggtgagccgagatcgcaccacagcactccagcctgggcaacagagtgagactccgtcttgggaaaaaaaaaaaaaaaagtctaagtgtcatttcgtttgacttcagctgggagcatgcatgttgggtgactcaaatattttgctactctgtgcatgtccgtgaaggactgcaagacacctggaggactgatttttggggttacaatttagcaagtaggcaaactcacaaatacaggatttgtcactaaagaggatcagtgtatattgatttctctatctttatttaggtatctatttatatagatctgtattaggaaacaaattagatagacttcacaccagtgcttcaaatcacagttcaaaaatctcatgctttgttctggttctccctctttccatatttgtatcttcatccttcagtagtgagaaacttgactcctgctgtcctcaacacgttgacttctttgctcagtcctcttgtttgtcaccagggccccagccacgtgggccatctccttgcagagagtgttcctgggacctggtgtgcggggccccagggctgtgctcccaggctgctgcttgtgaacttgctgagagctgccccccaggcatgttgccctaggctggcctcccaacctagtggatacttttgatcattgttcactgtaacctcaagcccctgggctcaagcattcctcctacctcagcctccagagtggctaggactacaggtgtgtgccactgtgcccagccaattaaatttttttttttttgtgtggagagaaggtctcactatgttgcccaggctggtctcgaacatttgggctcaagagatccccctgcctcagcctcccaaagcgctggtattataggcatgagccaccatgcctggcttgaagttaatttcttattaacgttttcagtatcattagaatatagtaatgcagtagatttttgactgtttattggtattgtacatcttgcacctctaatgtgctagcttactgtcttcagtcaatgtaggattggagttctaattgtgtaaaactctgtatataaggtttattacttttttttgtgtttttttcttcttcaatagccatgtcaccattaatactagtaaatggataagccattcctttctaatatcttgttttaatgacaatgaatttaagatatgttttgtggataagaagagctgctcatagatacagctttttatgttactgctatgctagttctaggtaatttcttttttttgatagggagtcttgctctgtcgcccagggtggagttgcagtggtgtgattttggctcactgcaacatctgcctcttgggttcaagtgattcttccgccttagcttcctgagtagctgggattacaggcacgcaccaccacgcccagctaatttttgtatttttagtagagacggggtttcgctattttggtcaaggctggtcttgaactcttgacctcaggtgatttgcccacctcggcctcccaaagtgctgggattacaggcgtgagccactgggcctgggaattctaggtaatttcagagtaaaaaatttgatttagagttgcttcttccttttctatgaaataggacatttacaaaattgtttttgaaaagatgacttgggttgcgatgtttttcttgttttgagatcctagagtaaatgagaaataggatgtggaattttaaactgacttcttgtgcatctgcttatttttgtggtagagtcacagagttacgaccaagcaggggaggtgagaattgtgcagactggggatattgggagggtgaagggatctagtttgcttgaataaaaggatgcaagtcactgtattggtgaagtttctttcaaatccaattcctgactgatttccttgccttccacagttcatcatatacaaagtagcttaaaaacattcacaatttccctgttatctttaggataaagtccaactttctgagtttagaacacaagacctttgattaccccattatcaccccagaccccatgcagcattttctctgctgtctccaagcaataagtcttggctgtgtggctccatttttctggaaaatttgtcccttcttcctcctttgtcttcttggtaaactccaaattcttttcctaaagtttgctcaaactgtgtccctttctccaaaccctctccaacttcccaggtacctgactataccctctttcttctctctaccgtacagatggttcccagacctggctgataaccaggatgtgctgggtgaggggagctttttaaggaccgccacttgggtttcatcttggcttgttctgattcagtcatttaggttgcggttctaggtgtctgtgggtttttgttttaaaattccccaggcataattgggtaacatattgaagtttaccgaaaaacaaaacaagaaactccccagtaaaactccccaggctgaggtagggattttgctaatgagccagggttgggttgggagtattggcgtatatgtcagacaagtgcttcccatttggtgtgtcaaagcaagctgtatggcacgttctcaaacctgaacctgcatccgcatcacctggagaacatcagaagatacagattgcagggccccactctcagagttcctgattcatagacctggagtgggtcctgagaatttgcatttctaactcttcaggggattctggtgctgctggtccagagatcacactttgagaaactctgctgtacagaagatgagtctcgtgagctgggatgttgatcccttagaaagcccagaagtagagtctgtgcatagcctgtgtccacatgtgtcccatcttttttttttttttttccccacactacacagatgtaacatgtcccatcttactgtaattctttgttaacatagatgccttgaactcttggagtggaattgaaccggtggatttactaatgggtttatatcatttgctaacgtggctaaaagactgctgtcattgtcttgcaacttctgtctgaggtcaacatttgatttaagattctatagcctgtccagaaaggctgtaaaaaactttagtgcggtggttctgatccatgtgattttgccaccctggcaatgcctcagataattttagttgtcaggacttgggatggggatgctgttggcttcttgagggtggggttcagggatgctgttaaccatcctacagtgcacgggacgacacccccaacaaagagtttttcagctccaaatgccagtagtgctgaggctgagaaaccttgccttaggggaaggcgtttctttttttcttccttttttttttttttgagacggagtttcactcttgttgcccaggctggagtacaatggcgtgatctcagctcaccgcaacctccacttccctggttcaagcgattctcctgcttcagcctcctgagtagctgggattacaggcatgtgccaccacgcctggctaaatttttagtagagataggatttctccatgttcgtcaggctggtctcaaactcctgacctcaggtgatccacctgcctcagcctcctaaagtgccgggattacaggcgtgagccaccatgcccagccgggggaaggcatttctaatgaggtagagtgggttttcctgtgagatctgtcattgtgtctccctgcacccagctcctgctctccagagtccctgactctgagcagcctacctccttctccaccctgccccaatgtagcccccaggccgggcccagcagcctcccgcaggcagggctggcagactcttcaaggaaaactaaccaatgattaataatttgccacacctgaaagtactttacaatgcactattctttcaataataaatgatttattgagtgaggctagagcatctgttcaatcatttactgacctcaagtgacctgcacattccccttctcctgcaggcgcttaaagagggttgctgggccccagatgtgggtgttctctgctgctgctcttcagcctgggtggagagtcactcactcgttcaccccgcagttttgagtggctcgcctggtccctggcccagtgaacaccataaaaaaatcctgccctcagagagcttttgttctagaggggaaagtgacaaagtaattaagtgcatttttttgtatctacacaaatagattgtagtaaatgggtaaagaaagtgagaatgaggatataaatgatcgacaatgagggtatgtttggttttttgtacacaagggtaggactttctggggattgagacctgcaggagagaagatctaatcatgggagaagatggggaaaagcatttgctcgcacgcaaggggacaaacgggaatgtgggagactgtcagaaacacatcaggccagggtggctggaacactgaacgaaggggacccagtcaagcacagcaccccaccatgagtttcattgtttttctactgcaggagagcagcatggcatgatatttttaagaatccactctggcttttctattgaaagatcacagggaaaccaagggtgaaggtgggtaggccagctagcaggctgttggggtcctgaaaattcatggtgccttgggccacagtgatggaggcaaaggtgtagagagaaagggttcttgttgggacaaatgggatctggttcttgttgggacaaatgcacctggaaaggcatgttggcgctcctgcaggcatgtgtgggctcacataagtgaggcttatgtgtggggcatggctgtgcgctgagttacgtgacacatgtcttaaattaaagacactcatatttatttcccagggacagataaactttgagcaatctgggaaagcatcaagataactgactaaattctatcagttgtttagccttgagaagtgtgaattacatgttcacatgcatgtaattcagcttccagagcaattctttgaccccagtgaagcacagttgacccttgaacaacaagggtttgaactgcaagagtccacttatgtgcagattttctttttttttctttttctttctttttttttttgagatgaagtctcactctgttgcccaggcaggagtgcaatggcatgatcttggctcactgcaacctctgcctcctgggttcaagcgattgtcctgtctcagcctcctgagtagctgggatgtgcaccgccatgtccggctaatttttctgtatttttatagagacagggtttcaccattgttggccaggctggtcttgaactcctgaccccaagtgatccacccgcctcggcctcccaaagtgctgggattacaggcgtgtgctgcgcccggcctacgtgcagattttcttcagcctcttccacctctgagacagcaaggccaatccctcatcttcctcttcctcttcagcctattcaatgtgaagatgatgaggatgaaaacctttgatgatccacttccatgtgtatcttctcctcaatgattttccacaatgattgtcttaatggcggtttcctttctctagcttactttattgtgagaatgtagtatataatacatagagcatacaaaatatgtgttcatcaactttatgttactggtaaggcttccagccaacagtaggctattactagttaaggttttggggagtcaaaaattaatatgtggttttttggttgcacagggggttggcaccccaatccctgcattgttcaaggatcaattgtatattattctctgtgcttcttggtgcgcaaacttaaatgagtagcttcagatgctcgctttgttaaggagtcttattccttagtctggcaagtgcttatttgagcttggaagcaagagagaactatgtcatctcttatgagagatgaagtttaatcgtttggaagaaagcgcttgatttgaacaggcactaattaatgtccagattttttttttgatttttcttttttctttttttttgagacagggtctcactctgtcacccaggctggagggcaatgagacgatcacgtctcactgcagccttgacttcccaggctcaggtgattctcccacctcagtctcctgagtagctgggactacaggtgcctgccaccacacctggccagttttttgtatgtttttgtcgagacagggttttgccatgttgtccaggctggtgtcaaactactgggctcaagcaatcttcctgcctcagactcccaaggtgttgggattacaggcgtgagccacagtccccggccaatggcctgattttcagaggatagtcaacatcatacactgatgggctcagaaggatcttggcaacaatgagccctgcatctagcaggtggccacacgggccttgctgactatatagtatggcatctctggctagtcgtcagatccttcacttgctagttgcaatgaacaatgctttcatctccttatgagtcagccgcataacttgggctgcagaaataattaatatcctactcacttagccgggcatgatggcatgcacctccagtctcagctatgcgagagggttgcttgagcccaggagtttcaatgagctatgattatgccgctgcaccccagcctgagtgacaaagtgagaacctgtctcttaaaaaaaaatcttactcacatttcttcattttattctgttactaaattgtgtacaaatatgccaagtgcatctttttttaaggaagaagactaagatggctaatcatgcacaatggctgtagatgcttggtactggttgtcgtgtgggaaagtgctgggaagatgggattataaagtgagggccctgtgaagaagtgaaaggcatggattagctggtgggagaacagggagacaagaaggctgtggatgaaccagagaaggctttgaagctccgtagtaggaaatctctgaggtgcctatggcatggaaggacccatgttgaacccagagtgcaggtgtggaggggggttgggggacccggaagagaggtggacagggtccacattgcctgttgcttaggttgacatagaaacaacaggtagtagagtgaagcgggaagggatgagaaaatgggctttgagcgtgttttaggaagggaggaacgttagaggaaaaataacagaagatcacagctttacaggtgccacctgagtttaatttacttggtcatgggccgagataagctgggttgggaccatgttgagaacacctgtggtgtgggtgctctaccctcacgcgagatccattccagcgatgcctgtgtctggtgatcgttgaactttagtgtctggtgatcgttgaactttagggcatggagaatggctattttggactacagagaatgggaggagattgaagaaatcaggtgtgtcgggctccccttggagccaggccatgggaaactttgtaaggacagaggccctggtgaactttggaaggattttgttttcttttaggcattcaggttttggggtctgagcagaattgctggagtgttacacgagaagtgtgctggcggtgggctacaccattccttcctccccagcactcagtcacttacctacgagaaaatgcacatttgcactggtgtgtgtccttgcaccctctttctgaaacccatttgcagaatccaggcctttaggaaacttttgctattgcagacttacttatatctgtaaattatttaatatttatatttgtaactgagaagttgatatcatggactcgtaatggattttggagtttaaatatgttaaaataggtaatttttacaggatgtgttcattcacgtgacaaatctgggtgacttctatgtgcccagcatgttgtaggtgtgggtggcttagcagcaaacaacacagaaaaaccccatccttgtggagcctagatgcctccaggggaaaacatgatttcaaaaaagtgaaatataatagcccttctaatgttgacaggtgctgagtagaaaatttaagcttgggcaggggcagagggtgagccttatagggtcaatgtgactgtttctggatatactttgcatgttgaagtaataggacttggatggcttagatgtgtcctatcaaagagtgacaaagaagggatgggctgcagagtcacctgaaggttttcttttctttggaaaatctgggcaaggggaaagatgtgacggctgataactgagagggagaagcctgggaggagcaggatttttttgtgggatgaaaaggtgttctgtttggacattatttagtttgatatgcttatcagacacccaagaggaggaggtgttgaatcagcagttggttatgagtcaggggtattgtatgtgcccttaggcactagcaatgttttttgtgtttttttttaagcaaaattatgaccatcatttcagaaaactattttatatatataaagaggttgaaagcttattaagactagatttagaaaaaacatataatactctgagaaattctgtgtgtagtgtcaggtagaaagtaaagtgttaccagttctgtttataaaaccccctttaggccaggcgcagtggctcatgcctataatcccaacactttgggaggccaaggtggggggattacttgaggccaggagtttgagaccagcctgggcaatataatgagactctatctttacaaaaatatacttaaaaaaatagccgggcatggtagcacgtgccttgttatcccagctacttgggaggttgaggtgagaggaccgcttgggcctgggaggttgaggctgtagtgaggtatgattgcgccactgcactccagcctgggtaagagagtgagaccctgtctcaaaaaaaagagaaaaatccactttatacaaaaatttgcatgagagtattgcccacatttgaaggaacacttaaccttccatgtattatgtttatatggagacttgtctctgaagatggattttggagtttatattaaatttgtttttgtttctgtgttgttttttttttgatggggtctcgctctgtcgcccaggctggagtgcagtgtgcagtctcggctcactgcaacctctgcctcctgggtttaagcgattctcctacctcagcctcccgagtagctgggattacgggtgtcctccaccacgcccggctaatttttgtatttttagtagaggcggggtttcatcatgctggccaggctggtctcgaactcctgacctcaagtaatccacctgtctcggcctcccaaagtgctgggattacaggcatgagccatcatgccaggccaaatttggggatttttggaggatgtgctcattcatgtgacaaatctaggtgccttctatgtgcccagcatgttgttggcttagcagcaaacaacacagaaaaacccagatgctctggggggaaaacatgatttttaaaaaaagtgaaatgcaatagcctttcaaatggcgacagatgctacagagaaaatttaagcgtaggtaaaggcagagggtgagccccatgggagggtcagtgtgcaaaatggaaactcagcatcatttcttcaatggagctgttttggagaaagcccggggcagtcatggttggccgtgcactaacctttctatcgtggaggcgtggggaggggagaggcattctcaggtgttttccttagaaacacaggaaggtgaggaagaacagtggaaactgaatgaggaataaaaggcattcagatttaaagataccaagattagaagttcagagtctagggtggtcaccagacagcagatactgtttaaaataagtgttgaattcctggcaccagaattctagtcctttactattttgtggcttccaaatagagaaagttcatggaaggaaacataaaggtcatctagttaaagtcctgtgtatctatttcactctctttatagatgtacagtagtccccccagtccgaggaggcaggggaactaccctcattgaagaccctcacctcagtggctgcctaaagccgtggatagtgctgaaccctactgattttttttcctacttacacatatctttgttggtttgtttgttttgtttttgagacagtctcgctctgtcacctaggctggagtgcaaaggtgcgatctcagctcactgcaacttctgcctcccagtttcaagcaattctcctgcctcagcctcccaaatagctgggatcacaggtgcctgccaccacgcctgggtaatttttgtattttagtagagatgggttttcaccatgctggccagtctggttttgaactgctgacctcaggcaatccacctgcctcggcctcccaaagtgctaggattacaggtgtgagccaccacacctggccctacttacacatatctatggtaaagtttaatattataaattgagcacagtaagagattaacaatgataataaaatagaataattacaacaatatactcttcaccatttcgttgatagaaggttcactcttaaaccagatctcagcaacctcagcatacaatttttttttccttttcttattggcttgagaaccttaaccttttcacataaaggaaggcctttgtggcttctccttggcatatccaaatggctagcatccttgtacttgctctttgggggccattattaagtaaaataagggtgacttgaacaccagtattgtgatgccatgacaatagatctgagcgcccagggtggctactaaatgactaaaggtgggtgacgtctgtagcatggaaatgctggacagagggaggattcccatcctgggtgggtttgtgggagatttcatcatgctactcagaatagtatgcaatttaagccataggaattatttctggaatttcccatttaatcttttcagtcaactgtgggtaactcaacctgtggaaagcgaaactgtggatatggggggatgactgtatagcatcgagagacacaagtgaactccttcagtagcctgccacaggggatttcattcaacctgcccttagccttccttgttctctaaactctcagcttagctcacagctttgctgtctgcaggtctgagcacaaacctgccttctcgcttacctcctggatcccgtgattccaggcctaagttcaggaggtatacagcagagaggaccttccctccctagtctcttcttttagtattgtttatttctaataaagttgggggaaacttttcttctttgatagactataattttagggttatgcaaatgcataatccattgaaaaaggttttattaggcttggcttctgaagaatataaaattttgaacttgtccattaaagagagaacaatcttgattcaatgagtatcaagtaatgaaataattattttagttccatcatggccagttgttacagaaaggtcaggaaagaggaggagaagagaaatagaaagggcctttaaggaggcagagagggctaaaagagagctgaaaggggacaaaaggagagagggaaagagaaagtgaggggatttaccaaagataagttagcttttatttcctcctttacttgtggctatggggaacatgaagctcatagaaactgaagactcaggtcagggtcacagagacagggagctgggacctgtgttttccctcttataccacattaagaaaccactattggccaagcttggtggctcatgcctgtaatcccagaattttgggaggccaaagtgggaggatcacttgagcccaggagttcgataccagcctgggcaacatagagagacctggtctctatcaaaaataaaaatattagccaggcacagtggcatgtgcctgtactcctagctacttgggaggtagaggtgggaggattgcttgaattcagaagtttgagactgctgagctctgatcggatctgagtgagctctgatcgctccactgtactccatccagcctgggcaacagagtgagactccatctcaaaaaaaaaaaaaaaaaaaaaaaaagaaaccagtattcagaacttctcaaatccttgggggaaaaaacaacaaaaactaaatgccaccaccaccaacaataaataacaaaactctctactaacccttgtctaagactcctgcttgctggaaatgatgctgggggttgtgatcctggggtggagaatgtctctgtattgctgaagctgatggcttcctgtgttgggcattgagcacgactatgctatattgagtttgtattgaattttaccctagatcattgctcaaggtactctacccatctgtcttattcaataatacaatcattcattctttccataactgtttattgagtatctatcacataccaggcataatggggattccaaataatatggcagtagtcattgccctgaaagcattgtactcctagtaggacagttaggagggaagcgatgctgctgtactaagtattgtgggagataagggggagaagagactaagtctgaggagagaagggctactggggcagaactgggtggaggaatggctcatttggcagtggtctggaattgttgactagaccccctcagggacacattggtattaaggagccaactgacttagatttccatgtataaagtccttacatagatggtcaaagataatttagtctcttgtcaaagttgacttttgtcatcaggcaaaagcctttagctcttgctggtacccacatcttttcagcccagctttttgagatctgggcaatgagagagagtaggagggtccttgttaagtccttactgatttgtgtcatcctctaatagaagctttgggtctcttctgattgcagatactttaactcaacagtggcatccctccttgttaatatttctaaatgttatgcagttaactgttcagcctgtggaacagagttaccattctcactttccttaattttttaacttcctggagccagttttattccctgattaaaaaaacctctttagtccaaaaagacaccagtgaattttacttagaagtccttgctgaaatatactgtatgaggttctgctggaagggaggtctcgggcatgcagaggtcatctcaggcatgtctgggaaacccacctaagttgaagctggactggttaggttacagtcttctggacacattttggaggaggtgaggagaaagaggtgagttgatgagttcttcttgccattgggttaattagaattgctagtttggatcagcaggaggtttccggaatcctgaacataacttggatacccctgcagtgtgtgctccaatcttacggggcattgaaagcccaccatttcactgcaggcagaagccaccaggcagtgggttccccatgggaagggcttcctagattagacaatccccatgttaaaataaaacatgcctattaaaggtgacacatggccagataagacagccaagatgaaagaagtttgtgtaattgagtaattgcatctatcaaagttattagaggtttccttatagggcacaaatatgtttcttcttcttttttttttttttagacaaagccttgctgttctgctcaggctggtgtgcagtggcgatcacagctcactgcagccttgacctcctgagctcagtccatcctcccacctcagcctctggaatagctgggatcacaggcttacaccagtacatctggctaaattttaattattatttatattttttattgttttgagatagtctcactctgttgcccagactggagtgcagtggcatcgatctcagctcactgcaacctctgcctcccaggctcaagtgattcttgtgccgcagcttcccgagtagctgggattacaggcatgtgtcatcacacctcgctaatttttatattttcttactagagatggggttttgccgggctggtctcgagcttctggcctcaagtgatccgcctacctcagccacctaaagtgctggggttacaggcatgagccactgcccagcctttttctttataagtttttagtagaagtgggcatctcactatgttgtgtaggctggtctcaaactcctgggctcaagccattctccctcctcagcctcccaaagctctggagttacaggtgtgagccactatgcctggtgcatgttaattattatcatttaatgattaatgatgttaattattatcatttaatgattaataatgttaatatcatttaagtgattcctaatggatgaccattttgatttttctttttttttagtaaaaagaatctcaaaatatttgaataagttctttctgtcctctgcaagattactattttgtcctttcgtaactaataaataatttgtacctagataattttggattatgtaaatgtcccatcaaaccttcactgactggttttagctcccattgaaaatgttttctaacctcatcattctttatctgagagtttttccttcttaccccatttatgtctcagtaaggattcgtggattcttttgttattcagtgggttagaattcattgctgtcatgatttatttggatgcttccattatcacagacttgtctagtgggaccccgtcaagctgggtcctctgttctttgggcccatcctcttgattccttgaatgtttccttatcgtatggtatctcatgggccatctttttctgccccagcctttgaatcagctatttcttcaggaagctctggttccttttagataataatggttttggaaaccaagatctgggcaccagcatgctctcagctactggtgtgtcattgcttctggggcctgtctgtggatagagctagggactgtgtgtgtgtgtgtgtgtgtgcacatgttaacttttctctctctagctctatatattcatatctgtctgtctatatatagctgtatgtattttaaaggtaagtttaagcaaaacccatggaggtaggagtctacttaaacacggatgtgtaattctggatatatgtctcttttctcttgttaacaggtggctcaatcccttgtttaaaattggccataaacggagattagaggaagatgatatgtattcagtgctgccagaagaccgctcacagcaccttggagaggagttgcaagggtaagtcggaggcagtaaagtgggcattaaggaagcgtgggtgtctgtgtgtggggagtgggttttgccttcctgggtcctgtctggagcctccgtttacccttaaggtgaatatgtgtcaccttcctcaggctgcccctaggctcagcctaccatggtggcctgggggaaactcctgttgcctgtgcctccgtagaggtcaggggagccagcaccaaaggcccgagatgcctgaggtctgtccctctaggtggaagtgttgtggttggaggaggttgtctggcttatctgtgctactgatggggcttcaatccagtaaagcttggcagtaacttgtttccccagacttcccctcaaggcctgtttttctgatgctccagattctgtaccacacataaccttcaggagccctgggagcaattagtagcatttatgaaatcgtcacaaaatgccctgtcttaaatgcatacctgtcactctgccatctcccctgttttatattgtggcagggttcactcttatttacgaagctttttcctcattgtaggttctgggataaagaagttttaagagctgagaatgacgcacagaagccttctttaacaagagcaatcataaagtgttactggaaatcttatttagttttgggaatttttacgttaattgaggtaaaagcttttacataccatgaattgtttttcaggacacatagagtaaatgtgctcgccattgactggtgctgtaatggatgggggaacagaagggagaagtggccagatggggtttgaaggtattttaaggtctaaggattaaacatgtctaggaagtattaggtagttagttcagtgagcgtatttatccaggtgaatacttaagtgactgaagttcaaggtcattattgtttttcttgtaaccaattaaaatgcagtgtcatggaagaagagtattttattctatggtaggacaatgttggtgctcggtaaatgttttaaatgctaagagtcactcctggtcaaaagaggatcctacagccttgaggagtgcgtgccctgtggtttagaggaagtgattttggatcggagcccagaataatgtaagacattttacaggtgctcaacaaataattgttcaccaagccaaatctgataattgctcttctggagaggtattgtcacctctcccctctcggggaaacagagctgagggccttgcacctgggctggcggtggtgccccagaggctggagctggctgaagcacccaagagctaccccctcccagtgggcccaggtgctgggagccaaaatcccctctgggaagaaggtccgaggactgtgcacccaaggggattcatcacacccatccggtgtgtcttccttgttgtcggagtggattgctggttggaaggtagagtcttggtgcctggccctgcagagaatgtataaatggacattccatgaaaaatcaaagacagccagaagggcaataacctctgttaccccgaagggcctctcttgagatctgcagaaagacagtgttctgcctaggcacactgccaggtagcttgtccgttctggtctttggcctgctagaggagatgcagagggtcctgctgggtgacttgtgtcctctgtgctaccttagggatgtcagtggtccattaaagttagaggggtggatgttgctgttgttacaaaagggtggctttaaatgcaggatggggagttgtcacggtgcattttgttgggaatgaggtgggtggggggagggggttggtttgtatgtgggggggtttgctcctgttgaacatgctttttgttgtggagggcacggtgggcagtgggaggcaggtaggtgagctctgccctacaccagaggaatctgtcagacaacaggggactggacggtcctgggagatgaatggtctcattggtgacaaaggtgttttggccagggtgccagatggtgaatgccacctttgagagggtacccgccctgcctgcatgctactgtggctttgtggcagatggggtggacatgcagaataaccggtggaactgacttgagggtggaagagggctaggagcccctcaggttctcccagcccctcttcaacctgtgctggggtgtcccagcgatagtgtttccacatggccccgatcagtttcagttggaaagaaatagaatgacaagtcggtgtcaatgtggccagtgtgtgcaggatttcctggcccagtttggctgtgcaacctcagagaagttgtctggtagccatggagcctctgtaagtgtctaaggctcatgccaggtgtctggttaggtgtagtgggaatcaatggcctcacataggtttcgaggcatgcctccctcagctacttccatttctctagtttccctttgtcaccagctgcttatgaaattgaaaacaggatgatttagaaggaactgagcttgtcatgctcagggctgtccatgctgtcatgggctgccagccacttggggtggggtctctaacccacagatggtgactggactacagtgagatttgggtaagcttttgggagaagcaggcacagaagtagaggctgtagaagcgtgaatttctcctgagacttgaggacaggccccactctggtgcaaggagcatggtaatctttactgctggtgggcatgtgggaaggggcccggatcgaggggagctttaatatgggtacagttggtggagagctggtcttttagcggggtggttattgggcagtcatggcagaaaagtagggagtggaggacctggcaaatatgggggctcatgctcagtactgcttagcagcagcagtgctagtagaagcagcagcaggattagtagtggttggtactcagtagtagtagtagcagcagcagtgatagtagcaatagttgtaataatactgacagtgagtacttgaaaaatactatgtaccaggaactgctatgatttctttctttctttctttctttctttctttctttctttctttctttctttctttctttctttctttctttctttcatgttattttattttattttgttttttgagatagggtctcactctgttgccaggctggagtgcagtggtgctatcttggctcactgcagctttggcctactgggctcaagcagtcctcccaagtagctaggaccacaggtgcacgccaccatgcctggttaatttttgtatttttgtttcactatgttgcccaggttggtcttgaactcctgggctcaaatgatcctcccaccttggcctctcaaagtgctgggattataggcaggaatcaccatgctcagtcagaaggcattcttttaaccctacttttgggaagaggacactgggtgccatgtagttatataatgtgcctagggccacacaaagtgtaaatgacagagcccagattcagtctcaggagcgctgacttagggacctaaccatctccagactgtcgtaaaggtgtcttgagaactctgtcttcagagtatccagcacatgcttcttgaacttggcctagggataagtcagatgctaagagctccctggaacagtggggcatggctgtgggaaatcagattggggattataaattaccctaggttcctaggtgtcctggtgccggaaagtcaggtgacatgctagagagtggctggggtgctgggcaggtcagagcaccaaggtacattcaggttgaccacgaactctttttttttttttatgttttcgtctgaggtggggtctcactctgtcactcaggctggagtgcagtggtgtgatctcagctcactgcaacctccatctccctgggctcaagcaatcctcccacctcagcctcctgagtagctgtgactataggcatgcaccatgcctggcttattttttgtatttttagtagagatgaggttttaccatgttgtccgggccggtctagaactcctgagctcaagccatcggcccacctcgccctcccaaattaatgggattacaggtgtgagccactgtgcctggctgaccaagaaccctttagaaacctgtctcccactgagtaccatcctccacatgtgtgaggcgtgcagccctgctgacccaagttcatcaacatccacgctgttaagacaccattcccagttgtctcctcctcggatggacgagggggaagcttgtggtcttgcatggtcacgacattgactgatggtctgggcggatgtcaagttccctgtttttacttatcaaaggctctgggtttcttgcatagcaatgatatctctgcagtttcagaagcctttggcctgaatcgtgaagtgggtgtgcagtttgcttggcaaggatgaagaccccagatgagtcactagtatggggacagctcttctgtcctggtatctgaaccctcccactagcaaggtgggccccaggtattagggcggcaggctaaggtgttaagatggacccacacagtgctggcggcaggcacctctcatataaagtggagcctgggcttttcacaagagagcacttgttggtcctgtgtttacaccaatatcttggtggtttatggtataaaattagacagtagtcagttattctttagaggatcatggtgactagtggatgatgctcattttaaccttgtgtctttaacataataactggtagaacttttagttccgatgcagtgaagttcagggagctaaagctcttcccagttcaactcaaagtaatccttggatttttttttttcttttccttctagcagtgaaaacagcctgaattctagtataaatactattgttttcccagccttgcctattgacacttggctgttttggagaagttggagagaaataatttcttaagatgaaggtagtgagtgtaacatctcaaaagcatttcaggtgttgttttgggttttcaatcattaaagctatttattggccaggcatggtggcttatgcctataatcccagcattttgggatgccaagggatgattatttgagcccaggagttcccagctttagtgagctatgattgcaccactgcactccagcatgggtgacagagcaagaccttgtctctaaaaaagaaaattaggccaggcgcagtggctcacgcctgtaatcccagcactttgggaggccaaggcgggcggatcacaaggtcaggagttcgagaccagcctgaccaacctggtgaaaccccatctctattaaaaatataaaaattagctgggcatggtggtgggcgcctgtaatcccagctactcaggaggctgaggcaggagaattgcttgaacctgggaggtggaggttgcagtgagctgagatcacgccactgcacttcagcctgggtgacagagcaagactctgtctcaaaaaaaaaaattatggagttagaacaaatgttagtttcacagttgatttaatgaagatgcttttcattttttggtcttgtgtctgtgctgcttgtggatcttcgtattttggatagtggaagctctaaacttaacctagcatttagtaaaaagcttctgtgatgactttcaggccttttttaacccacttatgccggaggttgccaattttttttgtgtgtgaaagatcagaccttggcgatgaggttgaacagtagaatataaactcccacaagcttagtgttccaataatggaatgctaggcacagatgggttaattcctctggttacagaacaactgtgcagtggatccataactccctagccatatactcttaactaagctgaaggcaagcagggccttccctgggtactaatgatggcaccagcaggaagagagatggtgacaccagtttgcggggagtctttgaggttggaatttcaaagtaatgcaagtgagattaggaacgattgtcagagttgaggaatgattataatgcccagagaaacaagtactagtctaatggtgaacatggtgctcttccaggcaaatgctaattagaacagaacagcccgcaaatttccagcacatctgtcccctatgtgcacctccatggagactgtgatggggactggagactgagcaagtatccacccacttagagcctgcagggggggcaggaggaaggaggagcttgggaatcctctgtgtgggccaaaccaggacacaggcagcttctccatttgtatctatgctgcttgttggtctttgtattttagatagttgaagattatctaaatgtttctttgagaaatgagatgtgtatttttttttttttcctgagatggagtctcattctgtcaccaggctggagtgcagtggcacgatctcggctcactgcaacctctgcctcccaggttcaagtgattctgctgcctctgcctcctgagtagctgggactacaggtgtgcgccaccacacccagctaatttttttgtatttttagtagagatggggtttcaccatgttggccaggatggtctcgatctcttgaccttgtgattcacccaccttggcctcccagagtgctgggattacaggcatgagccatcgtgcctggccaatgaggtggtttttaataacttcaattctacatttcttgttcagctgcctgacatgagggccaaggccaagcctcatgtggtattttctttctttggttgttttgttttttgagccagagtctcactctgtcacccaggttagagtgcagtggtgtgatcttggctcactgcaacctctgtctccttggttcaagccattcttctgcctcagcctcccgaatagctgggattgcaagcttataccaccacatgtagctaatttttgtatttttagtagagacagggttttaccatgttggccagcctggtctcgaactcctgacctcaagtgattcgtctgcctcggcctcccaaaatgctgggatctttcttaggtttttaaagatcatttcaaaaatataaaatataatagaatactaagcctctctctacccctaagccagcttcagtaactatcaactcatgaccactcttgatttttatgaagccctgctcactgccccctctgaagatgtgtgtgtgtgtgtgtgtgtgtgtgtgtgtgtgtgttttgagatggagttttgctcttgcccaggctggagtgcagtggcatgatcttggttcactgcaacctctgcctcctgggttcaagtgattctcctgcctcagcctcctgagtagctgggattataggcatctgccaccatgcccgggtaattttgtatttttagtagagatggggtttcaccatgttggccaggctggtctcgaactcctgacctcaagtggtccacctgcctcagcctctcaaagtgctgagattacatcgcgcccagccgcgtgtgtactttctaattgaagaaaccgtgttgtttgccctgcacggattcccagggtctagattgggctcattgcatatccctcctcccctcttgtgaccctctacatccttgcatgctgtatcatttaacatgtccatctggtaccagaagttagtagttagatctagaagcttgatgtgattcaggttttattttcccccctcctccctttggcaagagtactttgtaggtgagggtgtgtaccacctgccacttcgagatacctcgcttaggtctggttatgtgtgtgtggtatttggagccattcatgatcattgcttaagatgcattaatttgttaggagtttgcaaagtggtgatattccagttcctcatttattagctgaaatatttgcataaagagaaactttgccattatcaactctttgatactctgagttacagtacacctataggaaaggcaggagaaatgattaattttgttatttttttttaaaaccgattttcaaaataatgagtgattctccagcattttcctgtggagttaatggattttttgttattgcttgttctgtatattttgatgagtatgattgtgagctcatggatttaaacagttctgatgtgctgttcattacagttatcatccctgtgccacgctttggctgtctttggctagtgggagtctatcgaagttgggccctgagtcttttgaatgtatactattagtctttgcaacttcctcattttctggtatgacagatgttttaggctccctgaacagtttttgccccagctgtggaatcaaccatttttcctagcagctttaactccttttatgtttatatttaaagataaacatatcatgaatttatgtgggtatttccaaatcagattcaggacaccagtgttttgacttaatctctttactcttacatctgtatctcttttctcccttcatctgttcttttttctccctagcctaatcccagctcttgatatcaacatacttattcatttattttatcttacagtatcaacactattacccataatatgatttctaaaaataatttaaattttttttttttttgcagtttacattgtccttagggtagataataatgtgcagggactatcttttcaaactatttttttttacagtcaaataaactagttaaactattttgtttaaagttaaaaaaacaaattatgattcatccttttgtttggtaggtacagtctttactgaacatttaattttccctgctgtgcagaatggaagatcttagtttcatcactgaaatctcagcatccttttttcctaagggattttcttggaagcctaacatttggcagcagttctgattaaaagccctttgtggtcttaaaagttcttcagggtcaggcacagtggctcacgcctgtaatcccagcactttgggaggccaaggcaggcagatcacgaggtcaggagttcgagaccagcctggacaatatggtgaaatcctgtctctactaaaaaaatacaaaaattagttggtcgtggtggcatgtgcctgtagtcccagctactcaggaggccaaggcaggagaattgcttgaatctgggaggtggaggttgcggtgagctgagattgcaccactgcactccagcctgcgcaacaagagtgaaactccatctcaaaaaagctcttcacagcgggtctccagcccctccagactcagacacagagagtgcaggagaggagaatagtgatgtgtacaggcattggtttctacactccagaatcttccggggatggggaactcaggccctaccctgatcaattggccctaaatgtgggggatgggtcctgagcatcagtgagcgtgtaagtctcctgggtgattctaacatgcagtcaggactgcactgattcagagaggacttcaggtatatctggagtcttaatggttattatttccccagattcaccttttttcttccttatctctggatctttctcaaccctagttttgtcccctgttcccccatttctttttttttttttttttttttctgagatggagtcttgtgctgttctccaggctggagtgcagtggcgcgatcttggctcactgcagccttacctcctgggttcaagtgattcttgtgcctcagcctccccagtagctgggattacaggtgcgagccaccatacccagctaatttttgtgtttttagtagagatggggtttcaccatgttggccaggctggtcttgacctcctgacctcaagtgatctgcccacctcggcctcccaaagtgctgggattacaggtgggagccaccgcgcctggctgtatttccccatttctaaaacaaactgcttactcatttttccacagctcactcttttctgcttgtatttttcactcaaacatcttctttggtagcttgtttctatttcctgtgttttctttccttcccatgcaatctggtatggtgcagttgggcaaggaatatctgaagtgcgtgggggagcaggagcatggaggccgcgtgcccgctgggcctagacatgtaatgtgtcactccaagaaagcaagggatggggctcgaatgtcaggaggctgagtaccaaatactccattgagaagtatctgccttcaagtactctgggactccagtagaacctgaagtatggaacattcaagtatcctactggactctcaaaaacctccatggtttcacagtcgaggagaattcttgtgaaggagtaaggactattcttagcttgtttgtggaaagactcttcaccaggtcatagattggttggtctctaaggtggagaatttatgtgagttacttttgaccttggtactgatatttagaaagtttaaatttggttagttgtaattttgataatgagtattttcccagttgtttcgtttcttattagttgaaggttaagatggagaggtccgtggaaaagcatggaccaaaaaccagcattactcaccaatgagcccatttgcttgactggattattaaatgctgtctctcggcagggaaatctggacaattaggtagtcgtgacctacctgccttttgcattctctttcgctgggtttattgcatctgttatttcctctgggggtcatccctcttgccgtttgaatcatactcacctacggctgaaatggagaagcgtgtaacaggtaacagtgactcccagggactgtgagaagtttcaggaacatttagaaaggcaaagagcactgagcgtctggctgatagcccaggtgtgtctgctgcggccctggttgcccttggcactcctgagccagggctgcccatgtgtacagtttggccgtcttgcttcttgatgtaaacgtccagattttcatctcagtaaactctaaacagtccgtgttatgacccattgtactgggggctcttccataaactcttagtgccttttgaatgattggccatgctggaaatgtaatggtgagcctctgcattcttgatatctgatcatcttattcataattcttcaactaaatggtattttctgatttctgtatcataggggaaaacttccatgacctcatggaaggcagtgcagttggtgaagtgtgtgagagagagtgtgtgtgtgtgtgtgtgcgcgcacgcgcgcgttcacatgccgagacaggcttgttgggatttaatatcatgacccatctgagggatgggaatgtcttctgtaaatatcctgatcccgtgctagttgtttgggatgaaagtgtgtgttaattttgtttttgttttttactgattgttcttctctcacttcagatggacagaaaacagctatcaatggcaaacctgtcaggtgtttattatgtctttgttaagaaggagagattgcttaaaaggaaaagttgtttttcaaggttaaggtcttgaaagattttcaaacattttgcattttgtcttttgagaagtcaggaggaaatgatgtcgagggcctacatgtttacttttggtgacctggatttgcaatgagtgtttggttttctttgttgggggaaaagggtcccttacaacgggttcgagagggaggaagtaggttgccgggtgaagtgctcatttggcagggagggtaaaggaaagctcctttgcttacctcaaaccgtggctcaagctgcgttctgctgtttctttgcctttagtcttggaggttaaaattgcattccctacatcttgttcagaaggtaagcccgcatgcttcccagctcattggtgtgggattttaattttgccttggggaaaagatgattattaatattgcttcaaaaccaggaccttcaaaatatggctgataaagagagccactgatgacattccctttgagctcaatttctgctgtgtttaatttttgactccacactacctgagccaaagtggcagttcttctgggcacatccgggcttgtagggggcagaaacatactgaagcaatgtcctgtgggtccaagagcctggaatcctcccaagtctggttcttttccccactccaactgaagctggacttggtggtgttagatctaccgactcttggagtttggattgggaaaaattggagagtttgattttctgatctgggtttgtgccaatatctccattcacaaaggctcttaactgtgaagaaggtggcaagagtgctggcctcccatagacgagcctgtgggctgggatgtcaagggtacagaggaagtggggtgagagctggggtgtctgtttgtaagcaaattccttactcctcttgggccatttttttccttattcaccttaggccaagacttaatttggtagtttgccaagtgtgctttaaagccctgtttgtaatacagagcacccacagtgtaccaagcacaatgtactaaaactttattgactttgaaattagaattttgatttcaggttaaaactcctatcggcttgtcttaaagaagaaaacagttctgcttttcttttagatgagtgatgaatgttgcactttgaaaatataaaacttgtgttaagaaaaaacgagcctaggtgccgtggctcacatctgtaatcctagcactttgggaggctgaggtgggaggatcacttgaggctaggagttcgggaccagcctgggcaacatagtgagaccctgtcttgaccaaaaaaaaaaaatttagctctacatgatggtgtgcacttgtagtcccagctacttgggaggctgaggtgtgaggattgcttgagttagggagttcgaggctgctgtgagctgggattgtgccactatactccagcatgggtgacagagcaagcaatatctgaaaaaagagaaagtaaaaagaaaaaatggtgtggtctgtatgtctaattaaaggcttttctttttcttcttttaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggtaagtgacattcagcattaaacatgtacctcacctgaagcatcagaagcattctgaggaagttttatgtaaattaaatactgcataaatagccactgcactccagcctgggtgacagagcaagaccctgtctctaaaaaaagaaaaacgaagaaaacttctgtaaatagaatcatttacaccttactagagaagcttgctatttgcatcaggccaatgttttttttctttatgcaaaattttccagtgtataatgaaagttttctactgctgtcagggcatggctgcctttgataacaggctgttgcagaatactaaatttataatgaaatctaattaaaaatatcaaattggttttcagtgtttctttgcctcaatctcatagttgtatttatggaaatttttgttgttgttcattaaaaccttcacttacatcacagttgtattcagaagtgaacttcagtgaaattggatctatgaaattaaatctaggagaaaagaatatatttgagaaagggaattcttatattttttaaatgaaccatttagtcatattccatataattttcttaactgaagaaaaatgtaaatggaatccacgtcggatacaggctttctttatattctaaatctagttgtggttgtttttaatggtatttaagaaaatagttggatgtttgggataacactttgaattgttgattgtttttcacaattttggagagaacttatagtgtttctattttatgttggttttcattcaaagtaagtttttacattaaacagttgtcccttggtattcgtgggggattggttacaggacctcttgaggatacaaaaaaattggaggatgcttaagtccttgatataaagtggcatagtatttgtatataacttattcacaccctcccatatatggcattttatttatttatttattttaaataatttcatcttttattttagattcaggggtagaggtgcaagttttttccatgggtgtattgtgtgatgctgaggtttgggttatggatgatcccatcccccaggccatgagtgtggtacctgataggtagtttttcagcccttgccgcattccctctctcccaactctagtagtcttcagtgtctttgttctcatctttatgtccatctgtacccaatgattacctcccacttataagtgagaacatctggtatttggttttctgttcctgcgttaattcgcttaggataatggtctccagctgcatccacgtggctgcaaaggacatgattttttttttttttatgggtgcactcccatgtactttaaatcatcttggtttacttataatacctaatacaatgtaaatatacattatataatgtacaatatacaatgtacattgtgtacagttatataatgtacattgtaaagtgtacattatttaattgcacattgtaaattgtacattatataattgtacattgtataatgtaaatatacattgtattaggtactataaacaaataactgtttagggaatagtgacaagaaaaaaatctgtgtgtgttcagtacagacacaatcacctattttgtttcccccaaatattttcaaccccaggttggttgagtccagggatgccaaacccatgcacaggaaaggctgactgtattttctttcccattagggcagtaataatgataagacctgatttgatattttcttattttatttgtgcttttgtattgagatatgccataaataataccatagtttgctgtggtcttaactgttatagaaggagtgggatttctggttgctttgctgagaagttgccatagagatgctagtgtcaagagctaaagaacttgtcattaaatcagtcctggatatctctttgtcctgggccgtttttttaagccatttaaatttttttttttttttgagatgaagtcttgctctgtcgcccaggctggagtgtagtggtgcaacctctgctcactgcaacctccacctcccgggttcaagcgattcttctgcctcagcctgccgagtagctgggattatggacatgggccaccacacccagctaatttttgtatttttagtagagacgtggtgtcaccatgttggccaggctggtcttgaactcctgaccttgtgatctgcccgtctcggcctcccaaagtgctgggattacaggtgggagccaccgcacccagcccatttaaatttaaagtattcttctttgacctcgttgtcacttatccagagtgtccgtaaggtgtcctccccaagtcttcctttgacatgggggaatcaatcttataattctgtgaatcctggaggcctcgtgtcttagtgtctatggtacagtataacaggtatgcccggattcctcatgtgtgacatgaaaatgataacaaggcttgtacacactagtcaaggggtcttcatcatcatcaccaccaccaccaccaccaccaccaccatcatcatcagcagcagcagcatcatcatcatctgtgttattctcctgtactctcttctaccatttaggagaagaatactcaggtttttctataaactagctagatttttgtctttcaagatcatacttctaataaattcataaaaattttcactaacactccacttggcaaactttaaaaacaccctacatgaagtccggtttgaggtagtggttcagtaaaacacagctctttgtacaagtgagatactgttcacctgtttttcttcctcttttccactaacgctttggaaaatagcctttgggaaatctgatctaactcggcagacttgcttgcctgcatgtaaacatctcccaaaggtattaatttgtcagcttgattatcttagaagtattgtctctttatgaagtcaaaaattgcttgggttaaaccataagacttaacctgaaatcccagaaacgtgggaaagacgaatatcctcatgtcctgccttgtatgtggaaacatgcccaggtgaagaaataagacacttcctcctcacacgtgggctgcttccttggggcagaggctggctctgcagcaggactctgaaaggtccctctgcgacactggcagtttccactgaggcccccatatcctgattcccggtctggcagaaatcaggttggctgttgcaaatggaatgactgccgagcccgtcgtcgacatttggtattgaatgatcttgcaggatgtctgaaaatgactcgtcatttatttactttttcacagctttggtaaaattactttaggcttttcatcattaatttttcttcttattgtaataaaatatgcataacataaaatttaccattttaactctttttaagtgtacagtagtagttcgtttgcattaagtacattcacatcattgtgcctcccaaccccaccatccatcgacagaatttgttcatcttcccaggtggaaactctgtacccattaggcactggtgtccactctcccctctccacagttgtcagccttctgctttccagctctatgaatttgatgactctaggtatttcatagaagtagaatcatacagtatttgttattttctgtctggctcacttcatgtagcataaggtcttcagggattatctgtgttgtattgtatgccagattttaattcctttgaaagagtgaataatattccactatttggatatgcctcattttgtttatccattcatctgccaccggacatttgggttatttctgccttttagctattgtgaacaatgctgctatgaacacgaatgtacaattatctctttgagtccttgcatttagttttcatttatttttatttttgagatggagtcttgctctgtcacccagtcaggagtgcagtggcatgatctcagctcactacaacctctgcctcctgggttcaagtgattctcctgcctcagcctcctgagtagctgggactacaggcacctgccaccacgccaggctaatttttgtatttttaatagagacagggtttcaccatgttggccagactgatctcaaactactgacctcgcgatctgctcaccttggcctcccaaagtgctgggattacaggcgtgagccactgtacccggccgagtccttgcttttaatacttttgagtatatatttatttagagatggagttgctgggttatgtggtaattctgtttaattttttgaggaaccatcatactgtttttcacagtggccacaccattttacattcccacttattctttaataatttgtctgtttaacttgagaactaaatgagatgtttttatgaatcatgactagctttaatttggattgatggctccaagggtggtctgttgaaatggttcatggtggtttgttcaggttcctcggaactctgtgttatttcttacaacttttaccaaataaaaagactgtgcagcacaggctgtattttaagtgaggtcaacagattggcattaagaatatgggctcctcatggcaatagtgtgctgaacattgtacttgctcatgttagaatgtcgtcagtcacaagtcatattcccagcatgggttcgtataacctctgcagtggggacagtgccttatctcctgtttttactttttagctatctgggacacagaagcaggggatgtgtccatcttcaagtctcaaggggttacttctatagcttagagcacatgagttggggagttggctccatgttggaggaagagggtccctttagtcaaactgagcctggattaaggatagctgaagatcttcagccccagccaccagtgagactggatctcccatttgcccttgcctaccttgacttagggccaggatagatctgagcctgaatgctaaacatctgaatgctagacctacgatggaatggaggacagtttcattaatcaggatgggcttgtcatcccagcttttgtattatcaaatacattaggcatagagacttttccttaagatctgtggcctaattagctcaagatttcttgactttgtatctaatttgaagaaccgtggtggttcctgcagtgggttggcttctgagttgtggattttgatgttgggttggcttgtcctgaatgccaggtaaagctacagcagtacctgagcctgcttgctggtgctcctctctgctgtttgcagacttttttgcagaattgagaaagtttggggaaactttttattctggataaaactgctcgtcttcactttctttagagttactctgaaggatagtttgaggtaaagtatctgtctgtccttcatcttccaccttctaaggtgtgttgagtccctgcagactttctagttttcctttatcatttattacagatctgccctagaagaatatatggaatatatgtatgtagtgtatctcagaggggtgctctctatagatttctgtgttgagaaatatttgtagttaccctaagtgtattgtttaaccatttatgtgatactgtgtggttctctttttagaattctgtaacttggggggaaatgcatattccctgtatgcagggaatatggatactccaggaatacatgtatatattctcttggatgctccatccagagttcatattatcaggtactcttcatctttctgggggaagaattcctgtttcttttaatcttttcatttgagaaccctctcctcttgaccatttcctttttttttctttaaagagacagggtctccctatgttgcccaggctggtctcgaactcctgggctcaagggatcctcctgccttggcctcccaaagtaccaggattacaggtgtgagccaccactcctggcttttttttttttttcaagacagagtcttgctctgtcgcccaggctagagcacagtggcatgatcttagttcactgcaacctccgcctcccgggttcaagtgattcccatgcctcagcttcccaagtagctgggattacaggcatggtggtgcatttttgtatttttagtagagacggcatttcaccatgttggccaggctggtcgcgaactccaaacctcaggtaatgcgcctacattgacctctcaaagtgctgggattacaggtgtgagccactgcgcctggccttgatcttttccttctcttttcttggcattgctgcagggcaggtatatttttaggtcagtggtcagagcagcagacagcctcctctaccacagactgagtaggaagtggaaggtgccctcccataatgcacagagaggctgggcttgtgcacccttcccaagtcatgtctgccgccctatgcaataagtagaacctgaagtaaaaaaaataaatgcaccgtcatgcgctgatggtgagaagattgcagccacctgtagctctctggctgcatcccagtcttcccaccccgtctccctctgggttttctcagtggatgtggacagacaattgatagcaaattttgtcagcaactgagccatacagtgttgtggtcttagttttaaaacagaacttttgtttttatttaaagctatttttatttcactgtagactgtatattgctttatatttagactgaatagtatgaaattacagatattcagggccgggtgcagtggctcacacctgtaatcccaacactatgggaggccaaggtgggtggatcacttgaggccaggagttcgagaccagcctgaccaacatggtgaaaccccatctctactaaaaatacaaaaattagcctggcatggtggtgcacgcctgtgatcccatctacttgggaggctgaggcacaagaattgcttgaacccaggaggtggaggttgcagtgagctgagatccgtgccaccgcactccagcgtgggtgacagaacaagactcttctttaaaaaaaagaaattacatatattcaactcctttgggcctttttacaaaactagcaatttcatatggctcaaactaatcttttgtctattagtctgtagatcggtttcctttctgaagattcgtagagagcctcttgacagtgttgtcaaagtgaaactgtgtggtgtgtgtggaagttatctccctggacacatgtgatactttggttggacttcctcttctaatgttattttctaagtttctgacaaaattagaatgacccagtagtgcttcttacattgtccataatacgttaaaatttttgtttcaaaaacttttctcccccacagtttttggttttacttctgatgtgaacttgaattgtacctgggcattttgtgagacattaatctcatcaagggacaatttgtcagtcttctagtttgctagggaatagcttaagaggagccaagttaactttccatagcttggagtttgagctaagaaagcaagttaaggagggaggacttgttttgtttggatttttccaagaggaaatttctgctgctggagatttaggagtgtcagatgcgtcccatcatctgataattgtatttgcttcactggggtgtgggtgcaaactggaagaaaatgctttagctcagtggttcctcaaactgctctctgttgtattcatgaggggaaatctttaaaataccactggtgtctggactcttcccctaaacattctgatttaattgctttagggaaattttaaaagctcctatgtgatactaataggcctcaaatatgtgttcagcttaattttatgctttataactaagaccttccagttcacagagatagcatatgggttgcgggtttaatccccctcattggtgaataactccttcggacttgtaggtataaacctcaagcatggtagctgttcatcagcccgagtgtcctaccatctggtctgggaatctcatatgcaggagagcccgggtgttgagtcaggtgtccaggcactttgtagaagactccatgaagtcctctagtggcagattggcaagggtagagattgagtgtggactctgagagcaatcatggactcagagcagtcagacctgagttcacatctcagtgctgtcattttctaagctgtaaaatcttaagagaagcacattcgcttcccagggccagtttcctgataacaacttgttgaagactactctttccccattgaattaagttggagaaaatgtagattagatggccatttatgtgtgaatctttttctggatcctctattctgttttgttgatctatattttctttgttttactttagtagtcagatggatagaatctattctttcttcatagcaaattatcttaattactatagctttataaatcaaatagtgaaagttacccaacctgtttttcttttatgattgttttgactattctaagtctcttgcattttcatattgactttagaatcagcttttcaagttttacaggaaactgttgggttatgcatcttgaattctaagacatggtcttagaattccagatgaagtaattccagatgaagtaattgccctgttggagaagtaattctccaacagggcaattctatccacctgactattaatgttaagagtgggcatcttaacattatttagatttccagtctaagaaaatagtgtatttacctattcctcagttatctacatctttatacatttctttttcttttttttttttttttaagtggagatggagtctcagtatgttgcccaggatgatcttcctgagctcaattgattctcctgtttcagcctgccaaagtgttgggattacaggcatgagccactcacgccaagccctagatctttaactctccttgtaattattaggatagaggtcttaaagatcatttgttatatttttatattttatatttttatatttttatatttgttagcatttaaaaaagaatgccataattcaaagtagcatttgtgctgttataaatggtattttatttatttattttatttattttttgagacagactctcgctctgttgcccaagctggagtgcagtggcacgatcttggctcactgcaacctccgcctcctgggctcaagcaattaccctgcctcagcctcctgagtagctgggattacagatgcatgccactgcacccgactaatttttgtatttttagtagagacgggattttaccatgttggccaggcaggtctcgaactcctgacctcaggtgatccacccaccttggcctcccaaagtgctgggattacaggagtgagccactgtgcccggccataaatcgtattttaaattttcacttaccgtttgttgttagtatatagaaatacaattgatttttgtatttttgctttgtttcctgaaaccttgctaaagtgcgttaagttgcagtaatttttggctgattccttaggatagctatttagataatcatgcctttggataaaaacaaatatactctgtgtgtgtgtgtgtgtgtgtgtgtgtgtgtgtgtgtgtgtgtgtgtgtgagagagagagagacagacagacagacagacagtgggggagagggagagaagaagggagagaagttaaaatctccggttatgagagttagtctctttttctccttaatcatgaactttttgcatcctgacttactggattcacttgtatttaaagtttcttactggattcatttgtgcttaaggtttatttgtatttaatatcccctcatcttcaccgccatacaatatttatgctttaattattcagttgtctttccacaatttaaaagaagaaaaaaatagtttttaaattacccactgaattactatttctggtgctcttcattccttccctttagctccaggtttccatttgatataattttttttcagcatgtaaaacatctattagcatttctttattttctttttttttttgagacagagtctcactctgtcacccagactggagtgcagtggcacaatctcggctcactgcaacctccgcctcccgggttcaagtgattctcctgtctcagcctcccgagtagctgggattataggcatgtgacaccacacctggctaaattttgtatttttggtagagatggggttttgctatgttacccaggctggtcttgaactcctgacctcaagtgatctgcctgccttggcctcccaaagtgctgggattacaggcgtgagccaccacgactggccaacatttcttatagtagaagtctgctggccatgaattctctcattttgttctttaatctgaacaaatttttttttttcttttgaagcacatggttgctggatgttgaattctgggtgatagctggtggtgtctgcccctctcccttcaaaggtgttccattgtcaactggccttcattctttctaataagttgttagccatcatttgtatctttattaccttgtttgtaatgtttctctttttttttttttgggttgatttttttttctctttgatactgattttttagaggattgataatgatcctaggtataatttacttggtatttatacttctcggagtttgctgagcttcttggatctttgatttgattctttttattattgtaaagtttaggaaatatttaaccattatatcttaagttttttttgacttattctcacactcttgtttttcttggactcctattacatatatattaaactatttgagattgtcttataggacagtcagtctttttcacttttattcaatcttctctgttgcttttaaactgctgataagaccagccagtgatttttcttttctcctttatttctcatttcagtattgcagctctagagtgtttattgggctctttttaaaaatactttacactggccaggcacggtggcatgtaatcccaacactttgggaggccaaggcgggcagatcacatgaagtcaggagtttgagactagcctggccaacatggtgaaaccctatctctactaaaaatacaaaatttagctgggtgtggtggcggacgcctgtaatcccagttactcaggaggctgaggcaggagaatcgcttgaacccgggaggcagaggttgcagtgagctgagatcacaccactgtactccagcctgggtgagagtgagactctttctcaaaaaacaaacaaacaaacaaaaaactttacacttttttgctgaaaatctctatctctttactcatatttttcctcagtttctttgaacatactaacccattgtacatttatacttgtttctgtaaatcttaaaatccaatgtgtgtgcctacttggatttacttttattatttatatatttgaggggtttggtttttattatgaagactgctttctttattgccctgagttaaattttctttcttgcatgtctaaggttttttattgtggacattttggatgatacattgtatgtctgacttctgataattctaaaaagtattgaattttactccaataccatattaactggctgaactcataggcctgttttttatgctttgttagggcagaactttggaaattttcaggtgttttccaagcttctctaacttgatgggactcaagattcaaaacatgtgtcatttgcaggccctgttaggtagtgcttgttttttcttgggcaagtttagagttaactcttttttagtgctcaacctgggtagcacttgacatttagggctaaataatttctttttggggatggagaggctgctccgtgcattgtaagatgttgaacagcatctgtggcctctgcccactagataccgaaagcgtccctctagttgtaacaaccagtagtgcctccagtcgttgccacatctctcctgggaggcaaaattgccctgtttgagaattatttctctggatagtgctcttgaattctaagacatgatctctctggtgtttcaaccgtatgccaggtgtgttaatgatatatgaatgaggtttccgcactctggtctggtgagaatttcagtacctcacctcagcttgaccttcagtatctctattcagctcactcctcctcagcaccagctctctgttaaggcttgggcggccttgacctgtgcccgcgcatcagccaaggacttgtagcacccccaccccacagccttctggggcccttcccttctgatacctgcttactgtccagggccatgcagatgccagtggctttaactaacccaagctctggcctccacccctttgctcagcagggctgctgtgatgtgtttggacttcagctcactgccacagtcggaaagtggtgtcctagctcagagccaaggcaatgcttggtgtctggagacatctgccttctagtgttgtacagttctgaggcagaggagtgggccgttatggtatgagccacttagccgtggccagagcccagtctctctgctagttgaatagcccagatgtttatgagctgtggagctgggagctccaagtgtacagtatagggtgtggttgtgtgagctgtaggacatgcctgtttaacttccttactgaatagatggagggtgagggcatatgcaagactgaggggctccagcatctgccatatgtcacctgtgtgcttaacaaaaaccccaatcctggggccatctcagacctgacctgctgtttcagaatttctagagaaagggcctggaaatctgtatatttaatttgtgcctcagggaagtttctgtactagaggatggcgaagggaacaacaggtgtggagagggaggctggacgtggcttccttgaaagggaaagggccgcatgaggctctgcattcctttccccaggacttatattgaaatcatggccaatgatttatttattttttaaaaatattaattcagtttttaaattttagttttttttctgttttttccttttttctatcttctaagacatcctgttatagcaaatttttacattttttcattgccctgccctgaaaatgtttttatttctcgtttttttttttaacatatttctctaggtttagaatttgtattttgtgcttatttactgtcaggccttcaaacataattgatttgtttttaatctttttctactaaaaattaaaaaaaattgtggtaaaatatacataacggtcaggcatggtggcttacacctgtaatcccaatactttgggaggctcagatggctggatcgcttgagccttggagttcaagaccagcctgggcaacatagtgaaaccctgtttctacaaaaaatacaaaaatcagccaggcatgatggtgtgtaccagtagtctcagctacttgggaggctgaggtgggaggattacctgagctcaggaagttgaggcttcagtgagccatgattgtgccactgtacgccatcctgggcactggagtgagaccctgtctcaaaaaaatatctgtcacataaaatttgtaatttttgcaaggcatggtggctcttgcctgtcatcctctggtgtcctccattttactttctgtctgtaataatctgattactgaagggacctcatccaagtgggatcataccatatttatccttttgtgagtggcttatctcacttcgcatcatgtcctcaggtaaatttaattttggggtttatgtcatacattttctcagcatttagtgaaaaacttctgcctcaccctgatcctcaactgtggtgctgaacctttatttagctgtagtggaagaggaaagaatttctgagattctacccttttctggcttcttgctctgagcaactgcctgtgtcctgatgtgttttgaagtcctcatcttctcctttctactccctctgggacccattagctgaaggaacagggtcattttctcttttggatctctcctgggggtaatagctgtgggcacagggctgttatttgatatgcttatcatagagtcgagaaagtgggaaggaggtaccttggtaaagagtgtctgtccctcctctctctgtgcatttttctcctaattcctttatcctcatcagtgaaagagatgaaggcattactgcatttggtatgtttggttgtaaaaatgtatgttagtgaataagtcattagtaagacattttctgacatctgtcattttttttcctgctgcacaaatctcttcattttcttaaagcttcaaagataatcttgaaatgggaatgaatgatggaatgaattttgcagtattacagtactgtgtactgttactttcggattactgaatatctggcctactcaaggtcaatactttgataaatacacaacattaggaaaaaaggaaaatcacgtatgtaaaatattttcattttgactgattcttagtaaaattttggtgagtctgtagagtgaagattgcttcctccaagtattcttagtcttaaagacggcacatgaaacatgtcatatttgagaagatacattataaacacatttcttatttgtttcttataatattcttttagaagcagaaagcaggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggtaggtgaatctcttgaatctgggaggtggaggttgcagtgagccaagatcatgccattgcactccagcctgggcaacaagagtgaaactgtctcggggggaaaaaaaaagcagaaagaagaaaaacatgataaaaaagatttttaaaaaatgatgatggatgccaaacacacctctaatcctagaactttgagaagccaaggcgggagcattgcttgagcctaggagttcaagaccagcttggacaacatagggagattctgtctctgcctcggccctccctgttctaccctccaaaaaagccaagtgtggtggcacatgcctatagtctcttacttgggaggctgagacaggaggattgcttggaccccagaggtggaagctgcagtgagctgcgatcatgccacttaactccagcaaaaagagcaagaccctgtcacacacacacaacaaaaagatgacagaagtttggtttttttcttcctcttcaatgggggtatactgcatttatattctccttaagatgatcttctctgacctaaccctagaccatgtatttgtccccatgtatgtcctcactgtcccttctttacccactccctggcttgtcaccctctccatattttcctttttcttcctgttgccctgccagtatgtcttgctcatctctgttcccctctcagtcgataaaccagttcagttggggcttgtttttcaggcaaagaaactggtgatagcagggtctggggctgaggggtctttcagccatggtggggggatgtggcccccctttgaacagattactctcaaactgtgttacatgttctttccatgggtattggtagaattgactaattagattgtactaatttccttcaatgtatattgactgccccaccactcattgaaacgctaatggttttttttccctttcttttcttttccttccttcctttctttctcactctttctttctttctcactctttctttctttctttctttctttctttctttctttctttctttctttctttctttctctttctttctctctctctctctttctctctctctcatctgtctgtctcttttcttttcttttctttttttttcttttctttcttggttttgctctgttgcccagactggattccagtgggatgattactgcttactgcagccttgagctcctgggctcaagcgatctttccacctcagcctcctgagtagctgggactacaggcatgtgccaccatgcctggttaatttttaaatttttttgtagacaggatctcactacgttgcccagtctagtcttgaactcctgggctcatgtgatcttgccgccttggtcttctaaagtgctgggattacaggcatgagccaccctacctggcctacggagaactttctgtataggttttcaggcttgtattccagccatgaaaaatcaggtgaaacacaaacaaaagcctcagaaggcagtgaaactgtcagattataaagaacatacaggttgttgattttggatggacattttcatctccttaaatttcatttcttttacagaattagagaaggaatgtgactttggtagtcacccatcatgtttacgaggaaggaggatattagccagtccttggatcatcccctcagaaacagagattattggttttagattgtgcagtcattaaagtagatatgttgttactaagcaactctggccaacagtattggaaaaatacaggcaattttctgcttcaagtgattaaacatactcatcctagttgcctgttgcagaaatacccagtttaattggaagtttcattacctcacaaactcaactctggggtagggtcatgaaccaggaagtaagcaaaacataaaataaataagatagataatacttactttatatgcttattcagaacgtttttactctgactttacttacagcactcaaaagccacatcctagtctaaaacactagtaggtaatggtgtgacattctgatgagaataaagagatacctgatagcctgacagccaggggcaagatggatcaggaagtacccgaatccgaaaagtgtggccatttggggactctgtgagaggagcatccctgtccaccccgggtcattgacactgggtaagagccatattgttgtgaggaatttgcatcgtgaaggtgatgaactgcggtttgcatcttttgttttatttatttatttttttaatttttgagaaggagtctcactgtcaccctggctggagtggcgcaatcttggctcactgcaacccctgcctctcgggttcaagcgattctcctgcctcagcctccccagtagctgggattgcaggggtgtgcgccaccatgcccagctaatttttgtatttttagtagagacggggtttcaccatgttggccaggctggtctcgaactcctgatctaaggtgatccgccctccctggcctcccaaagtgctaggattacaggcatgagccaccgtgcccagccgcatcttctgttttaaaaggactattagagaggggggaaagacatctgttaaaatgaagattggattaatgcatttaatccaaaaagggatattcatctcaccagtctggaaaactcagttccatgaaaaggtcattctctccttccacctccctttgatggtgatatttatgtggccacactgattaaaataatcaagaaagaagaaacagtttatatttttcaaatgaagctagatattacatgatttatttttaagaaattgaatacaattaatgttttgttctagatagtacagttttcttgtaatctcaaatgtatttccttgcctgccttcagtagtaagcagctatcaaatggtgccctgctctgatggtgtttacttccaccattcacagtattgttcttaatggcatgcggattctagagtaaccaataattagatactcagatgttttccagtttttagtaattagatagttagatgtcttctagtttttgtatattacaaatagcattttaatggacatgattaaagctaaacatttggacagatccttcatttcctagggcgtacaaatttcaaggcttttgctatgctagattgatttcctccccaagagttgttaattacttacattttccccggtgaaatgagagagctccctacaagtccagatttgatgttatattttaataatcactgtcaatctcaccaattttcataggtgaaaaataatgcattgttgttttaatttacatggctttgtgtaatagtggatttcagcatttgcatttccttggccatttgtgctggttttttttttttttttttttttttgtgaatttcctgcacacattctttgctccttttaaaaaataattggtaggcatttataattcatatcgatatgtaggggccgttgatttattaaagatattttgggtctgggatgtgtactacaggttttgatttcagtttgttttagttgccttttatttgttctcatggtagaactattttgttttcacagggaaaacaaatttaatctaatggtgtccttttataacctgtcaggttaatgaagcatagaatcaaaatatttgcagaacgatgatacattaatttacagattttttctgtacattggatgtgaactcttttaaactataacatggacactttattggaaccaaactttagttttctacattaatgagaaacactggtaactttgcttcattgaaaaaataattgcttgttctctgtcagatgtaagtagtttgagtttatttttatcttctcatctacaaaataggaataattcttacttcatagttgttttcttgttcagttgtctggcttacagtaggtgcttactaaatggtagcttgatttatgatcataatgacataaatgaatatgacttggtctatatattctggtagctgctgagggtaacacagatatatgattacactaattgtacttctgaggatgtgagcagtgttttgttgttgttgtttgtttgtttctttggtgttgattttaggtagaactttgattatcaattttatgccttctttttaaatgcaaagtccttaaagccaaaagtttactctaagacttgctttagctataactcgcaaattattatcatttactttaaaatatttcagatttcccttatgatgtcatctttgacacatgcttatttagaaatattgttaatattcagatattttgagttgttagagatgtcttattgttgatctgtaatttaattctgctgtcaccagaatacattctgtgtaacatttttatgttcagatattgattgaaatttactgacggcccaacataaggactattttaccttaaaagttagaagtatgcaacagtaaaattctattaccttccccatcttgtgtgctattgtcgtatattttacttctgtctccaaaatgcaccattaccatttttgctctaagcagctagttgtttttcaaagtaatttgtcttctttttatttattttttatttttttttagacaaggcctcactttgtcaccccggctggagtggagtggtgtgatcttggctcactgcaacctccgcctcgtgggttcaagcgattctcccacgtcagcccccgagtagctgggtctacaagtgtgtggcaccatgcctggagaattgttatattttttgtggagcccaggctggtcgcgaactcctgagctcaagcaatttgactgcctcagcctcccaaaatgttgggataacaggcatgagctatcatgcccagcctgtccttatatttactcacattggtcattttggtttctctttattctttctgtagatctgagtttccatttgataccatctccttatagcttgaaaagtattctttacgctgttttttacagttcaggttcattgctgataaagtctctcagcctttttctgaaaatgtcctaatttcaccctcatattttaaaggacattttgtgttggtgatagaattcagagttgacaggtgtttttttttttttttttttgaattggagtctcacctatcacccaggctggagtggagtggcgcgatctcggctcactgcaacctctgcctcccaggttcaagtgattttcctgcctgagcctccggagtggctggaattacaggtgcccaccactgtgcccggctaatttttgtatttttagtagaggcggggtctcaccatgttggccaggctggtctcgaagtcctgggctcgagtgatctgcccgcctcaaccacccaaagtgctgggaatacaggcatgagccaccgcacctggccagttatttttgtctgtctttcagcactgtaaatattgttctgttgtcttcttgttttcattgtttctggtgtgtcagcttctgcttgtttttgttgtttctctgtgtttaatgtgtgtctaggtatagatctctttgtttttgtccttcattgaacttgctaagattcttcattatgtaaattaatatttgctaccaactttggtaaaattccagtcattatttgttcaaatattttttcttcccctatttcttcttcttttaggactccaattacatgaatattttattgcttaatattcttccataaggaccttcattcagtctttgttctttttcttaactctttttttctgtttgttcttcagatttcagttgtaaactatagaaggaagggttagcgactctgggaataaatcaatggaaagtatctgctattaatgatatctaatttatttttcatttcaggtattaccttttcagtttgagaagttctatttggttctttttgatattacctatctcgctcctaaactcacatctacttgttataaccatatttttctttaactccttgacatattataataggtgcttcatagttgttgtttactaattccaaaatctggatcatttcagggtctatttctgttgccatttccctcctttgattacaggtcacattttattgtttccttgtgtatctagtaattgttttactatgttgaacattatgatcgatatactatagggagtctggattaaagagcattgagttttgttcatgcaggtagttaaattcctggcagattggcccctttagcattgaatccttctgtctgtctgtcaatcagttaatcatagggcaggtagctccattctgaacttattccaagtgcacagctgttaatctagggtgagatctttattactaagacatagccttcctggtgtctcaggtgaatgcctgaggcccagtggagatttccttcctctcctcgggcggcatctcctactgcatgacctccagaatcttcggtcagcactcagccccatagctgctgctttcctaggcctcatggagtctggccctgcttatgaagccgttggcaaagtaccctgggtaaatccctactgaaacttctggggcaaaccctctgctactcaggctcacaaattccagatgcttctacaacttggaacaaccatctcttcctccaccgctcagtgaaactgttttgcttgggcagaaaatgtcctcaggcataaagccaggtcagtcccgggccaccacctacatttcccgtctcttgaggctcacagcctgtgttacctgtggtccagtgcctgaaaacagctgtgtcatatgttttgcccaacgttacagttttccaggggagggcaagtcctctctcatggttggaagcagaagcctggtagtttgcttgtcagctgtgtcttcctctttttttttttttaagatggaatcttgctcagtcgccgaagctggagtgtaatggcacgatcttggctcactgcagcctctgcctcctgggttcaagtgattctcctgcctcagcctcctgagtagctgggattacaggcacctgccatcatgcctggctaatttttgtatttttgtagagacagggattcaccgtgttgaccaggctggtctcgaactcccgacctcaggtgatctgcctgcctcagcctcccaaagtgctgggattacaggtgtgagccaccgcacctggcatgtcttcctcattaataatattcatggcccttcatgattttttttatcctatctggagtatgactgatttaatttcagcaggcccttaatttctgtgttgactgtagagttatcgttcacttgggttaacttctattacaacccgagtatctgcccagccttttattccacctctacacctggtcacagtaatacacgacttacaagtagccctcctggtgcacccagaagaactttgtctttttcacaaattggcatctgtgctgtcttacctaaatcctcattgttggcctcagacacaatctgtggatgatagttcaagttgggcacaattgacttcagatttcttgaaaagggtcagcttaggcttagagtttggtgttgacattttgcttttatttttttaaaattaggtatcaaatttacatgctttaaaaatgtggtattttctgcatgtgggattaacattttgtatgtaagactggctttataaatatttacagatagtttgtagtcaataaggcacattacgttctgtttctttcctacaggggcgggctggtctctctccttccctttcttctccctcactcctacattttcttctttctttgtattttacgattgattcacttatatttgcataatagcattttttaatttttttttttttgagacagtctcactctgtcacccagactggagtacagtggtgcaatcttggctgattgcaacccctgcctcccggttcaagtgattttctgcctcagcctcccgagtagctgggattacaggtgcacaccaccacaccaagctaatttttgtatttttagtagagacagggtttcaccatgttggccaggctgatctcgaactcctgacctcaagtgatctgccttcagccccactaagtgctgggattacaggtgtgagccaccgcgcccggccattttttaacttttcaaaatgttttcacttctatctggccctttttttcccattcacatagccctcgttgacagtcttgttgccttttgcctggactgttattccagcggcaactcattctcctccttccagtagtctcctggccaattgcttctactgtttaaccttccttaagttgagtttctccctctaacttgaaaaaccacacgtactgttccatattgccttccataagcttcacctgcttcagccctgcttccatgagcttcacctgcttcagccccatttccataagcttcacctgtttcagccccgcttccatgagcttcacctgcttcagccaggtttggggtgttctttattcagcagcctccacatcctccttctccgtacttctgtcctagctaggcctcccctgcagtgcccttcccttccctccataaagtccctccttcatcgtccagggtctctcccacccagtgtccctcagttcgaactgtccccagttctctgtgcaggtcacagttgaatcacaggtgtctggacatacctagccctgtctcccaaggcaggaaaacatgactgtgtcactgtatctgctggggctcctggtgtcctccagatagttgatactccatatttgtcatttcccattgaacacattgaaaccctgtgatccaggcagggtgaagagactaaggccccatgtgtttaataatgttgcacagagaattagtgattggtacggatttatagtccacgtcctctcattttgttcctctgacagcctctctgttcttccctaatttggctcaaaattactttggttggctcttaagtagaaacttatgtccttttgtacttgggggcgtgtccaaattcattaaatgaggtgggagatttttcttcttcctacctctcgctttgctgtcctgacacagctgccaccactaaaggtgctggtggggcagagagagggggcagtgggggggtggggatgcttgtgcttagatctggtcttgacatcacacgagacttcctcaggtctgctgtgtcctaagcctgacttagtatcactgcatgaatacaattctctacttacctcttttatttcaggcacttcgtcttagtaacatggccatggggaagacaaccacaggccagatagtcaatctgctgtccaatgatgtgaacaagtttgatcaggtaagctgcagctcagggatcctttttcattgcattaaacacccctctttccccttttattctttctggaggcaggggctcactctgttcacactggattgcagtggcaggatcatagctcgctgaaggcttgaactcctgggctcaagtgatgtgcgatcctcctgtctcagcctcctgattagctgtgactacaggtgtgcatcaccgtgaacagctaatttctttttttttgaattttcatgtcagatgggctattgtggaaacatcataacaaaattcaagggtggcacatctcacacaagtgcgtgaacacccgattatcatgctcatgaactacaaaaggattgctggctaatttctttttttattatttgtagagaagggatcacgccttgttgcgcaggctggtctcaagattctggcctcaagcgattctcgctaccttggcctcccaaagtgctgggattacaggtgtgaacaccatacccgcccagtatccattgtttaatacttaccttgtagcggtatcatttttccagggcattctagctgctggccatattcattttgcactaggaccacttcttttttccaattattcattcatcagaatgaactaaagcctccgctcagtgtcagggacaatgaataagacttggtttctgttctgaagaagctcactgcctgtctgggagacaaacacacaagtaaattactggagtatgtggtgggcactgtagtacaggttttcttggggtactggggagccccagggcatatgggagctgaattctgtggcagagagttctggaaaatgctcagctcatcagtgaagatagtcacgatcaagacattcttctaatgccgctggtcggattctcttgcgagtctcccagacccactctttgtttccccagaatggcttcacctgtggtgggtgcttggctttctgctttagcaggtgtaaacccactgtggccatttctgtttaggatcttgcctgttcttttccagtggatcgtttctgtactgtgttcttactggttttgcttttctggagtcctaagaacgctctgtctttttctttaaaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggtaagagaaatactgctgtgaaaaatgtcatatgtatttggtaacatccacagtcttcccaatgcttttgttcagaaacaaactaaatgccttttattatctcttccttgcatatgttgcagctcttcaggctcagccaagggggcctctgtccttatgctgaaggcaaatcttcaagggagaaaggtgaaggcattcactggctcctcccagccagcttttcaggcgctgtggcctcaataagtagagtgtccttaagcagaaatcacatatgtagaagttagttaaacatataatgaataatgataaattgaaatgtttcataggctccattctagctgcatacatctttaccgtgcttgtgttagagctgttttcacgtgtatatatgtgtgttatttttaattcagtatttccattaaattgtaagctccccaaaggcaaggtgaattttaatgatgtagttataaaatcacacagtcctagtagcatatgtgttaggaatatggttgttagctggtcgtggtggctgaagcctgtaatcccaacactttgggaggccaaggcaggtggatcacttgaggccaggagtttgagacctgcctggccaacatgacaaaactccgtctctactaaatttaaaaaattagctgggcatggtggtacacgcctgtaatcccagctacttgggaggctcaggcacgagaatcacttgaatccaggaggcagaggttgcagtgagccgatattatgccactgcactccagcctgggtgacagagtgagactctgtctcaaaaaaaaaaaaaaaaaaaaaaaaaaaaaagaaatacagcttttgatcaagagattaatgatgataaaataaattagacttgaagcaggttccaacgaattggaaatggttcattgtcaaggttgtcagctggatcgagatgagccactgttggaagtgcattgagttctttgttttatgcttttgcttatggtgtattttctacttggaccttcccctctttgccatctggagaaatagtccttgtcctttgaggccccgttcaaatgctcctggtcctctgaagcttttttttttttttttgctctcctctttcccggtggagttaacaaacagccctttcttttctgctccccagcacttcattcccattttagcactctctgaccactgtgttatcgtcaggctcgggtgcctttctgcctttcctgcccacctgtgagctcctcgaggggacagatgacatctgactcattttcatgtcttcctcagcagatattacaaattctccaaaatacttgttgagttggtatagattgttgacttcctaatcgaagtctttttctatttgtattttgagtaggacctgtctgtgttgtcggaagcaaaagcgctgtagggaaccatgtgatgcaggtccctgcctgtgcctgccgctgataagggcaggctgtgatcgctcaggctcatctcccgtgtctggttccccttaggagtaaaactgcaactttcacggatgccaggatcaggaccatgaatgaagttataactggtataaggataataaaaatgtacgcctgggaaaagtcattttcaaatcttattaccaatttgagaaagtaagtttttgtatacattgtaccatatttttgtatttttctatttgctattcttgttgatggttttagaagttttactatgttttcacattatgggaagttcagtacaatccatcccagtccccacgcttggcagttgggttaagtagaatggtagagaacgttattttcacttggtcttccatttaccatgttcttaaacagaaagcatgtatgcttcttactaatacaaaagtgaaattccaaatgtttctgaatatcccaaatcccaacaatgagtctaagatgttagtatttgagaataatggtgtttaaaataaaactataatttatattaatgtagccaaatggacaagttatagagactgggcatatctatattggaccaaactatatgaatcagtatttttcattccaaacaggcatggaaatactgttagttgtgctttgttttattagaaattttggagggggctgggcgcagtggctcatgcctgtaatccaagaactttgggaggctgaggcgggtggatcacctgaggtcaggagtttgagaccagcctggccaacatggtgaaaccctgtctctactaaaaatacaaacatttgctgggcgtggtggcacatgcctgtaatcctagctacttgagaggctgaggcaggagaatcgcttgaaccaggaggcggaggttgcagtgagctgagatcgcaccattgcctgggcgacaagagtgaaactctgtctcaaaaaacaaaatatgtattttttttttggcttttggattaaatatttgattagttgttgcattccagcacatgatacttcttatgatttcttgggtagttcctggccacctctcacctttgcacttttttgttgttgttgcccaggatggtctcaaactcctgggttcaaacaattcatccacctcagctcccaaagtgctgagattgcaggcgtgagccactttatctggttgacatcactgcttttttaaaaacctgtactctctttcaggaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccaggttggtgtcagatgccattttaaagttgtaggtgcatttgaagtagaatgatgtctccttttatttagcatcactatgttccagtgtaatgacatttaactctctcataaccaaaacgtgccgccattccagaatgttgtgtgtacttccctatcttagatagagcgcggtaaagacaatgcaagcattgtgattcatttgttggcagcaacataaacagcagtggcacagggcttttgatgtacaggtggtaactgcaggggtgattaaaatgtctaagctgtctaaaagcaggaaaagcaaatagatttcatctcttatgttaacaccaatgagaaagtagtgagtatgagttgagtatgattcttctgtgggctggaaggaaagagcttgctgggggtctctgcttcttggtcaggaagaatggcctcaacttcacttagctatccctgtttgaaaataagttctttcctctgtagatgttttccttgttaatttctgtgcatgcctttaggacctctgccatttctttcctgtccgcttttcacttttttcttactgttgatgaacctatctctgccagacttctttatttccaattggttgatttctactgccttgctccatttgtacgactgtaacaaggaccactctctgcttcccagatggacctctgtgtcctcccatcgtggaggaaacagaaggacaaaatgggcctggttagttctctccagccttctgtaaggacactaatccccttcaggagggctctgccgtagcgacctgatcacctcttagaggccccacctcttaacactgatgctggggtgaacttccaacctgtgaatttagaacaggcatgcccattcaaaccatagcatccactttacacaccatcaccttttcctaagtcgctgtcactcaattgccaggggcaaataatttatatcaccaaggtaaggtcctggcacataatgtatgctcaagtatttgtgtgtttatgaataagttgaaaattaaaataaattggctttgtgagagggcttggcaagaacttgactgtctaagcttttcaaaaatctgctttgttttattcctggttcttaatagagatggatgcccaaggacagactcgagtgaacttagctgacactggctgtgattatttttttatttttatttttttggtaggggagagaatggggtgggtgttgtcataaaagctaagattcttttttatgatgaagtttgttttttaaagatgagatcttgctgtgttacccaggctggagcatagtggctattcataggcagactcccactactgattagcaagtttgtatttcataaaaaatattacctataaaacagaccatacagggtcatttcttatccccattctttctgacaacagcttcaggtaacactgtgaagggatggtccatgcaggtcagtaacacttttttcatgtagcttttgcatcttgaaagaaagaacttaggagtatactttgaccagagtatctttctgagtgtgcaggacacctttttcagacggaagggccacatgtgtattgtgctgctgtaattctctgactgctgttgctgcccctcaccgtgattgcaggtgttggtgtgtgtaccgtggaccagggctcttggaagcctgtacatgttatttcatgttatcctcacaattgaaggagataagcattagtgtccccactttacagagaatgaaactggctcctgtaataggttaaggagtttgcctatcttagaactaggaatctgttcagaaccatgatttcttaaccatggtatgttgcctgttgtattaatctgtttttatattgctataaagaacttcctgagactgggcaatttatattggaaagaggtttaattgactcacagttcagcatagttggggagacctcaggaaactcacagtcatggcggaaggggaagcaggcactttcttcacagggtggcaggaaggagaagtgcaagcagggaaaatgccagacgcgtataaaaccatcagatctcatgagaactcactatcactagaacagcacaggggaaactgcccccatgatccgattacctccacctggtcccacccttgacacgtgaggattatggcgattacagttcaagctgagattcgggtggggacacagagccaaactgtatcacctatgttgctgccttagtatcctctggtgtgggatatttccttcagtattcttttactcatctagttgtattccaaaaaccttgaaaggttctctgtttcttgtggagtcctatttttgaaccctaggtgtagggcttacctgtgtgtgtttcccagcacatgactcgtctctgttcccactttggggtcttttgctctgtgtggctggggtgtcctcccttctgtccttgatttaagcaaatgctactaagccctccggccaggtctcaggagcctggtggtacttttgttcctgccgagcaaggccagtacggtgcagctcagcattgatggacacataatgggcaccaaatgctggatggacagaagcagcaaccttagcaaaagtctggggcccaatacagacccaaggtggcccagcctgcactagaagctagaggaaggccgagcgaggaagcagactcgagttgaatattcccagaacaccaggccttgttcaaggggggtgtgagggtccttaactctggggagctggatttttttcagagtggactggatcggagtctctgcctcgttatgtgtgtccctctgtgcatctcaaaccctcttggacttggtggacctgctcttgtaagagaggggccatgtctgacattaaatatagaccctcctggccaggcgcggtggcttacagctataatcgcagcactttgggaggccgaggtgagcggatcacttgaggtcaggagttagagaccagcttggccaacatggtgaaatcccgtctctactaaaaatataaaaattagtcaggcatggtggtacatgcctgtaatcccagctcctgagctacacgcctgtaatcccagctcctcaggaggctcaggcttgcttgaacccaaaaagtggaggttgcagtgagccgagattacgccactgcactgtagtctgggtgacagagtgaggctctgtctccaaaaaaaaaaaaaaaaagagcctcctgactggcttccaggctgtgaaacaaatggactttccttgggccatgtggagaaatagaaacagtcttacttggttaataaaattagtctgtcttcctggccattatgagataaatgaagattaagatcaagaccatggggctttatatgaacaggtaatagctggtgagtacccactaggtaacaaggaggggcccaagtgccttatgaatactcactccttttacttgtgtaactcccctatcattcccacattacagataaagaaactgaagcctgaggagggtgaatagcacctccacgttttaacagttaataaaaggctgatccggggctttagcccaggccgtcaatctgtctcagaagtgcggccaggcgcgatggctcacgtctgtaatcccagcacttttggaggcctaggtggacggatcacttgaggtcaggagttctagaccagcctggccagcatggtgaaaccccgcctctgcaaaaaataaaacaacaacaacaaaatcagctgggcatggtggcacgcacctgtaatcccagctactctggaggccaaggcacgagaattgcttgaacccgggaggtggaggttgcagtgagctgagattgcaccactgcactccagcctgggtgacagaggagactccatctcaaaaaaaaaaaaaaaaaaaaaaagtgcacattcttatccccacatgcacagcataacctgaatgcagatctcacttccatgcggcagccataaaaaataattgggcaaagagcagccccaacaggtggtatggcggggtgggacgcagaccttgggttctcaccaactctctgggccttggttttattgtctttaaataaggggattggacttagtgtctggaggtcatttcctattttgtctcacttatttagaaaaccgtctgtattagtcagagttctccagagaagcagaactgatagggcccacgtgtatgtacatgcagagagagattggtagattgattgataaaattgtctcacgcaacttggaggtgacgtaagtctgcaatctgcagggcagctggcaggccagagaccctgggaagagctgatgatgcagcttgagtctgaggaggacagtcttgaggcagaattcccttttctttgtaggtcttttttctcttaaatgccttcaactgattggatgagccccgctgacattatgtaggattttaaagtctacagatttaaatgctaatctcaactgaaaaacactttcccattgatacccagacatgtttgaccacatatctggggactgtggcctagccaagctgacacataaaattcaccatcacagtcttttttttcttttgagatgagtctcactctgtcggctaggctggagtgcagtggcacgatctcagctcactgcaacctctacttcccgggttcaagcaattctcctgcctcagcctcctgagtagttgggattacaggcgtgagccaccatgtccagctaatttttgtatttttagtagaggcaaggtttcaccacgttggccaggcaggtctcgaattcctgacctcaagtgatccacccgccttggcatcccaaagtgctgggattacaggtataagccaccgcacccggcccatcacacactctttaatcctcatctcttcttttgggctctccatacgtgactttgtcctcattttccccttattattgaagccatttgtttatagatttctttcccttcctaaactctaaacttacaaaaggcagacacagtgcctcattcatctttatattacgtatagattgcaggtgctcagaagatgtgtaagtgaagtcaacctccagcttcattacatctatgagatttggaaaatgcctaacaactgagcattattttagtgggaagtgatgactgtcgttctctgctgaattatgtcacacatcagagagtgtggcatgaaagggatcctgcagacgattttcagggaattgtggtccaatatgcagctagggaagaaatccttaggattttttatttttttcccaccaaaatgcaactcacctgtgtctaaggcttgaaattcctgttcctgtagatagatgtatgcatgtagtaaaataaaatgaccggctgggaattttacattttccagtggctaactttggcaaggtgctctgtgtccagataaaggatgcatctttgacttgggcaggaaaccttaatttcccctcatgtacatagtttctggtgggagggtgggcctagagttcagcagtagtgattttcagtaaaggagaaacaaatggccaggcatgactggtaagaaagcgttggcgctcgtatggtaaactccttcatggtggtgttgaagtcattgttggaggttttgttttgttttgtttatttgtttgttttttcttcctttagaactttgtgttttttcaacctggatggttcctgtaacccatttaaaattttgtccccaagttcatcagaattacctgatgcactgattaaaactaaattattacaccttggagattctgcttcatcaggcattggctgggtcccaatatcttttgttttgttttgttttgttttgagacggcgtctcgctctgtcaccaagctggagtgcagtggcgtgatctcagctcactgcaacctctgcctcccaggttcaagtgattctcctgcctcagcctttggagtagctgggactacaggcatgcaccaccacacccggctaacttttgtatttttagtagagactgggtttcaccacgttggccaggatagtctcagtctcttgacctcgtgatccacccgcgtcggcctcccaaagtgttgggattacagcgtgagccattgcgctcagcccaatcaatatctttagaaagtgtcctcgtgtccctgaaaatatgctgtctttgggaaaccttgccctagttgtgtgataaaaaaacgcatgaggtcaaaatatgtgtagcaaatagaaacgacgtcaggataacttaagactaaaatcatttgagaggaagcacgcagacacctgttttggtctatgctaggcttttgggggttaagtttggaatttattcattcacttagtcattgactctacaatgtaattgagcacctagcttaagctggcactgtgataaatgcttagatacaatggtaagccaatgcacagaagtccttcctgctgggaacttcctcctgggaatcatcaagtgggggttaataaataaccacgtaattaaaatcagtgctcatgtgtcattgtctttggaaggcaatatctgagatgccatgaggtgctttggtagagatgcccatgccattgtggaggtgtagtgcttcctgcgaaggctcaagaaatagcctgcagcattgtgtgcgtggtagtggagagagatggggaagggtttgggaagggaggtggcttggggcagccaggaggctgatgccctgcatttccctgggggtaattatgtgagaaagctcttaatgttcaagaaaatccacatattttcaattcaccctggctgcagcctggggaatgcattgggggcccagagtagaggcagggagatacgtcaggaggctgatgcagcaagcagtcccggaagatgatgatgggatttggactcagaccaagtagacagccttggatagatttgaaagccattgagagcatgtcctgatttgggtgtggggcaagaggagggattagtcagaaggagggatcagggctactttcgtccttatggctgcaaaatcacctgggttcactgaaatatggaatactagaagaccagatttggggatgaatttggctttgaagactgggatgctttagaactgtgcagatgtttgctacaagacccactgatggggtctgcctggttccgcctcctttcctatttctctaaaaatggaggttgtaaatgatgagtgtaatgaattgatccaatgttcactttcttccttgcctctcgtggatgtgttaatgaacaatgagaaggtgaaaaatggcatcaggagaggaggaatagttctgcccaatatactgatcggaactaagtgagtcttgaccatagatagaccagagcttggcagacacatagagtttagaaaacattgtgttgttaaatttttaaaaaatatttttatatttctattttaatttttttattatactttttctgggacacatgtgcagaacatgaaggtttgttacataggtatacatgtgccatggtggtttgctgcacccatcaacccatcatctaggttttaagccccacatgcattcagtatttgtcctaatgctctccttccccttgcccctcaccctctgacaggccctggtgtgtgatgttccccttcctgtgtccatgtgttctcattgttcaactctcacttatgagtgagaacatgcagggtttggttttctgttcctgtgttagtttgctgagaatgatggtttccagcttcatccatgtccctgtaaaggacatgaactcatccttttttatggctgcatagtattccacagtgtatatatgacacattttctttatccagtctgtcattgatgggcatttgggttggttccaagtctttgctgttgtaaatagtgctgcagtaaacatacgtgtgcatgtgtctttatagtcgaatgatttataatcctttgggtatatacccagtaatgggattgctgggtccaatggtatttctggttctagttccttgaggaattgccacgttgtctttcacagtggttgaactaatttacactcccaccaacaatgtaaaagtgttcctatttctccacatcctctccagcatctgttgtttcctgactttttaatgatcaccattctaactggtgtgagatggtatctcattgtggttttgatttgcatttctttaatgaccagtgataatgagctttttttcatatgtttgttggctgcatacatgtcttcttttgagaagtgtctgttcatatccttcgctcactttttgatggggttgttttttttcttgtaaatttgtttaagttccttgtagattctggatgttagccctctgtcacatggatagattgcaaaaattttcttccattctgtaggttgcctgttcactctgatgagagtttcttttgctgtggagaagctctttagtttaattagatcccatttgtcaattttggcttttgttgccattgtttttggtgttttagtcgtgaagtctttgccatgcctatgtcctgaatggtattacctaggctttcttctagggtttttatggtttgaggttttatatttaagtctttaatctattgtctttcttactcatacttttcaatttccttttttccatgtacagaaaatgaaggttttattgcgaagtttttaggtctaagaagttccgtctgtttttcttttattaaggaaaggattgatggtcttggcattaagcaagtccaataggattttaagagatcttatcttaacagcaaagcactgaaagtcttcaatgacttccacatccagtaaaatgtgtctctgaggttttattgttcacaaagctgcttcagtttttgccaaccgtccactctgaagtcaatctctttgacttcagttctgccgtctgatacttccccaagtgaactttctggggatgcacctcattgctgtattggcaatgtcatttcagctttttcaccctcctgagtgactagagaaagtccagctagcccctccagcatctttacaagccgttcatgtgttgagtggagtctcatttaaccactaaactattatcatgtctgtctccactcagatctgttgtttattgaccagtgctcaataggtttactgtgtgcatagttttttattttgaaggtggggaacttctgttctgacctgcacatacagaatactgaatttgatgtcttggtcgtacacttcagctaaaatcagaattttattctgtctagacaaggttaagaagatgtatatataaccttttgcttgttgctgtgctaactgacatagctgattgtttgaataatttaagccgatcatacagtctgtttatgactgtagcatgtatctgtgaagagctgaccccgtgtgcagtgcagtgttcatgcaggtgagtgtgtttgtaagtgcaggatgggggacacatctctgccctgtacataactcagtttcggtcccagctgcagccaccctgagctggttcccagcaggattagtctttgaggtgggccctcaaagacagggtgggattaatactcagggaatcaaggcaaaggctactttgggagtgtgactgtcagtgctgctgggtcatggaagagtttgaagcatggtggttattatcagaggtgttttcagaagatccttagggagtggtgtttgggaacggtttggttgtgatgggggatgctggagaagggaccagtgaaaacattgtatcagtatcacaaatgattgccggtcagtaaacttgtgaaattgggtctggtcttttttctttctttccttccttccctccctcccttcttccttccttccttccttccttccttccttccttccttccttccttccttccttccttccttccttccttccttccttccttccttccttccttccttccttccttccttccttccttccttccttccttccttccttccttccttcctcctttcctcctttcctcctttccttttattttttttgacagggtcttgcactattgcccaggctggagtgcaatgagggaggagccctcatggcctaaatacctctcaataccatcacattggccattaagtttcaccacctggattttggaggggaagttgtccaggcagcttccaaggcctggagactgtataggaagtttcctggacgttgtcactttctgttgggctgaacttaaagtcatgtggctacatctaactgtgttgggggctggagagagtggtccttgttcaaggctgctgtgcgttggctaaaaatgcacagaaaattagagcaggttttgaggagagctgacagtttttgccacatctacaaaattttggatggggtgggggtgatctaggttgtttattctgtttctaagccactgtagcttctctcactgaattatgcctaccatttgaggagcaaaagggagttttcccatatatcattatgttaggtttgttatggttaacaggactttgttttattcagttaaattgcattgtgtagttgctaactagtgtggaaaatagcaataagcgagagattggtccgttctgctgtctaggaggggacattgactaaggaaaaaagataagtgtaggtgtagcatggtggcttatgcctgtaaacccagcattttgggaggccgaggtgggtagattgcttgaggccagcagttcgagaccagcctggctaacatggtgaaaccctgtctccagtgtaaatacaaaaattagccaggcatggtggcagacacctgtaatcccagctacttgggaggctgaggctggagaatcacttgaaccggagaggcggaggctgcagcgaaccgagatcgtgccatgctttccagcctgggtgacagagtgagactctgtctcaaaataataataataacaataataataggtgattgtgaaaagaagcttataaaatatgttttaagagatagaaaccttttttcttattttggtaaagaacactgacttaagtgatagtgaattaagttgtatgtcaatttgacgtgcacgagggaggagaaggccagttgaatctaagtgactggccagagccagggctgccttcagaggctctgccctgtgtttcctgcctacccttctgggctcacttgcttcctgaaggctgggaatggccttgactttcatgttgccagcatctagcgcggggcttggcacatgatgaggattcatgaaatattcatcagatcatttccaaccaactcccgtgttcaccattagtaacacaaaagtacaacagtagaactatgcaggctgtcaatgcactcagtctcagagcagtattttcggtttatttaggaacaagtatacttgttgaaaaaaattacacagatagttcctaaaattacaaagatagttcatggccatgaactctttacatgtttatttattaaataaatatcatatgctgatgtgaaccgatactttaaatagggttggtaaaatgatctgtaggctgtataaagttttatgttacaaattccatggaagcagtgacttttgtttgtgcttttgtttctgtaatttaaacaatctgtgtttttcccattttctttagacctttttgctacttgatgagatatcacagcgcaaccgtcagctgccgtcagatggtaaaaagatggtgcatgtgcaggattttactgctttttgggataaggtaacatatccttaatgcaagatcatgactgctgaagataatgagtgacattgatttaatagagaattttgaggtgttacacatggtataaaatatggcttgcttatttactgaaactatgttacaaagattctcaaaattaggagtaagttttgcaattaatagaaagtaggtatgaaatcagacttaggtatttgacaagttgtattttatctcattttcaaaaaaccaaggaaagtgttacctcgttctaaactaaatgtcactaagtttggacattggcaacgctggattttataggattggacagactaggggtgcagcatggaatgggttaactgctgagtacattgtagattattacggagactttggggtatcagtgcacattttcagcttagcgttttcaggtcatcttattacatattgagaaagcccatgacttggatttttgccacggggttggggtggggctcccctattccaagcatctggatgttgccagctgctttggtggcagcccaaggccgaggggaggctgcaggccggcgtagcaagctccatggattcctgactgaagggtttcaccgtgtggtaagtggacaggtagttctggcaaggccacaaggatttttcaacacttggtttactcataacatttaggcaaatgggaccaacagcaggggccacccacaagaagtactgaggctcggtgcatctcctgttatccacaactccagtgccctcctcatgcttccaaggaagcagtgggctccctgcccagtgctcatagacgccactactatggcaccagcttttcatgaagagaaaggctgtattgtgagtggaatggcaaggagacaggaggcaacgctcaaatttgtcttccctagctgggggatggggcaggttttataggcagagggtaatgaggcatggtccgattgggtcttgcatgatgccagagctggacctgatcggatcctggatcatgccatgaggcgttcgcctctgaactcgttcctccttccttggtcctagcacttgggttctgcccatggttgcctgcttggttcatctgggaatgctcagattacgtaacttgcaacctgggatccatggtgactgaaaaactgtttactatgttattacacaaagttgaaccagattgggctggttctgcggttacgctcacctgagtccggggtcctctgcaaatgcacttgtctcagtctgtgttagtctggaaaacagaacacacagcatgggagagggaattttgtgcagggaattcgtttcataggtgatgaaagaaagagcacaaagggaaagcaggggtggaggaggccaccccgagatcagccacggcaggaagctgcaccccggggctggagatgatgtctgccaggagcagagcccagtggcccagctgccagcaagatttgggagcagagggcgagggtctcttctgagggtactggaacagctcaggctgcttaaaacaggtgggcagtgctggtggtgaccagctcctcccctctccgggtgctctttgtggctgaccttgcgttgtagcgtagtttgctggagccaagagccaataggcggttgagcagcactcctgcccagccccactgcctccgtcctcccctgtgggacaaatgtcaaaactctctagactccagactcttcctttctctacatgcccttggctctaagtattgcactccctgtttcatgtttgcctaattctgatgtaatttctgccatctctaccaacaaaacaataatgtgttcccagatatttagaacatcatcgcatcttgtgcacatggaaactcacacaaggtgacagtttctctttatctgctggcattcccaccctcatacactttatttatttatttatttgttttggagacagagtcttgctcttttgcctaggctggagtgcagtgctgtgatttcggctcactgtaacctctgtctcccagggtcaagtgattctcctgcctcaacctcgtgagtagctaggattacaggcacgccccaccatgcctggctaatttttgtatttttagtagagacagggtttctcccatgttggccaggctggtcttgaatttctggcctcaagtgatctgcccgccttggcctcccaaagtgctgggattgcaggcatgagccaccgtgcccagctctaatacacttcaagcattgacagacagctctgtgaacatcccactagaaaaaagcactctaggtgaatgctgttgagctagaggaaggcactgaggtagctaccacacactgtgtaggtcccatttgcaaatttcttttgtaccaaaccctgcgatattgtaaaatggtctgttttgttgtttttcggttcctagataacattgacagctgcattgtaaacagaacactccatcctgttttctggccttgtcttggggtgattttgcctcacactggcagggattattagggaggtcctgcggctgagagggtgctggggtgggaggaggggcacagacacgggcttctggagagaagctgcagaggaaagaagggtgtgctgggctgggatttcggagaaagacagagaccccagcagcagtcctgctggatagaccagcaggtattggagggaaggtcttctcaccagcctaggtctcatttataaaacaggggcttgggctgaagctgtaaagtctgtggccccgtgagagcctgtgactctccatggggaagggatttgcttctgctttcttcactgctctggccccagggcccacagagtgggggctcagtctgcctgccttagtgtgtcttggagcctggggaggtcccagagggaatgggcctagccttctgagctgtcgagtgctgcccccttctggctgcagcccaccagtgctgggtcccaggcctcccggcggggcagaaacctgctctaagaaccagggccttgatgggaagctgggttttgcatgtggctcactcttttgcagccaaaactgaataaaaagaagtaaaatcagaagtagttgttaggaaagagacacactgcaaaggaggggaaagggacaggttgaccggttgtgttttttcatccttttgtaatcacagaaataagtaggtttcagttgtcttaagagacagatgttacttaatcaggaatacagagtagacccgttacattttagaggaggaacaccttatatagtaaggcgaagtcaagcaagactttgtgaatttgtgacaagtttgcacttaaaatcgtgtaaatatgtcacattttgtttaacgttatttttccaagtgtttaggtaatgtattacttttttaaaaaagaaatagttgttaggcatgtatgaaggagtaaagaaacctattctgggtggttgttatataattcctatgaaatctggggctaatttctttgtgcttaaaagggatcatgatcgttttggtctgcggccatcctatgatgtggtatgggacacataaggggtcagttttcatacacacatattttagcatttgaccatttatagaaatatttgtgattattcggatatgtgaccattaagtcgtttccaggtaaatttttcattttgaaggttatcttgatctcttattcccccaccgtgctttctgtcttttgggcattttactaattgcacatgcccgcttgagatgtggagaggggttgatgagtaactgtgggctgcgccagctcagtgtctttaggttttgggttggttgactccatgcgtgcttccctcttccatcatcccaggggtgttccacccttcagggacgccagattcattttgaagaatccttttctagagttgaggaggctgcattgcctttgattcattcttgatcatttttctatgatatggatgagcatttaccaaagtgtgtcgtgcagaagaatagccacttccgaaaggatttgggacttgaataaatttgctaaatgcctacccaccagacatgcatggtcaagtctctccaatctatccacgagaaattcagacgaagattataaatgtgctgcttaaacccctttaggattcctcccaaattgtagctgtttttactttacttaacagtatcaatttttgtctactagtgttgatgtctgggtttggacaaaagttcttagagttggcagtttttacggttgaggttctatactctgaatttaaaaccattcctctctttatttgtaccaactgacttttgcttttttaaaagatagataattcaaagtactgattgtccttgtatgagaagaggaaacctcctcattttggtttatcatgctctggtaaactatccctatcatgctctggtaaactatcccttctccctgatacacacttaatcctctcaattgaaaatatttagaagctctttgtaaaagtaatgaatttgatttggtctcctaaataataaactgcaaaataacatttttttgagacaaggtcttactgtgtcacccgggttagagtgcagtggtgcaatcttggctcactgcaacctcagcctccggtgctcaagggatcctcctgcctcatcctcctgagtagctgggactatggcacacaccatgcctggctgatttttttttctttaagagatggtttctcactatgttgccccagcttgtcttgaactcctaggctcaagtgatcctcccacctccatctcccaaaatgttgggattacaggcatgaaccagtccgtaccctgcctaaaacaacttttttttttttaacattagcagtgattgataattttgttaacatttagtatatgtaaaaacatgcatatactcctgaatctttttatcatagaatttatagattgtttaggaacattatttctgataccctaatgagtacttcatcccttcctccctttgtgctggattgaatgctgtggtgggtacctcagtgtttatagtagaactactatgctgtccctattttcccaggatgggtaacacaagctgcaggtgtaacactgagactttcactttgacctatgaacatacacttaatttcattattcttcagtttttggttattgttaaattagagctcttggttacagggttgaccaccatttgtagaagttcatttgccaagagtgactttatagtataaagtgccttctggctggctgggcataactgaggttcatgctttatcaagtgaaaatggaaagattagtggagatttcaagtcatccattagccaaggactgggcatgccatgtactcatgctgccaccttgtggaggttaatgaaatagaatattaaaaccaagggacagaatgaaaatttacaaatggttgaaaagctcccatactgaatattatattaagaatattgccgggcgcggtggctcacgcctgtaatcccagcactttgggaggccgaggcgggcggatcacgaggtcaggagatcgagaccacggtgaaaccccgtctctactaaaaatacaaaaaattagctgggcgcagtggcaggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaaaagaatattgttttaaatgagaacacatggacacagggaggggaacattacacatacggggcttgtcggtgggtggggggcaaggggagggagagcattaggacaaatacataatgcatgcagggcttaaaacctagatgacaggttgacaggtgcagcaaaccaccatggcacatgtatacctatgtaacaaacctgcacgttctgcgcatgtatcctagaacttaaagtaaaaaatatatatatattgttttagtaagttagcatgagttttcatttcaagaagcttgtcttgtcatttttactatctaaattttgtggaagtctggagctgtgttcacatgaaaatctggtaaaagggaatgggccttccttaagtactgaagactccaaactgtgtaaaaccccaccaaaaaaatatgattgtatgaaaaggactctaggatacaatatcttaaaataggaaggagaaagatttgggttatgttcatgtatcaatgactgttgtattgttttcttctctttttgaagtgatttgtgtgactttattgaaatgggcacattttataaactttaatttgtaggcatcagagaccccaactctacaaggcctttcctttactgtcagacctggcgaattgttagctgtggtcggccccgtgggagcagggaaggtgagttagaatggcttttggcagcttgttgcaaccccacttatcatattaacttcgtgggtttgagcccaaggctacgtgtaacacaattttgaactgggtacacttggcacggcatttctcagtgcatggaacattcgttttgcaagaagggtcacatgaccaaataaatgtggacaatgcatatcatgtttcccttggttcttcaagttgagcaattgggaactcctagaagttggacatctccatgaaagaaattatttatgtgaccactatgcaggatggattgactaagaaagtgggaacttctttttgtcagaggggaccctagatgctacaagacatctggaggttatgaaggcttgtctgaaaagctttaaacatgttttgatatgacttctccaagtcacatgaacacacatttaataaacctgtagccaggtgtatagtcctgtgttaggagtaaaagatacacctgtaatcaagacccagacgccactgccctccagaagtttctggtatctggggtgagacagatatacaaacaggtgatttcagttcagtgtcgtaagtgctctgatagtggggggcacagacacgtcatgtctgtgcattgtagaagatgtgaaggaaacgtgcgtacagacttagtctcatatattctaaagcaacgcaataaatctagttgtaggtgtataacaaatagggtggtttaacaattgaagtttgctcttcagagacacgattcttgggtatttaaaaataaaagtccttcctagtgcacaggatttattatttatttttatttattcattcatttattcacgtatgtatgtatatttagtttttgagacatggtctcgctctgtcacccaggctggagtgcagtggcgtgatctagagtcactgcaacctccatttccctaggttcaagtgattctcatgcctcagcctcccaagtagctgggattacaggcgtgccaccatgcccggctaatgtttgtagttttagtagagatggggtttcaccatgttggccaggctggtctcgaactcctggcctcaagtcatccacccgcctcggcctcccaaagtgctgggattacaggcgtgagccactgcacctggccaggatatgttatttacatacagcatttctaggattagttctttgtcaaaaaagatacccgcatgcaggaacaatgcattcagtattggatatatgaactatatatgtcatgcttggctactctgttgctgtaaacattcttagttgatctttgttccgtgtaccatttcatttaggggcatgaaactcatttagggaaactcattagggcagagtagattgttacactctattttgttaatattccttataaactactagtttatgtggaccattatgttatttccaatttttaatcacaacttcctgtgctcttttaaatgaatgaatggtgtttttcaagctcccagggctgggcaaggctgcattgcagtggcttattcttgtctcgagtgttgactgaacatgtgcttttttacaatctgtttcagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggtgagtgatgacttttggatttcatgtactcgaatgtccagtaatactagtgttcacttgaacaacaaggtttattaacttttttttaatttttaaagacctttgaatgttatttaatactttaaggcggtcctcccagtaaataaacacacacacgctctgtccttttacgtctgatgcgaaaatgatgtttacagggtgaatttcgggggtttggttggttttgtgaagttttatttacttttaacttttctttttttcaaaatggacaattataaaaatttgcaaaagtggagagaagggtgtcttgaacctgcctgtacccattgctcaagttcaagtgcgatcaacttgtagccaattcaactccgtctctcccctggccctctgctagctccacccccaacccagattcttctgatgcatacccttggcctcaattgtattttatctgtaattgtattttatctgtaataccttattacttatctctagaagataagaacacttttgaaaaaaaattacatctcactcaagaaaaaaaatcaccagaatttcttgctatcatcaaccggctaggcagagattacagtgctttagtatctcattacccattggtttgcgtcagactccggaagatgtctgcaccgtgcacttggctgatgtttcctgcttgggtccctctcaaaccacaggtttccttctccactccctttaaaaaagaaaatttgtttcagtagattttggggtacgggtggtttttggttacatggataaatttacagtgcaatttattatttaaaggaaactgttttaaaatttatttttcattgtgtatcatttcaccaagagagtgattgttttcagaaaagatgaagtgtttgattgtacactgaggttttcataaacctggtggatagttgatgaaaactgagcatacttaatagagggctataagttctagaagatagaaaaaatggtaaatactgataaatactatgttaccttctttgggccataaaaatcagtgaataatggcattaaagggctctccccaggccctgtgcagtgtggcctggacatcctactgttcttttatgctgtctggaaaaggccgccacagactgtcacaggtgtgatgcagaaggcttccagccaggtttgtgaggaatgagtaattttgcttgaacaatggctggaatatcagagtctgtcaatcaggtgagtagtatttgctggcgatttggatagagaaatcattgcttgtttaatgggctgtttcttcatcctggactattgttaatgagagatgatgcattttcggaaatgacattaagttagcagtaatgagctagatttttattgaatagtatacactatataggaaaagatgcgctaaggcaagctcctagttattcagatcctaccaggtcttatttttttttctctgtctcacacgctcacacatatgcacacacaaagctgtgtaaagttttaatcttttgccatgatttcccagtgcctttgctattgctatcctcattttgtttatttttctgatattgctagcctcgcttttttaaagtaaaattttcattttattcaaagtttgtacagaattgctaacatttccctaaaataattactatacttcagcttgtcctgctctggtgtccccccactgtcccctgcttccctgaagatccattttagagaaattttgcagaaatatagggtcaaagtaggagaatatacaaggtgatttcagtgtgttgcagtgagtggagtgtatcatgttttagggagttgagaaacagatggcaaattttgctagttttcccccactggtagttacagttgataaccaagaaactgctgatggaccaggccccggagataggaaagatggtacgccatttttcaatggaagggtggcacttggcaacctgggccttgtctttcagctcttttcttccatcatttctctatgacaggttagaagtgaggtccttgggaccaacacagggctttcttgggaaggctttgttgctctttacctactaatctgtcagtttggagataacctactagtaaactctagaatttaagaatgatttgttcaagactgtggtttcaagagttgaatgttgcttctggctggtaaagtggagggttggagagataaaatgactcacttgaacatttgcagttcaagttcaaagccatacctgcctagctccagattccattttcccctctgccaggcacctctcagttgggggtgtttataaggtagaaaactattttaacaattaggtgattgataaaaaggtagaatgtgggacaaaatgtttttcaagccttccctttttacctgttcagcttctgatacccacatgagactccaggtcccaggtcacccagctctgccttgctccttcccacatcagaaagtctctgggggaaagtgggggttaggacagtggctgccattcagcctcttccgtagccacctttgaggactggcccagtaactcggatagtgtcccaggcacctgcgggcttctgcgtggcaggcagactccagtggcaatggggtcccctcagggctgggctgcatggcgacttcttggttccttcctggatgtgtgtaagcatggactgctggccccctgtgcatggttccatcctcggtaggacggtgggcctccggtggtggagaagtcgaacagagcaggagtctggcccagctttgtcatttgctcgctgtcactttgggttttttttgagatggagtctcgctctgtcacccaggctggagtctaatggtgtaatctcgcctcattgcaacctccgcctcccaggctccagtgattctcctgcctcagcctcctgagtaactggggtcacaggtgtgcgccaccatgcctggctaatttttttgtacttttagtagagatggggttttgctgtgttgaccagctggtcttgaactcttgacctcaagtgatccacctgcttttgcttcccaaaatgctgggattatttgcatgagccactgcgcacgaccagctcggtgtccactttggacttgtcacattacttgccttgggcttttgatgtctctgctgagaaataaggacatgggatgagatggtttccaagaaattttgctaccattctcaaatgccatttatgactgtttagcaggggactggaagaaaccagggatcctcttaatgagttatgagatcatttgccgactccttttcaaatccacgtgtcaatggtgggtgttagatggccatagagaatagcaatactggaattattctggcttgtaggtacagagattgcatgtgtaatcaaaacctgctggacagaaatggtcctgagcgtctctgggtgtttggcctctgtttcatttcttattaaatgggggagatacagcaggattataaagactgcaggcaatgtctgtaaaatgcaaacatgccaggtttttggtaaatagtagctgttgcccttttctctaaatcagttaataagataaataaaagattttgccttatatagttcctcattcccctcctggccaccctcccccgcaaaaaaaaaaaaaaaagtcctagaggaaaaaataggaactaacaagatttctcagatatgttgatagcaactagatatattgtactagatacagttgaagtaaatttataagttcatcgagctaaaaatatatttgagataaaataataagataggaagtagtaattcacatttagcagtattgctttaggctaattatttattcaaagagatatcgtagcaaatgacaggacatacctcaggaaacaacatactaatgttagatactttagtgggtagtagttaaaatccgaggccttggggtcagacagctctgggattgagtctcagttcctcttcagtaggtgtgtgattttagctaatcgtctgaaccttagaaagcctcagttttgtcatctgtaaaatagagataataaactattcacctcataggctattgtgaggataagatttgatcatgaacttaaagcatctgattactaggcacataacaggccttcttaattataagagccaccaattttgggtaaaatcacatgaaatgtgacatgcttgaaagaatgtatctgagtatataacttccattatttgaattgatatttatatagggtttctatacatagtacagtaaataagagaataataaaaatattgttaccctaatagatgcaatgtattaatattatgtcaccctttgcatagtttcttttaatccttgagcacttttaagcagtgtgtatccaaaaaggcatggaattgataaattggagtttaatgtttttctatatagctcacttgactctacaaacccctttggtgtacccactatcttataatttcttctcatatttgccacattcctgccaacttggacattttctttttagattgccttgacaatcataaaataactgttgttatgcctttttgttgttgttgttaatctctcagttgggagaaccatatcactccttagtgacataataggaaataaatgctgagggcccggcgtggtggctcaaacctgtaatcccagtactttgggtagctgaggtgggaggattgcttgaggccaggagtatgagaccagcctaggcaacatagcaagaccctgtctttttttttaaagctgagtacaaaagggatacaatgaggtgaatctaactagggtgactaaatgaactgatagtgctgtatatggatagagagacttcgagttctgagttgtttcagtattgcctttaagtaacttctagcaagcacttggggaagcatgatatgaaagggcaacaggctgtgaactgagatgagcttggttcagactccagccttcctttattaactgagagtcctcagtccagttacgtgctctcacttcatctcagtctcctcatctgtgaagtgtggtcactacttacttggcaggttgtcatgaaggttagagataacaccaggcatcaggaacagtggttggtgcatagctcttacatccaggagctgacctgtggagcaagaagctgagtacacacataaacattaagaggcagaatatggcaggtccttcctaagaaatataaacaaagccttaggaacctagaagagagagtgatgttttctgattgggggactgcaggttagtttcatagaagagtttgagctgggccctgaaagaagaataggatgttgataagctatgacaggaagggccattccaaatggaagcaaggtgtggcccaaagctggagagccctgctctctgactctggggcctcttcttgtgctggggcctcaggcctggcccctgtgaccatccccatagtgtcctcagtggtctttctgcctttagtgtcaccatggttgatgtgcacatggtaggattctggttagatggcgtcaaacccacatagccacgtcatggtttttctctagtttctgtgtctgcatttcagtaaaggtggtggtagattaaataattggttaattttactgagtggtacctaacgtgcatgagataccttcctcccattgggagcacttctgctttctgctcaactgtttccctttagccaaactagaaaatcatggctaggaaattagcctgactcagattgtacttcagatcctttgaaatattttccctgtctgaggcgtgtccataaatagtttgccaagtcaacaacactcaaggtcgttgtagtactcaaagtgctactaccaggcatggggagagagctccttccctattccctgtctgcatgaaatgagacagatatttttagtgtcttttctagaaaatggctaagattgctctgctacaacttgatgctattttgagaatgaaaacaaaacaatgtaaaatcaaggcacagaaacttaacacattatataaagaccatcagcaatggaatgaggccaagtaaacaatgtgtgtttgtgtttgtgtggaaggctgggaccctgtcttaaaatggtgcattgtctttttatgaaaactgaaaggaagagatagtgttaactggtgcattgtctttttttttttgagatggagtttcactcttgttgcccaggctggagtgcaatggtgcgatctcgctcactgcaacctttgcctcccaggttcaagcgattctcctgccttagcctctcaagtagctgggattacaggcatgcacccccatgcctggctaattttgtatgtttagtagagacggagtttcaccatgttggccaggctggtcttgaactcctgacctcaggtgatccacccgtgtcggcctcccaaattgctgggattacaggcgtgagccaccgtgcctggccgcgttgtctttttatgaaaactgaaaggaagagatagtgtaacttctgagctcaacaaagagataacgtgaaataatgaattttcataatggggcacttgctacctttcatttgatgccatctggttcagattggagtattaggggactcctgtgtgtcttagtgggctgccagggagtgggttccaatggaaatactgtttttttccatttggtgatgtactttatttagtgggattcatgctatgaatggggtcctgctgttggtttgatcagaaaatatgtcatagtcatcaatagcaaatgataatgaactcagatccttttttcacttagagagttcatacccttactttagattgttccggcattctatgagtttattaattcttgtttctccaggatattttgtaaaagagataaaatgagaacttagggaggtcagaggatttgcttgtcatggagatctcaatgtgccatttgctttgtctccccggctttgtcagagtagagacaaagaaatgacaccttgatctgtaagagggctatctctgtagtgtcctaggttgatgcttatgcagctcagtcaatacccagcgatgttctccacaccttttgtctatgctaggatctgtctagtgataattataggccatccaagtaaagatttctaatgtaatgtcctgtaacttaaacctgatcattatcctgttattttcagggatgttcttgtcatgttttttaaaaaaagtattatgctttgtcaacttatttcttaaataatttttaaatataactttggttggatcctcaaataaaaacttgttttccttcctagcttttgttttttggggtcttgcatggagccagagtctacttagtgcaaccagtctgtgcagtgtctcatgagcactctgctcctttccctttggcttttcctgactgggctgctctttctgctcttattctttgcagttttttttctgtcagtctattgtgatgccttaagcatcactgtgaagatggggcgggtgttatcccttctctgagaatggaaagctgaggcaaaagtcgcaaaatggcttgtgaagacacagttgttccttagtaagtcccgtggctttatgctgacagccctcacggttgggtctccagcacagacctccagactcacttatccagccgcaagtcaggatagccggtcagcatttcagtttggccataatcaaccttttgattttatctcttgaatctgcgtccctcatttcccccagctcagtaaatggtaaccctgttcttcccttgtcttacaccaaaaccaatgcagtcctcctctttttctatcacaacacaaacccatctcatcagcagatcctataggtgctacctttaaaatttgttcagcacatgaccactgatgttcacttccttgttccccactccggtcccggctactgttgtttcttgtctcaattattgccttgatcagatcatgtccttcctcctatttccctgggtgtgagcccttggcttctcttgcctctgtctctgccctcccctgccatcatcctgtgctcgcagttccgtgtgcatccatattgctcttctgtgaacaccttgggcacgtatcaccccatgggttttgtgcttgctcattcctctatggagcactcttcctgcactctgtgccagccagtccatcccctgacaggtctctgctcagaccccctcgatcagagcccttgttgacctccctatataaagtggactttccctctgtcactctgtctccctaagccagcttccttctccttcttagcacttatcacctcttacatttgtgtcaatcttttattgtcaggtcactcactgtggaaactctttcgctgctgaattcacaaggagttgctgctcaaaaaatttctgttaaaatggctcagtgcataaatgctatgaaaagctacagcattaaaatagataacgtgccctgactgtgtatttgataggttcaaacttacaatttagttactatgaaatatttccattgctgttgatcaaatacatgtaaatttctgaagaactaatgtgcaaagtttaggataactttggaagaacacaaagaacagaggaagaacatgttttaagtctctttttccccccttctttcctttgtccatacaggatttacagctgttggaggatggtgatctgactgtgataggagatcggggaaccacgctgagtggagggcagaaagcacgggtaaaccttgcaaggtaagttgcatttcagcagccactatgccggtgtcttttgataccttccagtggtggtgagcacataggacctgcttactgtgtattgcgtcctgtgtgaagcaccttcttgggttattctgttggcatttgaatgaacatcccagttgttgaaagttgtcatgttcctgggtgagagtctgatacctctttgtattttctagagcagtgtatcaagatgctgacatctatctcctggacgatcctctcagtgcagtagatgcggaagttagcagacacttgttcgaactgtgagtgtgtttgtgtcttaagtcatttctgcttttccagagccatttcgagttggctcaggaaagcctttatggctttcagctcatcctactctggtgtccgctcccctccccacactgtcccctgcttccctgaagatccattttagagaaattttgcagaaatacaaggtcaaggtaggaaaatacacaaagtgatttcagtgtgttgcagtgagtggagtgtatcatgttttagggagttgagaaacagatggcaaattttgcaagttttcccctactagtaattacagttgataaccaagaaactgctgatggaccaggccccggagataggaaagatggtactccatttttcaatggaagggtggcacttggcaacctgagccttgtctttcagctcttttcctccatcatttctctatgacaggttagaagtgacgtccttgggaccaacatagggctttcttgggaaggctttgttgctctttacatactaatctgtcagtttggagataacctactagtaaaatctagaatttaagaatgatttgctccatagtagactgtggtttcaagaatctaatgttgcttcatggattcttaccagagtgaacacttaaaacccacaggcatgtaggcctggcttgcctttgaaactagttgtctagaatctggcttccctcccaactcttacgtggtgtttctgggattttctttctttggctcttgcttagacactgagccatggaggtagaactactctggaatcttttctgtatattctataaactcatgtgtgccgactgacacttcctacatagtctagactggcctttttgaaagcattgtgaactggttttgccaaaacagcactcacatctgccccacagtcagcttcctgtttttcgccttgttaaagtcagtgagcctttcccactcattgtaacccttctgcgcacactgaggtagatgctcctgcagatgctactgcatgaaacatcttcgcttgcagaggagggcagtcagccacagagaagataagcacccatgctgggctgagtgagagagagacaagttcagatttcattcttgcccataaggaatttgtctctgcatggatcaagactaagtgcatgggaaaagttcaacagaccccaaggcttaggggatttcaatataggacaatctattttattattattttttttttagataggatctcgctctgttgcccaggctggagtgcagtggtgcattctcagctcactgcagcctcgacctcctgggttcaagagattctcctgcctcagcctcccgggtagctgtgactacaggctagcaccaccatgcccagctcattcagtgtttttttgaagagagggggctttgccatgttgtctaggctggtctccctatgttgcccaggctggtctcgaactcctgggctcaagggatccaccccccccccccccccccccctgccctcggcttcctggagtgctgagattacaggtgtgagcccctacacctggcatacgacaatctttttttttaaatggaagaagtgggcagcagagattggaaaggtcactgagggccgggcttggctggaagtagcctgtggtcctgcaggctggtaagggtttgtggtggctgagagtaggattcaattcctttgaaagaaatagtagaagcagaggtgtgcagacgggaaggagtgaggcctgtgggaaggacagcaggcaggcacctgttcctgtggtgggggatagagaaggtaccgtgagagaaagctctggaagtcctgtgttggccagccagggctgccctcacaaaatgccacaggctggggggcttccacagcggcaggttgtttctgcagagttctggagactgcatgtgtgagatcaatgcatctgcaggtgcagctcctcccgagggctttcttggcctgctgatggctgccttctcacccttttctccttgtgtctctgtatccaaatctcctcttcctgaaaagacaccagtcagattagagtagggcccaccctcatggcctcattttagtgtaattacttctctaaaggttctgtgttggccgggcactgtggcccatgcctgtaatcccagcactttgggaagccgaggcaggcagatcacctgaggagttcgagaccagcctggccaacgttgtgaaaccccatctctactaaaaatacaaaaatcagtggtggatggtggcgggtgcctgtaatcccagctactctggaggctgaggcaggagaattgcttgaacccaggaggtggaggttgcagtgagccgagatagcgccattgcactccagcctggatgacgagtgagattctgtctcaaaaataataataataaaaaaaaaattttaaaaaaggttctctgttcaatttctaaggtgctagggtgagggctggaacataggaactttgaggggagcatggttcagtccataacaagtcctggatagcaaagtggatagcgagtcggctgtgtgagagtaactcatctctgggctctggattccaggggtttggacatgaagtcatccactgagcatggggctctacgtgggttcctgaacgtttacccaccagagtgcgtatgcaaaatgtgcctggtatgggatgatgaagtggatgtgtatgatggtgatggttgcacaatggtgtgtatgtacttagcgcgaccaagctatacaattaaaaatggtgtaaatggtaaatgttatgtcttgtctatttttccacaaccaaaaaaaacgtggatggcagcattgaatctttctgaatgcagagtgcaggataagctggcacttggcattgccgcagcagtctgatcagagcctcgtttcctgctccctcctcattgtgccttgatgaattttccatttcgccgagaagggcctctgtggcttgcttgagtcttgcgcgaggccccaccagttctttatcactcaaacaacaattcccggtgggacgctgtttagagtcgccgcggggaaggaggaaggtattttcattgctgagtatcagtgtgcgtatcgcacaagctccctcagattttcatttgaacacaggaggtatttataaagtcctcttgcacctttaaggattaatgactttggatatatgcttgttagaagcaagcttgttaaaattgttgtttgctaatcagaatcacattctttggggaaacttagggcagggagcacgaatgcaatttaggaaatcactcagcagcaactggagaatgttctcaacgagttagaaaattggattgaacaatatgctatgaaagatggcggttgtgttgaagcttagaaatgtgaagtgttttgtattaaaagtgaatgaattacgcttctatttgccattaacagttttacttcaatcatgaatatatatcgagagttgttaagagttgtgttttacaactatatgttgcaaacactaagtggattttatcacatacaaaaagtgagggtcacttagattaaaggatgctaatccaatttgttgcctgctatagatgtggttgtgttctagaaagcctcaaattctcagacccctgcctctttgagtctcctaatcagatctcccacactgttgcctacctatttgtcttagtccattcaggctgctgattcaaaatagcataaactaggtactccatataaacaatagaaaattgtttctacagttctggaggacaagattcaagatcaaggcgccagcagttttggtgcctggagagggctcacgctctggttcatagacagctgtcttgtcactgtggaaggggtacggcagcttccctgggctggccccttctactaataccatttgtgttggcagattctcatgaaataggcctcacctcctaataccattacattggtgattagggttcagtaggaatttggggagggccacaaacattcaggcacagcactagttcaccttccctctttcaggtcctctaggactcccctacttttaagctacagttctaagtcctcgaatggcaaattgccctttgcagtctgccccattcacctttccaacccttgccatgcaagaccagtcctccagccatgcacacttctttggggtgcctggaaggaggtgtgaatttctcacgtctgcctgtctgtaagggtatttttcctgccgttggacaaccagggatagtttgcctgggcaaaagagaaaaatgaaagacacagatcctacctcctgcctttctcttctgctcctcggagggcatggcgctttctctgtcttcccacagccctcaatgagctgctcttgatccacctatgtgttcttccctccagcccccgcactagactgcgaatgcatgaaggtgcctttgcacagcgcatttgtgccccgggaccattgcacctgctgtatctgccaggaatgcttcccccagatagtctcatggctcatacatcacctccttgcagagaggactttcctggccactccctctaaagtacaacctttgcctggctgtctcttcatggtttactttactatccaatagtgtgttttctgtgtttgtgtagtgagtgtccctacacgactcagggtgttgtctgtttgcttgaccagtggatgtatcctcatcacttagagtagtccctggtacttcgtcagtgctcagcaaatgtatcttaactgaatgaatgaaggtagtgactgtatctgtccctctctccctccctccatcccttccttccttttttgacagagttttgccctgtcacccaggctgaagtgcaatggcatgatcacggcccactgcaacttctacctcctgggctcaagtgatcctcccgagtagctgggactacaagtgcacaccaccactcctggctaagtttcgtgtttttttgtagagatgggatctctccatgttgcccagactggcctttaactcctgggttcaaaagatcctcctgccttaacctcccaaagtgctgggattataggtgtgagccactgcaccaactgactatatctttctcacttgtgtcacctccaacattgtatgtgtcagctcttaatgttgtcttttttttttttttttcctttttgaggcagagtctcgctctgttgcccaggctggagtgcagtggcatgatcttggatcactgcaggcctcctgggttccagcaattcttgtgcctcagccagccgagtagctgggattacaggcatgggtgaccacatccagctaatttttgtatttttagtggagatgggatttcaccgtgttgcttgaactcccgacctcaagtgatctgtctgcctcagccttccaaagtgctggaattataggcgtgagcccccgtggctggcctcttaatgtagtctttatgtaggattagagttaaatagctcattgctacatcaatcacttattatttgtttgttttatggcatgactggaagatttttactcttaataatttggaaagtattttttgagatttgcctaagaagcataatttagaaaaaatttcaagccatcaattacaatgttagtgtaattatttctattatctcatctacaatggaagatgttaggaagaaaacattttgaaacctttgagttggctgatactggacatagcacccatcagatttgatcattaacatctccctttagatatgtatataaaaggactaatggcagccaatcttgatataaagggaaacagtttcattaaaagctttagtactaaacctgaagaggggtataagtactaaacctgaagaggtatactagattgaacaacttagttttgaaataagccaaactaagatatgtgaaaggggaaaaaataatccttttggacgtaaaggatgaagtgatagtttacatatctgcagtctggagttgtggttctgatcacaggcactgtctctaaaatacttgcttatgacttctcagtcctgaatttctaaaagcagtggctgcatatgaggaagactggaggacagggctaacacttattgagcatgagttatgttcttggcccttgttacagattaatgcttttcttttctttttcttttttttttttctcctttttttctttttgagacagggtcttactctgtcaaccaggctggagtgcagtggtgtgatgacggctcactgtagcctcacctcctgggctcaagtgattctcccaccttagcctcccttctagctgggactacaggtgtgtgccaccacacccggctaattttttttttttgtagctcccaggagtctacgtttacaatgtaggagaactttgagtgggtaccgtagaaaacaaacaaacgtcagaaaacttgatggttgaatactgaggtgggtcttatctttgagccatatggtttggactgtttggattctgtttttccattttcttattcagactgtttaggactaatgagagaagttttgcttcctggatgagaccaagaatactgtggagagtcacatgtcactagcatttgttttcgtatctagtattatttttgaagaagagtctggaaaatgcactctggcaaaggttaccaagaatctaagcctttttgcggggggtggagggggggcgttgatatgtgcattataaattatcatctaagaaaccgtccaagaaaaatgccgcgtcgttacgtgacctcgatctttctttctcccctgcaatcctacacggcaataaaataattagtgttttagttaagtcaaatttttgaatgtctatgttaaactaagttttaggaaaaaaaattacacttattgcctccttcccagaaaacttttgaggatttcaccacagcaaggctcgtatttgctgctagtggttttgaggacctagccggctttattggcttatatttgtatttagtttgtatttaacctctagatctttgactactgtgttgtctttgactacggtttcaaaatgtatgtttttcaatgtggagcaccccattcatgcattttttcaccctgtgccttttacatttataggtgtatttgtcaaattttgcatgagaagatcacaattttagtgactcatcagttgcagtacctcaaagctgcaagtcagattctgatattgaaagatgtaagtagtttctagaggtctcccgaacttgcaagtacttgggtgtgttgaatccccttcttcttcctccatttcatgttcctttcttctcagagctgggattcatgtttttaagtattaactcaaaagacttgtagaaatgtcattattacatgctaaaccatattaccgtaaagtatgtaaaattgctacctcaaggttactacattgttaaagaaaatgatgctgttttaatttagaactttttgtttacctcttccatgacttaattcaaattgtattatttggaaattacagactctaagacctgtttgtatccctttaattgtcatgcatagtttggctaaagatcctcttctattaatagcagaaatggctgggcacagtgactcaggcctgtaatcccagcactttgggaggccgaggcaggcagatcacctgacgtcaggagttcaagaccagcctgtctaacacggtgaaaccccgtctctactaaaaatacaaaaaattagcccagcatgatggtgcacacttgtagtcccagctactcaggaggctgaggcaggggaatcacttgaacccgggaggcggaggttgtagtgagccgagatcatgccgttgcactccagcctgggctacagagtgagactctgtctcaaaaaaataaaaattaaaaaataataataatagcagcaacacagttggataactgagcaacccctagtcacagcacccactttcctggaatagccagcagttagtgtcactgcacaggaatttttgagtgcctgatatgtgtgagagctggtatagctataagtaagacaaagtccttgccatcgtcgggctgacattcttcctggagatagatgcaaggaaggaaatggaggggtggggttgcctcgctgggacttgaggtacagtgacgtgaaggtgctgaccatgcggtcacctggggagggcatctgaggcaggggactggcagtggggtcctaaagctggaagttacctggtgcatttacaggaacatcagggaggagcagagcaagccagggagagcctggagaaaggtgggctcagagcagttgtcagaggccctggaactaggacagaggctactggacagtccagagcagtggagtgacatggtttgatctgtgattttaagagatcctctttgttgttggctggaggagctacagcagaagtaatttgaagtcttagtggttcacaagacagaaataaggggttggtctagtgtgtcagtttcctagggctgccagaacaaagtgccacacattaggcagcttacaacaacagaaatgtattgtctcactgttctgaggctgcaagtccaaaatcaaggtgtccgcagggccgcgctctctgaaggcttcaggggagaatccttcctcgcctctcccactttctggggttttgctggcactcactgttgatccttggctggcagtgcagcccttcagtctctgcctctgttgtcacatggcattgtcgctgtgtctctctggctttcttcctataaggacatcagtcactggacctagggcccaccctactccagtatgacctcatcttgtcttgattgtatctgcaaaaatccagttttgaaaaaaaaggccacattcacaggtaacaggatttaggactcgaacatatctttttagggggtcatggtcaccattcaacctataagagctagcgtggccggggacatggaggttagtgagaacttctcagcccagcggtggtttcatgcagcactccttggcttgttgcctcttgcctcagtaccctggtccttaacccttctctgttccaggccctggtcaaattcctgattgtgggtctgaaacccgcttagtgtcttcaaatgttttaatgtttctcctcctgcaatttcttaataaaacgatggaaataacaaaaacgagtgttaattatattttataagatctgtgtgcaccgttctccaagggagataaatttcacattattgcaacaaacggggtatataatgatagcaaagctcttgcaagtcttgtgtgtaagcccctccttgctgcctaaagaacagtgaggaatctgtccactgaagtcccggcaagtgaattctcacccttaagaggattatcgaaggcagaactgctgcctcttcagaagtggttccgtgtgctggctcttccccactcccccaggaatagggagcctgggttcctcaaacttgaaaacaagtaatttcttatgcagagggctgagactagtgtggcaaaacctgaatgctggtacattagagtaaagtctgtgggtggtagaataatctttctccaaaacaaccatttggcgaggcgcggtggctcatgcctgtaatcccagcaatttgggaggtcagggtgtcggggggaatcacttgaggtcaggagtttgagaccaacctggccaacatggtgaaaacccatctctaccgaaaatacaaaaaaattggctgggcctggtggcgctgcctgtgatcccagctactcaggagcctgaggcaggagaatcacttgaacctgggaggcgaaggttgcagtgagccgagatcgcgccattgcactccagcctgggcaacagactgagaccctaccacacacacacaaaccatttttccactggtgggcacccaggatgaatgtgtgtccattcttgcttcttgctgtcgacccagccccttccctaacagcagacagagcacggttccccctcggaacccactctgcattgctcctcagtactcggcttctgaggaaaattgccatctcagtaccagtaggagtttccttgtgtgtcttacagatactatgtgaaaagtggtcattttatcaaactaggtgtgtcacttttacctcctgtgtggaagaagacacaatgtatcatgaagcatttttgaattctccagttatcaaactggtccaaagggcccaaggtgtcgttggattttcctcagtggacccaccttttgggggtggggaggattggggtagcagggagggtcctggccaccttcccccacctgacttgccttagccaggagctgctctcctttgatttgttttgtattctgggagtttgcctaatattttgtttgctgctgtttgaggaaatcagttgggtctcatttcatggggtacacaaatagtaaagatatttgtacattattttctatgactttgtaaggagagaaaactgtgcaaggttgtgtcccatggaatgtcgaattttcagttaggaactccctgagtctttggggcaattatttatttatttatttatttatttatttatttatttatttatgagatggagtttcgctcttgtcatccaggctggagtgcagtggcttgatctctgctcactgcaacctccgccttctgggttcaagtgattctcctgcctcagcctcccgagtagctaggattacagatgcccggctaatttttttgtatttttagtagaggtggggtttcatcatgttggccaggctagtctcgaactcctgacctcaggtgatccacctgccttggtcttccaaagtgctgggatttcaggtgtgagccactgcacctggcctgtggggcaattttagagtaaagaccgtgaaggtgcagttcatggggtctatgtccaagtctggttcccacacgcctttttccagcagggcccatggccagtggaggcttgtggagtgcttcctacctgtgcagatatgcctgttcctacctccctatcagtgttaggtttctttcctggaatatcctcctcaatttactcattccttcaattcttattgcataaggtttatcacagttttcatgttctgtaataagactaccaatacggtcaccaacatctgtgtgataataatcgccatttgtaacacactattaccattttaaaaatattcttcaggacctaacacagagtctggctgagaacagaacactcagttgtgtatcaagttgaattgtattagatttgtcaactaggattccggacctaagtataatcataacttaagatcagttactttttctggattagaattagattaggttaacattatcacctgcacatgtatctctctgaaattctttatttttattttagggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgtgagttcacctcctgttacaacatggcctggttttgttcactgttaatggccttatggatctttggtctactctgttcaaagcttcatcttttgtcccaaagtggattctgtggtttcagggctctattccatgatattggtagattaaaacggaaccaaggcaaaccaccctggttggagttatcctttgtatgtaggctggggaatgtcaaggaggtgagtagcgggtgtgtatgctggtgcaagtcctaagctgtgtgtgactcacactaatactacaattcttgaatttactgtagtgaaatcctacttagtctggtggcccccgacttctctttgcatctggaggcataatttgaagacccccttagagaaagtcctgctgtgggccacatgaaattagccacttttcctgtatgttggaatgttctgatgctgcaggtggctgatggaggtattttgccctgttgtcagatggtttatgttagttaggccagaagtagcatgtgcaaagacccaacagttcctgacacacagcagcccaacttccttctttacctttcaagaataggagctgcatcttactcaccttggtgttcccagtggccagcatagagctgctcaatacatcttcagagtatgtgaatctcatgccttctaagtcctccgggcagaaatgtaccagagctcacttaaaagcatagatattccttgccacacaaaccctgactatccaaatccaggagactgaaggattcttgcagatattcagattaggccctcacatgccaaattatcaggagtcaatttctgaaactcaggaaccaaatagattaggatcatatgctatcccttcctttccaaactctggttactgagactcactgcttgaccccagttactgtgttgagctcatgttttgaccccctgctcttttatgtttccatcttgagtgatgcagttgagagttccatatctttttgtatatgattttggaacaagtttctgtattgacacttgaatttgggtgtgctaggtaagtgctgaacatcctgatggcatccttccagcaagccacgccacaatgtccaaatgatatttccttatctctagtagaaccttgaaagtgggatggctgggtccaaggattagtgcatatagctgggtgtggtggctcatgcctgcaatcccagcgctttggaagtccgaggtgagaggatcacctgaggtcaggagttccagatcagcctggccaacatggtgaaaacctgtcttcactaaaaaatacaaaaaattagccaggcgtggtagcaggcatctgtaatccctgctactcaggaggctgaggcaggataattgcttgaacctaggaggcagaggttgcagtgagccaagatcgcgccactacactccagcctgggaaacatgagcaaaattctgagtcaaaaaaaaattaaataaataaaaaataagtggatgtatagtttggctagctatttccacacccttctccacaggagatggatcattttggacttctgcctgtttccccacagctttgtcaacagagtgcattgtcatctttgggaacagttttgtatactgttttgtctcttaccaccttttttcctctgcagacagagaatgtcccagttacactatcagaggagaaccgttctgaaggaaaagttggttttcaggcctataagaattacttcagagctggtgctcactggattgtcttcattttccttattctcctaaacactgcagctcaggtaaataatgacatttgttttgcgccctcaaaatgatatttacagtacctatgtttatgctattatgactgcatcttgcagttcacttggggtctgaattgaaatgtgctgtctttggggaacaaagtgagggctgcctactggtgttccatgtccgttacaaagacctgcgaaaaaagggtatctttcaatgattttaaaatggaatatgcattttcttgaacccttgatatctgggagtttgggcttggcacagacctgagctggaagaactatgcgagttctctgagccttttattctttctttctttctttctttctttttttttttttttttgagatggagttttgctctgttgcccaggttggagtgcagtggcgcgatcttggctcacttcaacctctgcctctggggtttaagcaattctcctgtctcagcctccggagtagctgggactacaggcacatgtgccaccatgcccagctaggctaatttttgtatttttagtagagatagggtttcactatgttggccaggctggtctcgaactcctggccttaagttgatccgcctgcctcagcctcccaaagtgctggggtttacaagcatgagccaccacgcccggctttgagggctttctttcggttgtccatgttagcgattgagagttttgagttggtaagtcatgcccaagtttgatttttgtctttgttgtttctcccctcctaggttgcctatgtgcttcaagattggtggctttcatactggtaagttatttctggtctgatgtatgaaatactccaaaatcagtaagaagactcgcttttccatagagttagagggaggtgtttgttgatccttctcttctaatcctcacttcgtttacccgaagaaaaattagagtgcttgctggtggagtgtaaactgcggtggtctccacccatgtctgatccgcggcatcatgttcacagacagtttcgggaactgaaagttgtgatttaaattgaatttttataaggtagatatacacaagactaagtgagctgagaatcattttccagcatgaagcgtttctcccaaattgtggttcatttttaaaaaaatgtatttatctaaatttcatatatagcttaatatttttttctccccatgttccatagggcaaacaaacaaagtatgctaaatgtcactgtaaatggaggaggaaatgtaaccgagaagctagatcttaactggtacttaggaatttattcaggtaaagtttaatcatttggtgtattgtatgagaggctgaggtgcttacaatgagcctgtgtgagtaactagggcttccaggagtcattcagtaatgtcttaacagatcaggagtctcagtcgaatttactctgtgaattaattagaataattattttaaaaatctactagaagagaggttgactgaagactcttaatttgctctgtactggattttgaaagttaaaccaggattgagcattcagaaaatcagccactggaaatatgtggctattgtctattctaataggttgctttagctaaatcttatatcattatacggatgggcagggggattagaaacggatctccaccctgtggttcggatggttccaattctgtctaaataaaccctggcttttattgaacttggatgaaatcctctggcagcaaggcccccaaaataaaagcattattccctcccaggtatgcaaagctcccttcagcactgctcatctcctgggcttcactaattacttaagagggaagctgagcagggaaaaatccagtgtctgggaattaggatgccttctatttcttaccttgagatcacaatgttatcgcgtccccaactgtgtgattaatttaacatttggcttgccagactaatattaacgccacactctgttttcacaagagtgcttagaatgtatgtagcattacatactgtttaaagaaaatcttcatctaaaattttaaatatttccacaggaaatgctcctacaagctttcctcagagatagagtgagttatctttgtaagaacctactcagtgaaatttggtgtttatttcatcgatcgcttgctaagaaatctaaatctgttaggtgtttaccttccaactgatggactatgtggaaactaaaggaagaaggaaatctattatgttctattatgttcgtgtaggatggcaggctaaggataatgcccgttgatggagttaggaatttgagctgctttcagaggttaaataacagtgacatgtcatctgaaagggaaatatttgttatagaagttacccccactgtatttagcattgtgaatgaagagatgttaggaaagctcttttaatttctatgtgaataatggatcctcattcatgtcttaataaaatgtatgatttattttattcatttaaaaatgtcttgtgtctatgtaaaacagtgggggattagttgcttatttagattaattatcttatgttaaaatataatttgtgttttcttgcaattcaattattcaagaggttttccacatgcaacttaatacggtatttttaaattctttaaagctacttgggcattttctacaaggaaaaggtaaatcatttctcctattccttgttaatatcacatgttggtatcaaaacataccaccttttttagattatgggacataatgtaagtaataagatttggaatatggagaagatcaactacacttcatgattatctatcctacttctgagtttttaatagaacttgcaattgaattagagcctagaatgaaattgtattatacacctgatttttcttttctgtgcagtttccattcagtgagagaaaaataaactattttaatccttctttgtcaatgtattttgtaaatacattatacttatgtagaatccagatgctttatggaataaattaagtaacatctttataaactacctggcttgctttagcaactattgaagaaaatgcagagatatgctgtgttctctaagtgatatttctttatttcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggtaagtctgacaccaagtttctcagtaagtatgtcttgttaacaacacatttaggatctgattacatttccatctttgaaaatggaagggatgctgggaagaaaatcactatgcatgttgattcattttccacaagaaacttcactgatatttttctcctaccagagaaaatctaaatatgcggggggaggggggggcatacaatcttttattccaatttatatgtgtgtggaaaaataaatgaatgttcactttgcagaatgctttaggaatccatttgctgtgaggcaagtgaagcatcctgcattccctgtaaacatgtttaaatgtagttgaatagttgctaaacattggctgtgtttacatagtgttaggttatgccatttttcagagggatctttgtaatcaggaatgctctgacgtgagacaggccgtgcatttctttctttcattgggaaacccgttcatttctggaaacacagggtttttgtacataccctgactgtgaggtttccctgaaagataatatgtggttaattaaaagccaagattgataaaatgtaaactccccttcaagaacagtttctaactctgtggttttgaagtagacttttggttctataatagagactttgttgaacctgccatatagatcttcagtagcttgtttcctaggtatacccaactatacccagtattttccaagtggttgatgcctctgcactatgcgcttcttatctgtcctgcttctgaggctagccttcctgacctgggttcctagggagaattagttgtgcctataagtccccaccctgctcagttgagtggacttgtggggaggcctgagtgacattgtgcaaatgataactgccctcatagaagcagggaggtggcctggagagaacacaggcacagctttggcctggccattgactagctttttgaccaaggccagagcacataggtgctattacacaggcaagtctccaagcagatgctgtagttcaaagtgtgaactcaagctaactacctgggttcaatcctggtgctggttactaattgttatagctgattatagttacattcatattcatgtcctagttacttaatttttctgtgtcacagttttcttatctgtaaaatagggatactattcatacccaccaaattgaaatcttatgagaattaagcatgttaatacattcctagcacatgaaactgggtgtagcaacatggtcagtgcctaacgaatgttagtgacaatgaagccatgtatctgtgaactgaatcaccttcactgtggggtggaaattactcctaccctctctgttttacatgatttttgtgaagattaaagaagactgttctggaaagcatcttgtgtagatttatttaacaaatacttttcagtccaagcactgtgcaacgtgcaaggatttgtaaactgcagagaccacacaaatatcggtctgatttcagctgttattagaaagtcattggaggacctctgcgctattacagctgtaacgttgcgccactttgccagttaatttgaaactacagtcataacatttggagcattaagtgggactgcctttctgttatcacaggcctcggaatgctcatgactaccattaaccagcctctccatgtttgagacctgtgggcttctcctcatgctgatttatttattattcagggatttgggacccagtctaaatcttggaggtgactaatcttacagcagcacctgagtgtttatcttgcttcctcctcctatatctattagcatgactttattccttcaacaaaatagaagcccaaataagtaccccaagagaggtctactttgtccaaaatgtttagaggtcatgaattatttactttttttagtggtagatgttgaaaaaatgtaaaaattaaaagttttttaatggtagaattaaaattttcatttagataaaatttttgcactttttacaatggtgaaggatacacaaaatctgtgaattacgcctcagaattcacattactgattgtatgcacttcaatagttatatatatatatatatatatatatatatatatatatataaaatttatttagaaataaggtctcattctgttgactagactggagtgcagtgatgtgatcacagctcactgtagccttgacctcctgggctcaagcgatcctcctgcctcagccttccaagtagttgggaccacaggcctgtgtcaccatggccagctaatttttaaaatttattttattctattttgaagagatgggatctcactatgttacccgggctggtctcgaactcctgtgctcaagggatcttcctgcctcagtctcctcaagtgctgggattacaggcatgagccactggacccagccggctttataatataaataaaaattcccctctatgatagtgaggcaggcatgctcgatttttcagtactcttaaacatacatgttaaatatgtataagtatctggcatgatgttgtgccccctgaattgcagagtgttctttgagtggggtagaaagactgggaagcatgtctgaatacttagttattaaaagcaagctcttagaagagccccgggggagtttcctatgagctcagcatcctgatattctcccaggttttagaaaacttaggaaacggggaggacctctgctggcatgtagtttccagtaagctcaccttgggatggtgactggcacagaaactccaggtgattcacaccgggggtctggctagacgtccctcatatccccatctccagtgcccttgtgctggaatattctcagtgactctggtctgcagcatagaaatgtcttctccattattttatgtccactcccaccccagtgtgccatccccctcatcatgcttctgcccagatcctcatctgtgtggttaatgaatgggcgacccttgctggtgactcagagaaccagaccttctggaagggtccccctgactgccccactgtggtcccaagttcacttatttggatttagggagaaggggaaggtaaacctggaaggtctgtgtttcttctcagcagcgaagtttctgtttcttttttttttttttttttgagacggagtcttgctctgtcacccaggctggagtgcagtggcgtgatcttggctcactgcaagctctgcctcctgggttcatgccattctcttgcctcagcctccagagtagctgggaccacaggcacccaccaccacgcccggctaattttttgtacttttttagtagagacgggtttcaccgtgttggccaggatggtctcgatctcctgacctcgtgatctgcccgcttccacctcccaaagtggtggggattacaggcgtgagccaccgcgcccggcctgaagtttctgtttctaggaaggccacgcttctccaacatgccagatattaagttcctctccatttcgaacccacctatggttgcatgaaattcatctttgtttatataatacaatacctttttatctactggcctttcgttaacctgataaatcttaagctagcaggataaaatgtgagccaaaccagtgtgctgccttagaatgacaagagccagttctctctctctttctcttttctttcttttcttccttcctttcttttctccttccttccttccttccttcctctttcttcctttcttcctgctctgttgcccagtcgagtgcagtggcatgatctcagctcactgcaaatgtccacctcttgggttcaagcaattctcatgtgtctatctcctgagtagttggtattacaggtgtctgccaccacatccggctaattttttttttttttgtatttttagtagagacagggttttacctcctattggtactgagatagcagttttcccaagaagccaagtactgacgagcaatgtggagctgggtctgaggggcaaccatgctctgtctgctgttgggagcgggctgggcccccagcaagaatggacacacattcatccaaggtgaccaccagtggacaaatggtgactgtttgtgtgtgtgtgtgtgtgtgtgtgtgtgtgtgtgtgtgtgtggtagagtctcactctgtcgcccaggctggagtgcagtggcgtgatctcagctcacagcaacctccggctcccaggttcaagtgattctcctgcctcagcctcccgagtagctgggattacagtgtccaccatcacacctggctaatttttgtatttttagtagagatggggtttcatgatgttggtcaagctgatctcgaactcttgacctcaggtgatccacccatcttggcctcctaaagtgctgggattacaggcgtgagctaccgcgccctgccaagagccggttttcctttctcgtctttttatcctcctctcacccattgctagtttttattctttcctcttttgatgtaggttggtgatgggatcacgtgtgtctgttaagaagccttacattttcagctgccctcggacacctccttcatattttgattatgacctgagttgaatagggcatttgcagatattttctggtactgttcgctgcatctacctcttcctagtcagtttttgtgtgtgtcttagccctgtttccgttctgttccaatcataataaatgggtaacacaaatcctaggtcaagagtaagtcttcagaaattaagagatgatttttattttaaatgtaaatcctgttttcctggcatgggcagaattaattttgcttttgatatccagcacaagagggcagcatgatctgcagtatttcagtgatataatgtaagagcacctcattgcaaaacctggtttttaatttaaagctttcttggaaattctatttttatagcttgggtctttgtatcttgatatgtgttaatatgaaatttaaaaagtaatattgtggcgtattatgtttgaaacatgaaagtctttgtggaagatatttttctgatgttgtcctggaatacctagcatttcaaacagggtttttttggatttcctaattacaccttcttgactagtaactggaataggcagacgctgacatcttgagtggttggatgcattttaattcctgaagcatacattatgatttgcttgtatgatgtttctgttttctttgtaagcatgagtttgcagagaaagatagttacacagttagtttctttagttttcttccacgccaacagagttagcagagacattttattcttatcaggtctctacaatttcactctttgttttggagaaaagatgagcggtttgttgtcctgttttctcatgcctaattatggtgacataacatttagctaagtacactgactctaatgggtgccagataaatgtttacttgctttcaatttgttaatttggctttaagaacccaagagctggtgttggtagaagtgtttgtttactctctcagggaagtaaaagttaatattgggttacagccagtgtgttttacacaactggtttttctccagtgtgtgcgtggggagtatgtgtgtgtatgtatatttatgttcatcgatgccttcaacagtgtaacaaaaaaaccagattcatatcattcttttttctttatagattaaggtaaatgagagctaaaacactagataaaagaaaaaagaaacatattgacttcttcccatgtttcttttttttaatccagtggaagatgcttgtggtcactgaggtatggaatgcgaatgctagtactagattttaagatagacatattctcctatgttccctaatcaaaaatcgagggttgccccagtgattaagattctcagcttttagccaggcgtggttgtagtcccagcagctcgggaggctgagtcaggaggattacttgagtctgggaggtcaagactgcagtgagctgtgattgcatcactgcactccaacctgtctccaaaaaaaaaaaaagaatgattccttcccagcttgactgaatgggaagttaggatgtgcatcctacaggaattgaggggaggagggtggtagtggtttgaactattgttctgtttctgaaacctggaaagggactctggaatccactacaagttgctaaataatttgtggagaactgaaagcaacctccatgatgagctttttatatgatcagaaagactgtcttgcgatactctataaaatctgatgtccatatcccacttccttgccagaaaaaaagagtcatcaataaagaagaaacataattgtagggatacctatttatctgtttattcagttcaaatgaccactggagttggtgctaaatgtgcatttttaacaagtataatatttcagcactgtcaaaattacctctacaataataggcttgttaaattatagctctataagctagggggtaagatggctctgcccagcacacattaatctatgcctgttcacacaagtgattctgctgagcaggtagcatgtttaaacaagaaatactggtcctaaaacctctgatttatggtaggtgttgttttgacacagcaccattcagacaatttacaaggcaaagcttcgtgctaaaatatttcctcagtgtcatcattcgtcaccagtataaatattcagtagtgatgctggaaaattggtaatatgcccattgatgccaaatcactcgctatgtttcctttcaagtgagatctgttgtggatatggttaaaagaaactatgatttttcttccttgagagcagatgagctgtaagaaattgagaataacaaccgtcctgacagctttcatgtactcaatcttgcctatattgcttttaattctggcttaagtcctgcgggctttccctcccacccccttgcctgatgcgtattgtaaagaacacatttatatgtacattagttagtttaagaggctttttgtgttcaaaggaagaagttagtcatcaccagaaaagctttgttgcaaaacaaaaacacacatttcccctttcattttttcttgttaataataacaaatgcaagtgactataaagggaataacacaaaagattgcatcaatcataatgattctcaatagccacataaatattgttttttcagctttgaatgaaacagctaagagtttgaagtaggtgtggtaattaaatcctgtcgggttatcacaaattaaaaataatgtttttttcacataacaatggttatatgtacttaaactcttatcaggggtgatacgaagtcatattttatgggagttgctcctttactgctaatagtatcataaaagcctttgttaggagtttaaatagttacgtagttacatatatttgattgctattgttattttgtcagtaatctgtatgtaagcgattactgtagcacttgtctacagctggtaaatattgcatcattttggcataatttttaatctactagaatgttctgattcatggtttttctccataataaatcatacatggagatactgacaacttagtaacagagaaagcactgtgtttgtccaataaaatgttaaaaagataaaaaactagggaagaatgtgctttgttcaaagtgataatcatgtaatatttcaggaaattataagatgacattttacttaactgtgttaaattgttttcctatagtgtatataatgtgatacctgcatgtatttgtatatgcctgtatctctctctctctgtctctctcgatatatgtaagttctccacttcagtctaatgtccgtggctatggttttaacgcccccccattaactgatttgatatgtgttgtctttatctttatcttcggctaacttggaactagctaacttggaactcagggctttgtagcatatcccaatatctgctgttaatgtgtgcttagtaatttggcattagcctatgggatgtgtgactgataatagtaattcaagtattgtcatttaaaactgtcccccactgttagatcaacattatagttctctgtgaccttattgtcagaaaagaatcaaagtatcttcatgacttagttcttagctgttggataaccatttcaagggaaaatagaacactgtttctggaataacctaatgatattccattagccacttgcagtggccgatttcaacatgaataaatattgataagtatattactgagagcctaatatgtataaagcatagtttttggacactaagtggaagttgttgggatttgctagcttgaaacgctgttctgttttactgtaaggccaactgcttcccctcaaagatttgactttgaagttctcatatgagaactctggttttcatttataattggagttttaatttgagagttttccatttataactggagtttaatttgagttttatatgagaactgattttcacttataattggagttttcttattccattattttattccttccccctttattataaacatgattatttatattgccatgaagacagtggaaaaaaaatcagaatatttacaacgctgaggttgtgacattttgttttccatgaagtttaaaacatttttgcttttatcaagtttttgatagtgtttatgaaaatgatagttacattctaatttaggtaattacgtatttaccacccttgtcttatgttagccttgtttcccccttgtcttccttgccttgttttccccttgtcttcttggagcttatctgttgtttccttgctaaatcccctgagcccaggattggatacactgtatctgattagtaaatatttgttggctggacagaacaagaaatagttccaagagtgcatttgcatctctttaagcaacacccataaagaacaatgggactttacagtgttgaaataaaattagagtgttttttgtcttacagctggtacttatattaaatttaactcttgcttccaattttctttttcaaaagtacagtttgtaatagattactttggtggactttgtttctgatacgtgatggcctgaagagaaaaaccgtacattggttctttggaagctgtgattcatggaactagaccaagttctcctgttgtttaccagtcaaagaaatgaaactgtcaaacacctaataacttttttgggggtttagttgtgtgttgaaggtgacttttaacactctgtgggttaagcgtctggtactgtatagttttgtttcataaacttcatgcccttaagaagtaaagagaggaattaatccatttaaaatcatcagtagacattgaaaatctgttcttgcacagggagttgaggtgttgagatgccccaattctgctaggatcatagtttgtggtaactaagtcggtcacattacttctcttagcctcagggttctaacaggtaaaaagtggctttttcattcatcaagcatttcttggtcttctactcatcgtcagttgtggtcccaaacattgaaacaaaagtacctgttttcaagggacttgcaaacttaaatagttgccgacagtggatgatgatgatgatgatttcttctccttcttctccttctcctccttcttctccttcttctccttctccttctcctcctccttcttctccttctcctcctccttcttctccttctcctcctcctcctccttccttcttcattcttcttccttcttccttctttcctctttgttcttcttcttctttttttttttttttcttgagacagagtcttggtctgttgcctaggctggagtgcagtggtgtgatctcagctcattgcaacctccgccctctgggctcaagcaattctcttgcctcagcctaccgagtagctgggactacaggcatatgccaccacacttggctgattttgtatttttagtagagacagagtttcaccatgttggccagactggtattgaactcctgacctcaagtgatctgccttcagcctcccaaagtgctgggacaggtgtgagccaccacactagaccaacaatggattacttctaaaaaccatcctgtgtcagaatctatgatctcatatcaaaaagatgcatattaaaattaatgcagctgccaaatggaagtctagatacttttctagatacaacacacatgagcatagctccatcagatatgtcttcttcataattcattggccttgattttataaaatttccaaaaatggttcttttggcacttcaaaaccaattgtgttcaaaagaaatcataccagtgggagtagcagaggtgttcaggaaacaaaataaatgattctttatttcagatcataatctctaagcttcaagtggactcacaacaatttctagctagactcttgactgggcctagatgcttttctgagccactgggggaggtctaagtgctacagctcagcttaggaaagtgtgttggagaaaggggagggacttccagtgttgccctttacaagtacctgtacacgctttgggcttttagaagtattgataggagaaagaacataagtaatgatattttccctgtaagtaatgttatcatgaaattcaactatgattcactgagtgttctcattcttggtcaccaggattaatgtttgagaaatttcttcctcgtttaaatagaagctctttcatatctcaaataaagactcgacaagcttcaaagtacattttgaggccctggcagtggggaagggggagggagggggaggaaaaaaacaggacatttttgagaggaagtttattaaaaacaagttctctgttctggaaacattttcctttcatgtcttgtttgcatttgcattttaatagattatatcacataggcaaatgttccagcacctcttgaacacctggaaagcctgtcttagacttgttctggtgtttagaaatctttaggcagacagtgttccaaatacagtcatgctcgccaggcatggtggctcatgtcatataatcccagctacttgggaggctcaggcaggaggatcgcttgaggccaggagtttgaaagcagctcggacaatagcaagaccccatctctaaaaaaaattagctgtgcacagtggtgtgtgcctatagtaccggctcctcgtgagactgaggtgggaggattgcttgagcccaaatgttagaagctgcagtgagctatgattactgtattgcccccccaagcctaggaatcagaatgagaccctgtctctaaaactgtgcagcaacatctgagaaaacagtatatctcccctggttgatcttcagcctgatagtagctaatcagacttctctctgaacttcaggtggaagtttatagaaatgttcttttgcttcagtgactggtctcattcctcactctgattgaagcacataatagaagagttcagagattttgggagttggaggaaaaaatagcatacccagttctttctgtgttccgcacaatgatattggaacagggaatatagttgaagcagatttacccttaaatatattttctccacatacaattccacacgccttgatcagcagcagtgctttgaggcatagttacaatcatggattattttttttcattacctttacatatttaaaagtagagaaggaaggaaatggttgcttttttaaaagtagtcattatttttaatttttttttcctcctgttggtgtcagaatggcctgggcgcataaaatttatttcctttgggggaactataaatgtattcttcttctctttttggagaataaaatggtagtgacatcttacaattatcccatgcgaatataaatcttctctatatactccctattacttagcatgaaaatgaaaagggagtcaagtatagtttaataagttctaccaatgaactgtattgtagacagaagtatttcttattggtgccaagttggaaaagttagtcttgacgtggtcctgtaaatgaaaggaaaatcaacacatacatttcaggatcatgagtgatcagtgtcactagaaaagtgttcttctttcactttaagattaaataaatagttgttgacataaatagccggggtaataaaagggaacacctgtgtaatccagccatcagcagttttatcgtacaatcagataagctgctgtttgttaaggaattgtcaagtctttagaccagatgaatagatttagctcatacgttagagaattttaaaaactgaacagaagaagctttaatttcccttgatgccaaatgttctaaccactctcatctcctttcacacacgagaagctgtaggagtttaaagctcaattgacctagccttcaggtatgtcttcttccattagttattgctgtaccaaagtagctaaatgttctagatgagattagggtttgaaattttatatggcaaaataagtacctcatcatttttggataaacatggggtattttttttctaatacagctcatcttttctctccctttaattctcatgtccactttcatttgatgtcaaatgagagagaactttggttgtcatttaagagcctcttgatcaaaacagttatcttaagaagcattgattgtgtgtgtgtgtgtgtgtgtgtgtgtgtgtgtgtgtgtgtgtgtgttgtgatgggtaggggagagggagagagagactttttagttagcttgtcccaccacaataagaattatatttttggattctcttaataatatgtgaaatttaaaatttgaaaattaatcagcaaataagatgtcctttgacttcacccaccagcaaatggaaggatttttctttattttctaataggggatttaaatcactatatgatttgggatccatggtacccttttggtaaaaagcatgactttagaatcagcctgcccaaatgtgaatctcagctcttccttgctgaattacttaaactctttctgcttcaacttatttgtagtatggcgatgatattaacagtacaatcctttttttgtgtgagtgacaattaagagaatcaatatatgaaaagcatttgatatggtacctaacagctaaaaattgatttttttgactaattgagatgatgaaattttagtagtcttaaaaaatgtacaaattccaaatttgctagttttgatgaaacaataggagtctgggaagggtgtctgtgttttcctggatgcaaagaaaaatagataaatgaccaagactaacaagccacaaaagaaaatcaatagagtattttttttgtttgtttgcatgttttctttttggttgtgttttcaatggggcttagcttcattccagagttaattttaaatttaatttggttttacaatgagagctcaattttgcatgtaagtaccaaacatctggtttactttttgtttgaaaacgatacagctgaagttgagtacagaagtctattgtgtaattaaggaaagagagtttgaaattttgtaaaataagttctatttaaatggaatattggaattattccagagaagtggatatacttcttaggagtaggagaaacttacattatttttaaaaaatgctataactagtccaaatgtataaattctatgtattcacctttttcaaaaagcatgaaaaatgacaaatttcacaagtgaaagttaaagttgacctaaggcagttttagattgttgagccttcaaattttattcatgggatgtttttagagacagtctgtggtttgatcactccagttaattctgggcaatctttctacatttctatcagatggacattctgatattttaaaacttcctcttgcgcaaaatatgtttaaagcaacctgggaagaaaatgagatttctggttagttcttgtaaactataaattatgtttttaagacatttaaaggaattataagccaaacatagataactcctgttactgcactattaccattaataaactaacaattaaaatgccgtaaagtactgactggatataatactagcattgtgatatataaaaaatagaatttggggtggagagacctaaatgaagataggacacctactaattttccacctgcttgccagatagttgtgtcttcaggcagagacacccaactagtccagagtcttaggattcaacctcagtaatgtcagaaaggccctcagctctgaactgcgatgattctctcattctgtgcaactcttttagaaataatttgataagagcttaagaaagtcaaaaataggttgtttgtaagacatcagaggatttttataatagttttgccccacccttgaatgttttagaggtctgttgtaggacagaggttttggtttctggcagttgcattctagttctctaccaaattgaggatcagccagaggtacaatacatttggaatcttgccctgtgtcttataattttatagcaacattataaatttatttgacaacttaagcttataaaacttctgtcacttccgttgtcttgtttcatctgcagtagcaacaaagcaacaagaaatctgttgcagtctctctgcctctgagcatccacacagtagatccaccctcttctttgccttcttgcccaatactcttgttattgtccctatcggtttttatgtggcaaccgcagggatgtgatgcctgtaattgaaaattaaatgattgccataaatcattaatcagactgcagattataacagcatttattaagcatcttggtaggccaggagtgtgctgggaattttgcataaggtaaccggttactgtcttgtgaattctgtctgggtattttcctgtgtttgtttcttccaacttttatttttggttcagacggtacatatgcaggtttgttacatgagtagattacatgtggtggagggtttggtatacagattattttgtcacccaggtaatgagcaaagtacctgataggtaattttttgatccttgccctcctcctaccataaagtaggtcccagaatctgttgttgttcccttctttttttttttttttttgagagagtcttgctctgtcactcaggctggagtgcagtggcgcaatcttggctcactgcaacttccgcctctggggtgtaagcaattatcctgcctcagtctcctgagtagttggaattacaagcgcatatcaccatgcccagctggttttgtatttttagtagatgtggggtttcaccatattggctaagctggtcttgaactcctgacctcaggtgatcctcctgccttggcctcccaaagtgctgggattacagccgtgagccactgtgcccggcctgttgtttccttctcagagtccacatgtactaaatgtttagctcctgtttgtaagtgaaaacatgtgatatttggttttctgtttcttgttaatttgcttgggataatggcttccagctccatccatgttgctgcaaagggcataagtttgttcttttctatggctgcgtagtattccatggtgtatatgtaccacattttctttatccaggccaccattgatgggcacctaagttgactccttgtgtttgctattgtgaatagtgctatgataaacatacaagtgcatgtgtctctttttttttttttttttggagatggggtctcctctgttgtccagtgcagtggcaagatctcagctcactgtaacctccacctcccggagtcaagtgattctcccattttagctttccaagtatctgggactacaggcatgtggtacctaatttttttttcttttttttttttttaggtagagatggggttttaccatgttacccagacaggctggttttgaactcctgggctcaagtgatctgcctgcctcagcctcccaaagtgttgtgattacaggcataagtcaccgtgtccagccatgtgtgtctttgtggtagaatgatttattttcctttgggtctatacccagtagtggattgctaggttggatggtagttttcttttaagttctttgagaagtctccagactgcttcccacaatggctgaatttccatttcctccaacagtatatatgtgttccttttctctgcaacctcaccagcatctgttattttttgactttttaataatagctcttctgactggtgtgagatgatatctcattgtggttttgatttgcatttctctgatgtttagtgatgttgagctttttttcatatgcttggtgactgtttttgtcctttgcccattttttttactggagttgtttgttttttgcttgtaaacttaagttccttatagattctgttctttttgcttaggattgctttggctctttggacgctattttttgattccatatgaatttcagtatagtttttctagttctgtgaaaaatggctttggtaggttgataggaagagcattgaatctgtaaattgctctgggcagtatggccattttgacaatattcctatccatgagcatggaatatatttccatttgtttgtgtagtctctgattttttttcagccatgttttctaattcttgatgtagagatcttttacgtctttggttacctgtgttcctaaatattttatgtttttgtggccgtggtattcttgatttggctctcagcttggatgttagtggtgtatagaaatgctactgattttatgcattgatttttgtatcccgtaactttgctgaagttgtttatcagatctgggagctgttgggcagagaatatggggttttccaggtatagaatcatgtcgtctacgaagagaggtagtttgacttgctttttcctatttggttgccttttctttctttttcttgcttgattgttctggctaggacttccagtattgaataggtgtagtgagagtaggcctccttgtcttactggttatcaaggagaatgcttccagcctttgtccctgggcattttctaaagttatgtcgcccattcctatatagtataatattttatgttatcatcatgcttcaccccctcagataagggttaagttacgtttaatatagtacttcctttccaatgaatgtggatatcttattaatcatatgtttaaaaatttgacaaatttgtgtgacctggaaaaatccatcacaaataacaggtgtcacagtgtgtatctaatggatgcgtttatctgtctgaatgtgtatgtgtgtgtgtaatgttgatataagaattccaatttgagttacatgtgtgaaactaagaaatattttaacctctgtcttcttcaccttctgaaatgtttactcagctgttacataaacttgcttttatcaattttcagaaggatttagcatttgaaaatgagttagtcccacaatgggagaaaaaagtttttactatgtagtaaatgttactgcttctgcaaactagatgatcacttttgcctgttatcatgggcatacgttttctagacttctagcagtacattggcatgactttctaaatcaagtttttataattttttaaccggtcatatgttaggagagtgctagctctgaaatttgtagtgtttggtgtcataggagatactgtggaatggtgctaccatagctattccttggcatttgtgtcctactgggagtggaaataattctgtctttggtatgaacattttttccttttttagctctccaaagtgataatggagaactttttatttatattttaataaaaaggagagaaagagggaaaggagacagagaataaactctcaaatccttccaaattagaagtcctgttaactatttcaagatgtctttggtcattctcataaattttagatttaattataaatgtatctagaacatttcatgtaggctattttggaaatgcagttgaacttttaataggactcatcattgttagactttgaatgacagaataacatggtcagaaggggcatctcaggaggttcctgttagaagaaccacagccaagtgcctttcaagcttgtggaaatcccatccagctgttctctaggcctgaaaaaatgtgggaaatcgaaagattggtgaattctcttggtggtctactcagaagaaaccatattagtaatgttgatggttcagtatcaaacctggcttgggctcagagcttgtgagcctagagtcacacatgtaccaatccaggtgagaccccagctgaaaaatttctttgccttgttttatttatatagctaggctttttagtacatggcccactttttagctacttgccctcctccacccataaatcatggtgatgagaaagacagagattcttctatcatccattttattccttgtttcttcttcttattattatatttttttggcagtaatttaagagatttgctttctttcttgtttgctgtagaagtcaaacagtatttggaaatttgcggaaaatagcgtttcataaatcttctaatttagtcttcacaaggcttgatattttatagtgagacactgatttttactcatacccttttcacaagtagtatgatgataagatctaatcctaattctagccatctatttgttctttgttctaaaacttaagtgtgtaccttagatatcactatttcttttttttctggtttactcatgatcttttgttaaatttaaaaatttttttttttatttccataggctattggggagcaggtggtatttggttacatgagtaagttctttagtggtgatttgtgagattttggtgcacccttcacccaagcaggatacactgcaccatatttgtagtcttttatccttcaccccctttccaacctttcccctcaagtccttaaagtccattgtgtcattcttatgcctttgcatccccatagcttagctcctacttatgagttgagaacatacgatgtttggttttccattcttgagttacttcacttataataatagtctccagtctcatccaggtcactgcaaatgccattaattcattcttttttatggctgagtagtattctgtcgtatctatattccacggtttctttatccacttgttgatgggcatttgggttggttccacatttttgcaattgcaaattgtgctgctataaacaggcacatgcaagtatctttttcgcgtaatgacttcctctgagtagatacccagtagtgggattgctggatcaaatggtagttctacttttagttatgtaaggaatctccacactgtcttccttagtggttgtactagtttacattcccaccagcagagatatcactatttctgttgcttcagggaaaaccagtttccagtttcctttatgtattgatggtcctctgaaaaagatagagctggacactgtggtgcacacctgtagtcccagccactcaggagactggttcaggatgatcccttgagcccaggagtttgaggccagcctggtcagcatcgtaagaccccgtctcttacgaaagagtcaatacacacaaataggtttactgaataacacagccattttctgttgagggagcaactggctccttggatgattggattagcttctctttttttggcccaaagtagaataactatggtatttttaccatttcccctcagtctcacttctaaggttcttttcaaaaatgggctaagatatgttaaggtttattaaaaacttcattgataccccccaccccccaccttgtgtaagctgcaacttagtcagagagattacatgtggagctttatatttatggtacattctttgttctctgcttttatactgcacctcagaggattcttaaattctttgacttttgaagcttttcgttttctttgctgagtttgaggacaaattttgggcaaaaacacccggatgataaataatgcatctagacaaaaagagaaacaaagtgaaactcagtgaaaagtaaatcgacctaaacagtctaagaacatttaacgttttgattacatctcatgacatttgatatcttgaccccttcagcctgtgctggctgttgcctttgcctccgacttgtaatgtcagaggattaaagctcttttactcctttctggtgaaaatatttgcaatttcagatttgtaactagtagatctgttcagctgtaaggaaacctttcagtgatgagcaacacgacttttcatctgagggatgcagagtctatgactgcccgagagattgggatcctgtagtggttttatttcattatgagcctccaccagtattatttaatgcaaccaggttttgaatgctggtgagaacacagttaaggtcatggtctgcaaggactttgatgtcgtgcagaagcctgattttcccataataggcatgaaaagcttgtgcaatatagctcttaggagatgaatatttgttcctgtaggttacaatagcagacataacctgtgagtgatggaaaatgtcgggcagaatatggatttggaggaaaaaggggaagaactagtatgaaaaaattagccatagaaatcgatagatactaggccaagaatataactgcaaacgtgtcagctgggttttcccaagaatgattgacagacactattgcagatcctgcaagtaaagaatttctgatgttttctttttttttcctttaaagttcaactaaatgatttccttatagatttgaaactcttttctccttatacagaaatttctcctctcttcttagttcccagatttttgtgctaagagaatgcataaaaggcaattattctgttgatatctttttaactatctgtaaagatatccatattgattcttagggccactaccctggtacagtttttggtggcttgaattaataggatggtttgctgtccattttatttgtgtctggagaaaactttaggttttaatgcacttgcaaattccttgggcaatctgtagcctgtttggctgtctttgttgcctttcctttagatgctatgccgagtccatgaagtgctcttctctctaaggaatacagagactggggatagtccccagagttgaggaaacgtagagccccgtaggtgtaccagttatggtgggtggtgggagtgccctgggctagcgctgaaacttcaggttttcagtggttgacatcatgagtgaggagacttttggaagaagcagaactgaaggtaagactgagtaagtggatctgtccaagagtaaggagagatgaggcctggagatggtcaaggcaacacacagaatctgactttggcagtggatcctagaccagatcagaaccagaactagagatcaggaggtcagcatggaatcagtgggaagccttccatctgcatggttgccagcttcgtgccaagggatgttctggcaattatggaagcacatattggtacaggtttgactaaccacccagacttttagcactggagtttgttgttgcttttttaaattttttcccccaggacagctgtcaatttggggagatatacaggtatgaattgcatgggaaagaaccattgaatatgactctgggatggttaaatatcttgaagctgcaaagaaggaacatagaacaaagaacaagatgaattctcatcttatgatttaaactgcatttaaacaatgtccgtagatcctgccttcctggaggtagaggccaagtagcaccatatacatatgcgtgctatttctgagcactcacggccccattgggcatgggctgtgtaggtgccaaggctggaggggctcctggggctgtgggtgttttgctcaccccctacacagcttgccctcatgcttctctgtaacagggtcaagtttctgggttacagctgccacaggaacaagctggcacattcttcttgttttgaatttgaccactgggtatttatttattttcccacctttgattgacatcaacgtttggtgacctccttcatccctcctttgggcggccaatcctgcccagccacaacactggtctcagttctcataatgatgttcccatcatgtctcttttgtaaacagagcaaatacagaaaatgccagtttctaaactttcacttaatttctacccatccactcagaaatacccactgagtcttatcttgagttaggcactgtgtttggagctaggccaagaggtcgtcaaaattgtggggaagatggatgcgcagtaagcagcagagggctgggcttgggattggctccgtggaaggagaggcccaggggccacgggagtacaggagacaagccaaccagatttgaggtggggcgagccttgaaggatctctcacggacctgtcatggggatgggtggttggggttacagcagccctggaggtaagggaaaggagctgcccagctggcgtggagtgattgcaggccaggtggtgtgagggcctgcccaggccaggttgggccatgcagggcagataaaggattttaaactttatccctagagcaggaaggctttgtcttcagtaaaatggatgcctgataacgtcacctttcggtgcttgccggagctccatttcatcagggaacctattaagagtaaaaatagggactcatttggatttttaaacttttttttttagaatcaggatctcacgatttttcccaggctggtcttgaactcctggcctcaggtgatcctactgcctgggcctcataaagtgctgagattccaggcatgagccatcgtgcctggcctgtttgtttgttttaaacatgaacttattttaatgtgtcacaaattttgtaactatctgacacttagttcacatttcaccatattgtttgtggccattttgattctttgattttcatttaattgcattgagtataatagcagcaaagtctatcttcttactgtttgttcctgttccaagcacctcccaaagaggagtaaaccaacatattttattatctctgtaatccagaaaattattgcataaggacatgtacacatttagtttggaactccagggcaaattagtatatttcctgggtttattttcttataaataatgaccaatatttcataaatattcatttaccactggtcatttaaaaagtggaattgcagtaaagttttaattggtaaagtgtaacgtgcttgtgtgtggaaaggcagcaacagacttggagacttgagcttctaaaagtttcattagtactctaagggctttatcttagggaaagaattggtcctttttctgtaaaaataaaaatgctgttcagtattggttccccccgccccaccgcccactttccccaaagaaaataaaactttgctgcttaatcagggttccagatgtctgtatgtatttatttattcagatatttatagtgttctctgtcaaacagtttgcctccctgggtgcattccagcaatgttaaaaacatacatggcaaagccacagagatcaaagacctgtgtcttgtgaaccctttgcaacatttgggccagtctctaaaatgatttatattaaaacaaccaaataagcactcttcctgtccacatcgtgctttaaggagtgttctggatggggcctgaagaacccgtgcaaattggagttcccccccatctttcgaatgagggacaccaccaggaaagcttcctgtggggctgcatttgacccgcaggtgcctctcccatttcctgtatttccacattttatttttgttttcattatttcttcctttaaaatatgggagttaacgattttacccccccttaaatattctaccatgtagaattttagactgtccattaaaaatatgggtttcattttctatattattttcaaaatatgcagtatctaccatctaaatgggaaacagcaagacttttttgtagtgacaaattaatgccactgtgactaatatctctgaaagggaagtgcctgtagcagctgaggcctgtgagctggagcaggacaaagcatagatgttgtgctctgagtaagaaagtctcaatacacgtggccttcctggtgagagctcttacttgagtgttttaaagaccagtgatctggcttagtccatcattggaaagtgttatgaaagcggccaatagacattttcctacttccactgcttgttgcagatcttctcttctggctgggagctggggtggatccggtaggggacagagcagataggtgtgtgaagtgacaaccttgaaaagaacctggccctatctacctttatgcctaccatctgtgatttgccagagttctctgcagagcaaaccatgtaaagtaaaatgttgcataaacctgctactctatccctggcccaactctgggtgtcaagaagtatgctgtgctttctgcacgaatgtgatgaatgtgggaacctttttgagatagcagcacatgctggcagtggcgagccgtgtgcgcctgggcaggctgggcgttcggcaggcatgttcccaggcacttcctagggacttgttgcatcatcaggtgtttgattctccaccccgtccttccccagcgtgtccaccacccttaggtgagagagtagaaaggagttccactcaaactaggagaattgatgtgtggctgtggaatttcctgtctttccgagttagcatgctatttgtagaggaaccttttggcttccatttgagactggatctcctttgtggaattcatccgtaactttaagagtataacttaggctcctgtcactactagttcatgctgggaataccctcagaaaggctactgtcagtccaaaccaaagttacccagatgcttctctttcttttttcaaagttgagatctggccgggtacggtggctcacgcctgtaatcttagcactttgggaggccaaggtgggtggatcacttgaggtcaggagtttgagaccagcctgggtaacatagtgagacactgtctcttcaaaaagtacaaaaattacccaggcgtggtggtgcatgcctgtagtcccagctacttgggaggctaagcccagaagacggaggttgcagtgagccgagattgcaccactatactcactttttgagacgggagtgaaaacccccgtctcaaaacactaaataaataaaataaaaataaatttgagatctttccccacaatgaaagccttgctgtcccttaaatattaataacattaattactgttctacttaattttatattaaattatatccaaaaaatcatgatttgctaacatttttaaaaactgtgttttaattttgctagatgtagtttaaaacctagattgaaatttaactagagattgaaactggaattctttcagtcctaatgactagctgtggtgtatttttaaaataatatttctatagtttatgagataagtaatagtttcatgttgctatttacaaacatatctcctacaattacatacagtaggtagtttttatgcctaatgatttaaattacataagtgaaaagtcaaactgagaatatttgtcaaaatattttctcttattaatatgggtgtttagaatgtgagcaacatctttaatataggaattatgggccaggtgcagtggcttatgcctataatcccagcacttctggaggcagagacaggtggatcgcttgagctcaggaattcaagaccagcttggtcaacatggcaagaccctgtctctacaaaaaaatacaaaaattagctgggcatgatggtatgtgcttgtagtcccagctacttgggaggctgaggtgggaggatcacttgagcccgagaggtcaaggctacagtgagctgtgattgcacagctatactccagcctggccaacagagcaagaccctctcaaaaaaaaaaaaaaaagaattatggacattattatattttacctgatcgtgaaatgtagagtgttcactgaaaactttagtttcacggaaaactttagttgagtttgcaaaattacaatttttatgcctctgtaactttttctgattttgatatcattattcacttttacgagtctaaattaaatatgagcaaaactagaaaccatttaaaatggtgggattctcaagctcgtgctggtgtctcttgcagatagctaaatggtagatgaaatagtgaatgaattgtgagtctctgatttggtctctcctacccaccatcaaggcttatccagagattttcaaatagcttttgcgtaagggagacaataattaagctaattattttccttactgccttatgaaaatataaattaaaacagatgtcacttgctgtcttccatggcatgaacctctgtggacaggagactctacactagactagtaatttagggtctgtttttccccccaagttcagacttaatcagatcagttgcagataccctgaaagtgaggccccaagctcctgggtgtcatcgctgcttggtgatcctctgggcatttggtactgccctcttgcactcctcttcccacctcccaggacccccacttcccctgagcatcatttccttctctatggctcttgtccttatttatttatttatttaaatttttttgagacagagtcttgctctgtcacccaggctggagtgcagtggtgtgatcttggctcactgcaacctccgcctcttgggttcaagtgattctcctgcctcagcctcccaagtagctgggattacaggtgtgtgccacctcctccggctagcttttgtatttttgtagagatagagttttgccctgttgtccaggctgatctcgaactcctgagctcaactgatctgcctacctcggcctctcttgttttcatttaaatggctcctgggatcacatttccttcactacatattcttagaacacttttctagaatagtctgcagcattttccttctttaaactcaagactcgcccttctccacttcccttgatcccgttatgtatttatctttacttttcattgctagaaacacatcccctggaagtatagagaatgtttgtacgtcactgtcttcttccatttagatcctctatcctctctttttaaaaaataacatatatattttttggcatttccccctcctccttttggccttcggttctcagtgtatacaagctcacagagggctaggatggttactgcctctgaatgaccattattcatgcatctgagcattggtaactgacctaggaacaatcagcttctgatgggctcctcttgaaattgtagcgcatggaaggctttagtgaatatcattgtgttgacttagccatgtcacccagtggggtggcatttcattcatattcatcatttacatcttaacctgaacgtgtttggcttgggcaggaaagtggggatcaagaatattgattgtgtaaaatatttttcagaaaggtcaattgctatggcgttttctaagggtcacccaatgctttgcagagtaaaatgcttacccacatcctcttcattctccttttcttctctgcataaggtggctcttgtgtcccttcagcacccttctctgccaccacaggcaggctcttcctttgccattcctcccctcagatgtcgctgttgttgttcttcgctttgctctccttatcctacaaggagagttctcctttgttggaggtgggaggggactctggtctccagaagtgctgttactgtctcatctctctcaccagttggtgacagaggggctaccacagcaggtacctcctctgtgacccaggcaaattgggtgctgagtgtccacgtcgagctgaatgctctgatggtgtctccaggaatggatgcatgtgatggatagactggatgctgagagaaggatggctggaaagtttttttaaaaaaatgtttttagggactgggtgtggtggctcatacctgtaatcccacctttttgggaggtcagggcaggcagatcaattgaggccaggagtttgagaccagcctggccaacatggtgaaaccccatctatactgaaaatacaaaaattagccaggtgtggtggtgcacgcctgtaatcccagctactcgggaggccgaggtgggagaattgcttgaacccaggaggcggaggttgcagtgagccgagactgtgcccctgcactccagcctgggtgacagagcaagattctgtctccaaaaaaaaaaaaaaaaaaaaaagttttaaaatcatagtaaaatgcacctaacgtaagatttgccatgttaatcattttaagtactctatatagtttggtgacgttaagtacatttgcattattgtgcagctgtcaccatcctccatctcctgaacttatccatcttcccaaactgaaacccaggacccattaaacactaactccccaccaccccttctctccaccccctggcattcacccttctactttctgtctctgagtttgactgttctacatgctggacataactggaatcaaacagtctttttccttttctgagaggcttattttatttcgtgtaatgtccttatggttcatctatgttgtagaatggcccagaatctccttccatcttaaagctgaataatattgcatggtgtgtatatacagtcagccagcctctgtatctgtgggtgctcagattcaaccaactgagaatggaaaatatttggaaaaacaatccaataaaaaattataataccacaacaaaaaaataatgtattacaaatacatagcacttacattgtatttaggcattataagtaatctagggatgatttaaaattaaatgggagggccaggcgcggtggcttacacttgtaatcccagcatttcgggaggctgaggtgggtggatcaacttgaggccaggagttcgagaccagcctgaccaacatggtgaaaccctgtctctactaaaaatacaaaaattagccgggcttggcagtgcatgcctataattccagctactcgagaggctgaggcaggagaatcacttgaacccaggaggcggaagttgcagtgagccgagatcacgccactacactccagtcttggcgacacagtgagactctgtctcaaaaagtaaacaaataaaaaataaaattatattggaggatgtctgtatgttatatgcaaatggacttgagcatttgcagatattggtattggtgggaggtcctggaaccaatcccacacagatagagagggacaaccaactgtaccatctttcgtttatccattcatttgttattgatgtcttgggttgcttctgccctttgactattgtgcatagtgctgctgtgaacatgagtgtgcgcatatctcttttagacccccgtagtctcttctgttgtgtatatatgtagaggtggaattgctggatcatgcggtaattgtgtgtttcataatttggggacctgtcatattttttttttcattgcacctggaccatttttatgatcccccaactatatacaagaattctaattccttcacatccctgccaacacttggtattttctggttttatgatagtagccatgctcctgggtgtaaggtagtgacttcctttattttcttaaatcaatgaatcctacaaggcagctttgagttgttaattgtggggagtgccaggtcgcctgacatctttgggcaactctttttcttttctcttctttttttttgagacagtcttgctctgttgcccaggcaggagtgcagtggtgcgatctcggctcactgtagcctccgcctctggggttcaggcaattcttctgcctcagcctcccgaatagctgggattatagtcgtgcaccaccaagcccagctaattttttatatttttagtagagacggggtttcaccatgttggccaggctgctctcaaattcctgacgtcaggtgatctgcccacctcagcctccaaaagtgttaggattacaggcgtgagccactgcgcctggctgggcaactcttccctgaaaacaaggcgcccatgtgatggagcctgtgcgggtttttgttgtgcgtcccctcttgtcgcctttccttggcatgcttcccctttttttaatcctacacttgaaaattagatcaaacacaaactgtgtttagatttatttacagtttcttaactcctttcctgtttgccttttgacaggcttggcataagaagtctttttcaagtagtaaattaatttaggtggcacgcaccccacctgagttttgttacatgctggcagtttagataaatggatattataatctcagcacatttctgcccaacaccactgcacagatttgcaagagtctacaaaagtgataatattctgtcagtttggagcctagaaaaagaagaagaaggagaaaaaaaagcattttcttgttcgtatttctaggatgcctgtggggaagccggaaatgccatatagcagtttacatggctaaatacacatgaaaaaagataagggacccaaagatgtttctttgtaggcacacgggagaagagtcagttcaaattggtaattgtcagctgtgtttggagatacattctccatcgcaaccaaagatttttctttttcccccttaaactcaccatttccttgaagaatgcagtctatttttaatgactttattgatttgacgattgggttacaatgtactttatttactgcagaaatgtttcgttcctgtcagcacttaatgcgaataaatctactttttggcaccactttgatagactgtaaaactgcttatatttgcaggaaaatttgttttgccacggtatgtttatgtcagactcagtgtgactttttctcccctcaaaatcattttatatcatagtgtagctgacaaataaatacacacagtgcagtaatcattgtgtactgtcagagcagcagaaaacaaaatgtgggttttatgacagggatcaaaaaagagatttaatattcacaattaaagccacttatttaatgctttctgtttttgcttctgtattaaggctttccagtttttggttcatagtttgtatatctcttaaaaatagtaaatatacagtaaaccctacattcactgatattgtctgcatgtgaatttaatatttattatccaagaagacccaataaaagtcgatctttatttcctattgttcaaggtataagcaaagtcaaaatacatttgcaatacgataagttttctgttaagtttctttcttttcttttttttttttttttaagatggagttttgctcttgttgcccaggctggagtgcaatggtgtgatctcggctcactgcaacctccactccccaggttcaagcgattcttctgcctcagcctcccaagtagctgggattattggcgtgtgccactgcactcaaataagttttgtatttttagtggagagagggtttcaccacgttggccaggctggtctccaactcctgacctcaggtgatccacccgccttggcctcgcaaagtgctggaattacaggtgtgagccactgcgcctggcctgttttctgttaagattcttaagtttttcttgaaagcaatgtcatgtaatatatagctttgctctattataataaatttaatttgggaaggaagctgaatcatctttaaaaattttttttcatgaaacatttttcttctacaaatgttttctagtacgtattttttcttaaataagagaaatactatccattttagttatattatacatttttgttttacttatttttcataggatagcaggatataatattggcaaattgaatatcatcaaatagcctacaaccttagtcctgaatcagtactatgccacaagagaatttggaatatccacaacatgtccattatatttgcagtccatctgaaaaaataatacacaaagaccaacaaatggataacttcctgtacaaatgaacacatcagaaatatcattatgtttattgctttagctacctttatgctttaatatgattggcaattatccagtaaacttgtgccaggtaaaaataagcacccatctgggttattcaatttcaatgaacatgtaaaataatattttaataattacgcaatatttgtttttttaaatttacttttgaatgcatttaacaaactggctaggagtcctttaaagagaggtaaatgcaatcgtcaacagcatctgcaagctaaccccaaagaacccattttcagccaacttcgtgatctctcattcagattcaaatctacaatgaagtgccaaaatcatgcttttaaaaaatgacagcattagtgaaactttggaggtgcttatattgctagtgtaggcaaaaacgcacagcaatacagagctaggccgttttccttgattctttcaccataggaagaaatgaacttccagggaggtaatggagtccttctgagaaccatgattaaaagtctttgggaattatcagccaaacttaaaatggatctctaggttttcatggggagttgtgttaaaaagggactttttaatttaaaggaaccaagttgataaggtaggttcagggaaccaaaaatgttgaacagatttttgctggattgacaacttgtacggatggtgggtttttagggtggttaatcgtctgcgtctagggaaatggccacagcttgcctctccttcggggtgaaaggtaggttctgagtctgtgatttttccctgctcagagtgaataaatattgtaagtaggtgtggtcagctgtccagctctttactttttcagttgggaaggaaagagttgcacagctatgatgttcagagccaacaaggacttgcagacgccctgtgcataggagcagctgaacacattcagaatcatgtaattgagcaggctgctaagtaatggagaaaagaatatcatgcacagagatttgatgtctttttatgggagaacaaaagagtttcgattctttcacattgagtttagcctagccattgtgtggcacaggaggtttaatgaatcattgtttaactaggatcctgccaagtatttgaccattaaatagactccaatgtgtatagagttcttctctgacagactcttatttgactgtgattaattggcatcgaattgttatttaattacctccacagaaatctaagaacagtgtgtattctgattaagttatttgatgtaggaacaggcatggggctggagaggtcagctcagccctcaggactccctgctactaccaaggccaacttctgtggctgcccaaagctcacagaagatccctgaggatcaaaaattcagacagaatctggattttacctttttcttagaatataaaaaatgttttggcaactcatagcataaatttgtaaagctttttttttgcatgttgaaatcctttgaagttatttattggactgtgttaaacatgttcagtgacagttattgaggtttccttcagttcacaattgaaacatgttacgcattcccatacatggagaagaggtcagccagcaggatgcatggcacagtaggagtaaggcagaagaaagtcaatgattgcacagtctggtttgggagtcactatccttagagaatggcaccacaagggcatgagatcaccactgaggggatagagttctgagaggtggagcctctagatgcaaggggagaccacctgtgcttagcagatgggcagggtagcaggagtggaaagaggcagatattaaaagaaagaaaatcaggccaggcacggtggctcacacctgtaatcccagcactttgggaggccaaagcgggtggatcacttgaggccaggagttcgagaccagcctggccaacatggagaaacctcgtctctaaaaatacaaaaattagctgggcatggtggcacacacctgccagctacttgagaggctgaggcaggagaatcgcttgaacccaggaggcggaggttgcagtgagccaagatcgggctactgcactccagcctgggcaacagagagagactctgtctcaaaaaataaaataaaataaatttatatccctgaagccagcatacataaatatctcgaaaagacgatgatgaacagcatcagatgctgcaggaaaagtcaagagcaatgaggatgagggaaaagctggctgctgcgtttagaaatgactggtgaacgccatggtgtgaagaggagcaggaatgggactgcagagggttgtggggcgtttggataggtgaacattccccctaagatgaagatgatggtttgactaagaggtaatgtgtatcttaaactgtttataactgacagcttaggtagaattataagaatcatagtaatatttctagttcttaaaattttatctgaatttttaaagaagaaattcaatggttaaatttcccccctagctttttaatggtgtacttaaatatatatatatatttggtgtacttaaatatatataaatatatatatttggtgtacttaaatatatataaatatatatggtgtacttaaatatatataaatatatatatttggtgtacttaaatatatatatattttggaatatatatatatatatatatatatatatatatattccaaaaaaagttcatgcatttttattgaacacaacctagcacacagtttggtgtaacacctgttggcggttcccagatattaaaatgatgcgccggggatggaactgacgatcacatttgggtgttggttgatctgtttccagcacacctttggttgctttacatagggtgggtagtgggagggcccattgtcttcaagttcagtcacgttctcacactgaatgttttgctgtcctatttttgagtattacatatacttgtatgtggattagagatagagccgattttgcacactgactggtaatttccattcaaggtaatctcagtgattgaatttgatagttgcctttgtggaagtggaaattccttgtctaggtgaatgctgtataaatatgcgttgctgccaccatctctgtgggaacacattcttgtagaccgcttggtatgtctaggcccttgtttttacccctccaatagtcattcttttggagatattccatgagcatttagccgcaaacgacagtgacaggatactggagcagtaaaaactatgtcttagggattaaagtggtacattcccagaagaggtcaagagattggtgatttcttactctcttagaatcagaggttcttaatgagagctctgctgtcctgtggttcctggtttaggaatcccctgaaatcatatgcaaactgtacacatgtgcatttccaagcgaaaacactctgtggcattcattggccatgcagtgtttgagagcagtcgtcctagagattctacctgttgctgtccagggatctgtaccttctggatgctacgtgaggctgggccaggttcactcctccctggtgtattcttgagatccatgggtaaaggaaatggcctggtctgtcttcctaacttttttctttttagcaaatgtaaaataatcatcacttgctgtagcaaagcatgcatagctgctatagcaaaatggtttcccgaggcaatttatcaggtgttttcaatggcttcaaggataatcccctacaatacttcctggcaatgagtgattcggctttgccctgggtcacacagcatgttaaggtctgggatgaggtagaactggagcccctggactttcctaattaattctgccttttattaggctgcatgtcctcattcattcattcattcattcattcatttatttacttgttacaagttatggcctcctgtaacttgtgtaatttaatcctgaggtggagttattttaaatgttttactttaattatgattagccaagagagagttcctgaaacccttctaagcaggagtgatagccaaagtatttaccatccagtacagcaggcagtagcctatcagaagaggcctgggctgtcagcggctgctttggccatcgtcatttgtgtcagccctgcctggaaatttattggctaatttttattagtagacatttaatagaacttgcaaatgtgtccagtaaagtagcttgatgtcatggaggtgttgacatgagcacacctttctgaacctccaggagctgggtatgagtcacagcctggatgcctgacagccaggcatcctggaattaatttcttactgtctctgagcctccactgtatcttctgtaaaatgggaacagtatctgtgtcatagttttgaggtgctgtatgtggtttctggcactaatttagtgctctgtggggtggtcttcaaacacagtgttgagttcactcttctaggtttgtgtgcctcatttggtgccttaagaaaatggtctgggttaggatgtacctttatattattattatttttttattttattttattttttttttgagatcaagtctcactctgtcacccagcctggagtacagtggtgtgatttcggctcactgcagcttccgcctcccaggttcaggcaattctgcctcagcctcacgagtagccgggactacaggcacacaccaccatgtctggctttttttttttttttttttttcgtttttagtagagacagggtttcaccatgttggccaggtgggtctcgaattcctggcctcaggtgatccccccacctctgcctcccaaagtgctggaattacaggcatgagccactgtgcccagccttttttttttttttttttttttttaagaaagggggcatttcttgctcccttgcccagtctggagtgcattagcgtgatcatagctcactgcatcatcaaactcctgggctcaaacagtcctctccccttggtttctccaagtgctgggattgcaggcttgagccaccatgcctggcagcagtgggatgacatctccaatcatgagtgaatgaaccaagatgaccctcaggaaaaaatcttgtccagttgcctgctctcagtgaggaaggcaccgggatgagttagtgtgggctctgtctgtgcacacacaggcagaagccgagtcaatctcttggctatcttctgtggactactttctccagccaaagtcaaatgtgtaaaacgtccatctctccaaactgcacttgtgcccctcctaaatgcttcctctttacaaatatggctttgaagagccataagtacaaggaatttttagcagaggccctcaacacctgatccttttccactcccattccacacccaagtcctctcctatcagcacaccttaggtcatgctcttcccatcaactaggcaaatatttgtcatcccgtcaccctttcctgcctctcagtcctgatggatgtcattccttccacctgatcaaagtccacattcttcatcaatacattctcttccctctttccaaattctcaggccctgttcccatgagggctgaccccgcctcaccctggtaacccgcaccagctggtgatgcccccctgctgttgtgccttcctcattgccgcctgccttgggcatggtccgtgctttcttatttctgccacctgcgtgtgtgctcatgtcgggttgtgtcactctacatgctgtgctcacttacatgtatctattaacctgctaccagtgtgatcataagacactcagagagggctgggtgtggtggctcatgcctgtaatcccagcactttggaggctgaggtgggcaggtcacctgaggtcaggagtttgagaccagcccagccaacatggtgaaaccccgtctctactaaaaatacaaaaatttgctgggtgtggcggtgcacgtctgtattcccagctacttgagaggctgagcgggagaattgcttggatctgggaagtggaggttgcggtgagccgagatcgtgctagtgtgcttcagcctgggcaacagagtgagacttcgtcccccgcaaaaaaacaaaaaacactccagagcgacatcaaacaagcatcaattttaagtcatgaaacaagtaaaattttaattccaattagcaggttctgatgagtgattataggtgtcttacctgatgggtgagcagcaggaaaggaatgagtccaaagtaggagattattgttacccagaggaaggaaaacttgaagctggatgtggaaaacagatgatgaggttgccttttgccttgaagccatttgggtttttataagtcacttagtgtagacagtctcacctagcatcttccagttggggaaaaaaatgagaaggatctgattagaaaatggaagaacacatacatacttttgaaactcattttctccaatttgtcatgtcatgtaataaaacctggaaattactttttcaaaaatatgtcataattatatgaaaaggcaagaaacaactacactttgaaaacacaacacagtcctgggactacaggcatgtgcctccatgcccggctaagttttgtatttttggtagagtcggggttagcttccctagctgcggagggtttctgagaaaagcagcacagttatccgtagccggtccagtataaaggcactcgcattagtggcaggttcctgagagctacatttgtcagcaagagtttcatggaggagaaagggcgaaggctgagatcctggtaggtggaggcaagcagggactgaggaccttcatgacaggtggatggaagagagggaaggccccctgatgggaacagggacacacggccaggaggaatggaggggaggttaggaagagacctctcttctacctcttctttcctcactgtttctaaaaacttaatagctttgatttgacagatgaataaataaggatgtaaatgaggttattttaaatgaaaagtaaagacatgctggtaattatgtaaaataaagataagtcaaaaattacttacaagttttcatgctgtatgtttaggcatagatctaaggtagggtttgagaagttaggcgtgggttgttgtgggtcaatttcaaaggattctgtttagtttatttagatacgcgtaagatgttttgtaggataactgagtgtctgagtaagccctgggctgggagatcaggagtacagataagatttgggatgtataagcaaacaggaaatctttgaaatgaaagtgagcaaagttcgagaagagaatcagaaaaaggaaaaaatggtcaacagatttatccttagaaaaaaataagatgaagcaaaggatattgaaggaagttgccctgaagagtggggtttctcattcctcttctctctgccttatggaaatcccagaatggcttggcagagagttcccaccgcattagaaaacactgcatcaccttgagcaagattggcttttgtcttcacatctctaacatgaggagtttggtctacaaagtgctgtgaacatttctgttgcctgcagaaacctttcttcagaggcaatctctatgtgaaggtcccaatggatgtaaggccctatgtttgagaggggaagggcagagaagggaggagatgaggtgtctggggttgggtgtgcttggcctcctcttcatcctctgtctcattctttaagattcttcaaggcagtctcagaatcttcataagacaaggtttgaggctgggcgctgtgactcatgcctgtattcccagcactttgggaggcagaggtgagcagattgcttgagcctcaagagtttgagaccaacctgggcaacatggcaaaacctcatctctacaaaaaaatttaaaaattagccaggcatggtggtgcaccagaggtcccagctacttgggaggctgaggcaggaggatcagttgagcccagggaggtcaaggctccagtgagccttgacctgggcaacagagtgagaccttttctcaaaaaaaaaaaaacaaaaaaaaaccccataaagtttgaatgttatcagccctggggatccttcgcacccatttaagctctataatcctacaataataatacaaagaatgtctcacccatgtgagctactctagaatttagaagatcccttcataatcatgatctctttgatcctcatgatctttggccctgtgaagtagtccaggcaaatatcatcagctccattttataggtcaggaatttgagtgtcagtataggttgggtgagttgccctgtattgttgagtcctgttgctactgagcctccgaggaggataagtacctcatgtcttgtccctgcctcattttctctttcatgccttctgtgagcctctgccatgttgatggcctgttctgatgagatatactgaaatactggacttctagatctcctgtttggttctcattttggtctaagctgagtgatacaggatgtccaggctggcccatcccctcaaatggcttcctcccctcccagatcacagtgtcatagatgctgtcatccttttcagcccagcaactgtctccaggctccacccaacagcctgtactctggaccagtctgtgccccgccatgtggcaccacattgtacctggagtgcacaggtcaattctctcgacaccatttgatagactctgctctttgggacagactgcttgcatttacattctacttctcacatctcaagatagtggttcccccatcctacctttgccctttgcacactccacctaccatcaactatgggtacctgagggtccaccctctctctgtacttctggcttccaattctctgcaggaatatctaaggccaattctttttttttttttttttttttgacggagtctcgttctgtcgcccagcctggagtgcagtagcatccatcatcttggctcatggcaacctccgcctcccgagctcaagcaattctctgcctcagcttcccatgtacctgggattaaaggcgcccaccaccacgcccacctaagtattttgtagttttagtagagacagggtttcaccatcttggccaggccggtcttgaactcctgacctcgtgacccacctgcctcagcctcccaaagtgctgggattataggcatgagccaccgcgcctggctcaaaggccaattcttatcaaaagtattagttttcagaaccatcagtgaagctataagtgtggatacctataaagaagtttacaaaattgaagagttcactaaacacatctacttttaccttcaaggtcagatgtggcacctaagaccatttttgtggtacagaatgggcttaccaggaaggaatgagtggcacatgctacatcatgggtgaacctcaaaatcttgagatacgggaaggaagccagacacaagagatcacatattgtgtgattccttttccatgaaagatactgaaaaagcaaagaggcagaaagtagttgcttgaggctggggtgggcatagggaggcactgtgagtgccatgagggatcttagtgggggcataaaaatgtcttgaaacttatttttggtaatgactgcatcactcagtaaagttactaaaattcattgaattggatacctgaaatggatgagttttatgagacgtaaaatatgtatcaatgcaaatatgcctcaatatcttcatatttaagtgtacttttttgttacaaaaaagaatggggctcacagtagacatgggaacttacaagttttaaattgtagtacggttataagggaattgggaagtcttcgtcatgggagacgtatcagaattccggaggtgactttaacttcagattagattctagaatcagtttgtaaaatagagtcatttatgaatttgtattttgacaaaaagttcattaacaccttttataatattctatgttgtggaaaaaagttaggagcaacctgactctgtatgtgatattatgacttcaaaggagcttggtttctctctctctctctctcagaggaaaattttagtgtgctcataacttaatatagacccttttcagacatttcggttgtttcctgcttctgatttaccaaataatgccacattgaccatctttgatgcacttattaatgccttgagatacttcttataaaattgaattttggggtccgtggggatgcactcaatagttgtttattgtccagctcccaaaaatctacctgtgccatcatgcaggattggagtgatgtggatttacattaaatgtgagtccaaaatgtggtctggctcaaagaatttactgtgattgtgggcttagtcatgggatatatcctgaccctgagatatgcagataatacctagggtatttattttaatcctggctaccaggcattcagagaggctggctacctgactatgtgctgaggcaatggccaacatgggaccctgtgtgttatgagagataattgaggtacccaagggataggtgcctgtgagaagtctggaaaacttgtgattaactttcttcaagtagttgaagagctgccctgtcaagagaaattcgattcactttgtatggttgtaagggcagaatcagcagcaacgattggatgttcccggaaggcaagattcggtttaatgtaagcaagccttgtctaacagaacagtccgaaaatagattgggtctcctcaggaaacagtgactcctcttctctcgacatccctggagatgctccagcaggggccagatgtcatttggatgaagaggtgtggcatgtgcatggagggaatttatcataagtgtttgatttggagacctctgggaaaatgactgtgagactgtgaacttgacatcacagctctgattatgacagtttactgcgaagccagatgaaaatattctggccgggtgctatggctcacacctgtaatcccagcactttgggaggctgaggtgggtggatcacctgagatcagaagcttgagaccagcctgaccaacgtggtgaaaccccgtctctactaaaaatacagaaattagctggtcatggtggcatgtgcctgtaatctcagctacgcgggaggctgaggcaggagaatcacttgaacccaggagacagaggttgcagtgagctgagatctcctccagcctgggcaacagagtgagactccatctcaaaaaaaaaaaaaaattaaaacttttattctttttgcaaacaccagtctttgaattgtttcttagaacaaggaagtaactattgaaccttctaatcttacactttctacactgagatcattgttgataagagttttgatttcagctgatctttgacattcagttcagttattggcgtagctgtgtgaggaggtgggctttctcagttgtttttgttttccttgtattttatgctgttttccaaccatgggtctttcagattttaagatgctcccaaatggtcaagataaagggttggttttcacatactaatgatttatgtagcctttttatctttttttcttcttttcttttttgtagagatgaggtctcgctatgttgctcaggctggtcttgaactcttgagctcaagcaatgctcccacctctgccttcagaagtactgggattataggtgtgagccccatacctggcctatcttttttttttttttaatttgaatattgctttcaactttttaaaagctgaaccatacttgcaatgtttctgaatattgcctatgttaacttttccacttaagaaataattcatattttaataattatgtcttaaattttttaacttatattttccttttattggtattgatacactgagatgagaaaaaataacaagaaggacgacaaacaaaatccataagtatctgtcggaaaaatactcatttaattttaatgtttcttaagtatagctgataaaataatagcctgacctcttgccctgcatagcatggtctggcaaacagcagaagggcccccggaagctggttggaaattcaggctccagctcctccccagggccactgcatcaggacctgcatttgaaaagttgagcttcctccccggtggcatgctgcagaacctgtgggtcatagtcatcatcgcacctttttggttttggttttctagcagccatgaaaaagtacctggcgttgtgcctgggctttttttttttttttttaacaggcatgagcccgtttaatccctaggacaaccctctagaggaggtgttattagaggctcagaaaagttgtcactgggcctgccaaaggtgtcactgaatgatgctttctggagtctgtgtgtccgaagcctgagacaagaaaattgaggtgcagctccaacttgtacacactgtgcttcttggccagctggatgcctcaggagaactgcagaggctgcattagccccagcagcgggaggcagctccgtctacagcctctgaccattcatggtccacttgcagcctggtataaaggccccaggacgaagtcaatcctgacaaaccctaggaggccacacatctcatctgtaagcagggcttccggaagcgttgattagaaaagaagttcagaggcctagacacacacacttctcaggggtcacctgcatccacgtaggctatgtgtgtatagcttccatttttttgaaggaaatcatttgaaagaatagatatttattagaaaccaggtttgatctgtttgtgatgcctttatgacatactgttttcttggattctacttgacgggaaataaagtcgatgctaagcagtgatcttcagtcattaaataatatttctgttttcctgcataatttcctcttgtgttcttagataagactaagcctgtttttgtcatactgtttgcacatctgaaaatgacaacttgtttgccagtagtaaactcacagcctggaaaatgataggatcccaagtttccccaaaaatgtgaggtacagtcaagcaggctggggaaaaaaaaatacagaggttatcattatgtttatataaaaaatataccacttagcaaaagaaattctgataaagcaaaattagtgaaataattaggatcaatttctgtacgttcatctacctactttgcacttggatggaagtcctagattgggtcttaaaaggagggaacattctagaacccaccaacccttcctgatactgtcacaagatttttttcccttaattcttttaaaatcagggccacatttcaactccctgcccgctgccatttgatgatatttttgtttctctttaggtatcgtcctattttctttttctttaccactgacatcggcttatttcatatgaataatatattaaatacatatgcatttaaaatattgttttgatttgtttgcgaattgtttctcttaaagggtctatctggggaaatgagtaatttttcatatcctgttcttgcaggaagaattttaaatcgtttctccaaagacattggacacttggatgatttgctgccgctgacgtttttagatttcatccaggtaacgttgagagtaatgtcaggatctcaaatggaaaacggaagttcctattttttcaagcccttttcatggggtctgggggtgggactctcggcctggctgtgtgtaatgttaacttaataaagggccatgtttgtaaaagaaaggtgcggttataactcagaggctaagttggcatgagtaataccttgtgtgtgggagtggctatacagtcgcgtcagggttagtttgaagcagcttcgtgcttggtaagtggctctccgtctgcctctaggtatctggcgtggattttgctttactgtgaacacatttcataatacagaaacaatcacctctcacggaaagatagcctagattaactaaattatgcattgtattaccacaaagggcaaatacttaggcactttttttttttttttggatagaaccaggtgtggttacttacaaagaaaagattagtaataataaggtgaaaataatactttattaacaaggacaatagagagcagttattgcggatacaaagcctttaaaggcaaggatatctaagccaatttgagtacaggatcaaagtcaactcagaaaatgtcttttttgttttcacacgttgattgctctaagtcttaagctgtctttaaaaaaaaaaaaccaacaatcctacagaaataccttctgtaaaacttttcttttgtttgtgaacttgaggctctaaaaaataatattgggtcatctctcatctccttattcagtactgttgctcatgtggtttggttttattttattttttcctattgtttaattttgtctacttgtcagtggttcaagctggggcactttttttttcccaagtgtttattttggaaatgcatctattaaaagctatacatattccaaaatctcagctgctgttgctaacactttatgaaatttgaacctctgtgactttttctaagtgccaacttagaatagttgtaatcattagctgaatttaaagccattaaatagaaatactacagttggggtctgcaattttggcttgatcctgtgatccccctacccctgcttttttctcaatgctcagatgctttagatctcctctggagccacagttataaaggaagcaaaattacttaatttggaaaattagctatgtaagaaaaatcagtcataggcttgaaatgcttataggaattcctgtttgtcacacagcaaggcagcaaatgagcatgtgactgcaaacagtatagcccatgggcgaaggcatccactgtttatggaggtgaagtaagctgagactcacaggtggattatttttactgcaaacaaggacctctgatttttttttttcttttgcaaacatttttaaaatgtgccctcctgggtttagctatattatttatccctcagaagccatcactaaaacagttgccccgtttacatagaatgcagattattgtctgtacacgttttgacagggattgttaattacttcaagaagattttgtgaaagtttctgtttctttgcaacaggaagctaggcaaaggttgagtttccgaagctggctggcccactatgtgcttagcagagtgagcggtcgtaattagtatcccttatgtgctttgtctcacatatggagggagagggatggatgctacttgatgtcaatataaaacatttcttagaagcatgaggagggaaaattctagtctcgttgtacttctatttaaccagagagacaagggcgtttgttattatccactcacataatcttggtaaacttaatgttgtggaatcctactggccccaattagctgatttcttgaatctacagcgaaggttaaatcctaatgttattgtctccaagaaaggagttttatctaaaggataacttagttatcaattatgataaagatctattgtcacttgttttgtttgcaggtgtctttaataaggcttcccataatcccttcaggaagaaatattttctccttttaaaaatagtattagctaaatataaaagctctggtccctgccattgttgttgattctttgagggacatttcccaacattcattgtttaaatggttgtcaggaagaatcaagtgaaacgtggtaaacaatgcagtaactggttcatcttactttgtgtgccgagcctttctcccggggatttgcattcgatgagtgggcttttgactgaggtatcgccaggatcattttaaagtatttgggcctgttgctatattaggaagtgaaaatttttattaaagccacccacccaaaaaaatgcatttaacctgccctcaaataaaggccaacaaaaatctaaatgtaattttttttttttttttttaagttgcctaggcctctctgtaaggatgaaaacagcccagtgctgttctgggactcttaatggaatcatgtaaacttaaaataaacactattatggtaagcacatagaatgaaaactaattttccaaatcaaatacattatattcaattcattttccccaatcaaccaaatgtttaaaacctgttagttataacagcaatcttctggaaattaattagaagcctattagctctgctagctgagccgaatgaagggggttgctcggtacatttctaagtagtctcctgaattaaagcaaagcaaggtcaaaatgacagttagctttgttcacctcatggctttgcttaaagtcgttgatcttttaggggggaaggagggaggtgttttgttttgcaaaggaaattttgtctactttgactcagttctgtgatacatttttaaaatttatttctagagccagtggggtgagccatacaggaagcctgatgttatctgtgtggatagtagccttctccattgcatgggcatctgaaatggagttgaattttaggcctcgtctaccgcatcaattcttctacagggtttatttagcccctttcaaaattcagatagtaggaaatttcctggatgactttgtgtttaacatccttagcaaaacatgcttcggacactggggccctgggttttgtggctgtcatcaggttctatgggtaataaacatgctgctgacatcacgggccctgggttttgatggctctcgttaggttcaataggtaataatcacagtgactagcagttcctcctaagcccagagaaactcacagaaagtgaggccttctcaacccagcagctgagattgactgaaacaattgagtttaaaaaaactggaaatttctttgtcaagatgttacccttggtgttatctagctgactgatcgacaggggaactacgtatcatcagaaccaactacggatggtattcttgagccagaaagaactttggcaggatgtatagtaacaaatagaatgaagattaaaatccacagaaaagttaggtatcttcataaaaagggagttgaaattctacacttaccagaacattcagactaagactgtcgagttgttattcttactaaagctgagatttaaaatcaaatagctatagaaataaataatgtagttgcatttatccatgtgactttcttttttttttttttgagatggtctcactctgttacccaggctggagtgcaatggtgcgatctcagctcactgcaacctttgccccccaggttcaaacgattttcatgcctcagcctcctgagtagctgtgattacagatgaccaccaccactctaagctaatttttgtatttttagtagagacagggttttgccatgttgctcaggctggtctcgaactcctaacctcaggtgatccacccacctcggcctcccaaagtggtgggattacaggcatgagccactgcacctggcctcatgtgacctttttaatccagagcattcatgtttgattacgttttctgtatgatggtgatcgttttattggttttgtaagtaggagtctggaactgtggaccattgggtcagaactgaactgtttccaattgagtttgccaaagactggaggggtagatctgagaggagaaccctctgcttgtggcttggtgtctagaatgtaggctctgtagaagcaagtctgaaaccatgcacagattttattactctcccgatgaaatcgctgagataaggaaattctggtttacatgtgaccagatttgctggccagatagaggcaattaacctaactttgatttttggacttcaataaaatatttgtatttgtgagttttcatttgtttttatatagttagatgttggcactcattgcagatgggaacagtgacactggtaacttaaaagtgggtgtcatttgctgtcctgtattaagggaagaaacccagaggggcagcgagggtaatgtgtcactttggaactcagattggctcaggtgtgcaacagtagtgaataaagaaaggtgaggtttttgattaggccttttggaaggaaagccagaattaagggaagtttttgaatatatcataagatataaatatatcactggaaataaataacttatagaatacaaatgaacagtctgcaagttacctcaaggttgccatgggctaatcagataatttagccaaggctggcagtgcacatctggcttataaagagttgttcaaacatgtttttcttgtctgctttttcaaaacttgtaacagctttgaacatctacaatatttctaaagccaagtcatttatgaacatagaatggctcttcacaggttaaaagtgaatatcttgttttcataaagaattgaaatacaaatagcataaagatcttcatctggaacttatgttctttgaataggaatttggcattcaaaacatagtatgtttgcgtaaatcaacaaacaaaaacatagagatgatagtcaacattcacattttaaagtgcttgattacttcctttttttctgtggttttttttttttttttctttctttttttttttctgaaacagggtcttgctctgaagcccaggctggagtgcagtggcgcagtctcagctcactgcagcctccacctcccgggctcaagcaattctcatacctcagcctcccgagtagctgggactacaagtgtgcaccaccatggccagctaagttttgtatttttagtagagatggggtttcaccattttgcccaggctggtctctaatttctgaccccaagtgatcctgctgcctcagcctcccaaagtgctgggattacagacatgaggcactgcgctgggccagaagtgcttgattacttcctaatatcagcaccaatgccagcatcatgaatctcttcttccattttcttaaaacaataattggattaataggtaccctacctgtaatatttgtattaataatatcttattagcattttaattagaaatttaatattaatgatttggaatcagtagttttcaacaattttaatagtgcaaatttatttgtagtatttgatggggagatatggtgttttgtgactatatttacaactggatgtatctgggaatatctcaaagtttctcccaaaaggaaaacatttctattacaaatatgtgacttgtgaaaataatttgtaattcttttcaatatatctcattttttttttttttttttgagacagagtcttgctctatcacccaggctggagtgcagtggggcgatcttggctcactgcaacctccgcctcctgggttcaagcaattctcctgcctccgcctcccgagtagctgagattacaggcacccaccaccacgcctgtctaatttttgtatttttagtagagatggggtttcacgatgttggccagactggtctggaactcctgacctcaagtgatctgcccgtctcggcctccaaaagtgctgggattacaggcgtgcgccatcacgcctggccaatacgtgtcattcttattacatgtcttcctttttatttttttttcccaccagctttttattgagctcctactatatgctgagtatgcagaggtggaaaagatagaggctttatcttcatccacctgagaagcatttattgagtatcttgggtgtactaggccccatgttgggcttggagatatggggctaagtgaaattgaattcccttcttctatgagtttactctattgggagggacagatagaaagcagttaccatgctgtgtgataagacttacaatagaagggatactgtaggagagaatggttaaggtctcagcacgagacaaatttccaatcctagctctttcactttaagttcaattatggcttcctccaagactggccatgcaacacctaatgctggagtgaggactcaaaccctcttctcacagtgcagccatatgttagaataaatatctaaatagatttgttttgctttgcttgcctttgatttgtggctacaaaggacatacaaagagcaaaattcaaattttctggtccttaaatctaatctctctttaacttttggaaagaaactatgtgcatgccagactgttggcacctgtgtgtgtgtgtgtgtgtgtgtgtgtgtttgcacacctgtggctcaccctcaaatgtacccttctaattcttcatcctttaaggaccagcgaaagtctctctttcgcattagtgatgcttttctttaccactccattctgtaataaaacaatctctaggtcctgtaaaaagaagggatcatataacaccaggctgagcactgctctgagcatatttcacttgccccatctcatttaaacttcactcatagtcgttgagtcaatcagtatttcttggacacctcctgtatgccaagtacttttccaggatctagagcatggagcagttaactgggtatcagcttctaggaattggcattctagtgcaggaggtcgacaataaacagaccaataaacataaataatctaagttagtataggtctagtgtgttcagcaaaggaaagtgtttgctaatgactggaccagcatagtcaaggaggaggtgacgttgagtttgaaaaataaggaaacagccgtgcaaagaagatatgggggcaggttgagggaggggcacattgtatggaggaggaacaggtgccaggtctccagaagggaacaaagtggcatttcctcaggcagagagatgccaagcatgagcagggtacctgtagtcccagctacctgggaggctgaggcaggagaatcacttgaacttgggttgtagtgagccaaaattgcaccactgcactccagcctggacgacacactctgtctcaaaataaaataaaaaaaaaaaaaagaaaatagatttaacggactcacagttccatgtggctggggaggcctcacatggtggaaggtgaaggaggagcaaaggcatgtcttacatggcggcaggcaagagaacatgttcaagggaactgctgtttataaaatcatcagatctcatgtgacttattcactatcacgagaataccacgggaaaaacccaaccccatgattcagttacctccccctgggtccctcccacaacatgtagggattatgggagctacatacagttcaagatgagatttgggtggggacacagccaaaccatatctatcactaagtctctaataatagattatttgtcatctggtgcccacccatctccctatagaaagtcatataatgctcatttaatatgagcctatgatattttagatataaacctttcagaaattgtggtactagcctttttttcttaccccctgtgtctttagaattaaaggtagacaaacttagtttcctttccccaaaattcttttagacattttgagtggtcagtaagattcccagctgtggagactactcatttaaataactttattcctggttttatgataaacctggtctcaaacccaggtaccagagaaactgtgactgttttttagatatgagcatctggaagctcaggagagagaggacactagattttcttttctttctttcttttttttgagatggggtctcgctctgtcgcccaggctggagtgcagtggtgtgatctctgctcgctgcaaactttgcctcccagcttcaaacaattctcccatctcagactcctccacagtggctgggacaacaggtgtgtactaccacgcctggctaattttattttttggtagatatttggtagatacagggtttcaccatgttggccagactggtctcgaactcctgacctcaggtgatccactcacctcagcctcccaaagtgctgggattacaggagtgagccaccatgcccagcctatatctttatctacagtattctgatgcacctttgttcaggttgtgatatatatagctctgtggtaatactgtataaacaaggaaaaacaattaactgtggcaaaagcaaaggcacatttctatagttactgttaaaaaataactttacattaaaactttgtaacaactggtgattgtacattgtactaatattattcactggaagtgcattctttatagaaagttacataagtatactaaagagttaaatttaaatactataaacatatacagtacacagcataaatatttttgtgaaataaaaacacctcatggtttaattaaatggaatgtttctgtcacaatttatactttgaatactctagttttgttttgttttgtttttttgagaggagtttcactcttgtcaccgaagctggagtgcaatggtgccatctcggctcactgtagcttctgcctccctgttccaagtgattgtcctgcctcagcctcccgggtagctgggattacaggtgactgccactatgcctggctaatttttttatttttagtagagatggggtttcaccatgttggccaggctggtcttgaactcctgacctcaggtggtccacccatatcagcctcccaatgtgctgggattacaggcatgagccaccacgcccagcctgaatactcttaaaaactgtctgtaaaggatctgaactcccccacagccccatgtatttgattttagacaacaaagtctgggtgccttatttcatgtgtgaaagagaaatagaatctcaggtcccagactccctatgccaaagggaaagttaagcttgggaacagagtcaccagtaccatctttcttttgttcccaaacagccatgatttcacaaccctactatcctgtgtcactgcctcatttcctgtactccctcctttatcttaatataaaatacagatcgactgagtgtgagacaatgcacaatccacattttcttctactccctcttttcacatgtaaaatgtagatatactggggctaatcagggtctcacaagaaggtgaccatctcactgtctaccctccctccctttttcttttttttatttttttttcccttctgcttgctcttctttaaatactgaagtttacaaaactccctctagaaaaaagcatcacagatgcccctgccacattctcatctgtggctaaataaacctctaatcgattgagacctgccttagttactttttggttaaaatatacgtgtgtgtgcgtatatatgtatatatatatacgcgcacatatatacgcacacacacgcacatacccctcaagaagcaattaaaccgttgatatgtaatcttccaattaaagtagcttgatgcccatcttaaactgtaaattgaggaaaataacatttgtggctgtaatagatgatttatgtagggctctagggcagtcggagtctacattttagccagccttgtaaacttgtgtatggaattcatagttgaacctatagagagctgaacccctctaaggtctttgagcagctaagtggcagctcatcttgtaattttaaggttaaacaaggatgtgtgatgtgtgcacatgcatctctctcctttagagacgttattcccagttgatgggctttactgaaaatcagcgaggccggtaaccggcttaccctgtgcacacgtggtggttgtcctctgagttgtgcctggttgcttcctgaaaagggtcgttttcagagttctccctgctctttgcggtcacctgaaaaaggtctttgtggcagtggatgtctcctctatcttgctgttatcatcatcatctgcatcagcatcttggggttggacagcagatcactccattccaagctatgctgttgggaggcttcccttggctttggaactcttcacttaccccattgcaattcagtgtccagcagtgccgaggccactaggcttagtcaccatacttctgcctggtggaaacctgattgtgtttcaggtttggctttgttgtatgaggttttctgttttcgggagaattgtggatggagttagtgaaaccaatagcagcactaatggagctttatgcacatttgagtgaaactgaaagttaaggtattaacttctaacttgtccttgaacctccaggggtaaatgttaaatttattctttaattttcttgctaattagtgctctagggaggatgaagaagtgaacaactactcttgttgactaatccagtggtccccaacccctgggccacagaccagtactagtctgtgtggcctgttaggaacctggccacacagcaggaggtgagcggtggacaagaaaacaaagcttgctccccatcactcacgttaccgcctgacctctgcctcctgtcagatcgtcggcggcattagattctcataggagcacgaaccctgtgaacattgtgaaatgtgcatgctagggatctagcttgcatctaccttatgagaatctagtgcctgatcatctgtcattgtctcccatcacccccagatgggaccatctagttgcaggaaaacaagctcagggatcccactgattctacattatggtaagttgtataattatttcattatatattaccacataataatagaaataaagtacacaataaatgtaatgggcttgaatcatcctgaaactacctccatcgccatccatggaaaaattgtcctccgcgaaaccagtccctggtgccaaaaaggttgaggactgtgttctaatccacttgtttgttttcaccaccttctggattcacagcaccctccactccacctgtagcacatgcctgccactgggctgcctctggcggaccccattctctgccccaatccttggcctcattatgcttcctcagagtcagttgtgattcttcctcaacgtattcatgctacttatccttgttactgtaattttgtgatggcaatacttatcatataaactgatgaaacaggaatgccacaagaaagatttgtttgacaagtcgaagccttgggaaagaaatcttcactttaaaaaattgttaacaaattatgtgtggatgagaataaatggggtggagatgagaattggaggaaaataggattgtgtgctaatagcttcacatgtgtcttaaaattcatagatgatgtattatgtgtgtgatatatacataagaaagaccatgaaaatctccaacatcagacccggacatgttttttcatgcctgtaatctcagcactttgggaggctgaggagggcagatcacttgaggtcaagagttccagactagcctgaccaatgtggcgaagccccatctttactaaaaacccaaaaattagctgggagtggtggtgcacacctgtaatcccagctacttgggaggctgaaagaattgcttgaacatgggaggtggaggttgcagtgagtcaagatcataccactgcactccagcctgggcagcagagagagactccatctcaacaacaacaacaaaaaaacccaaaccaaaaaaacctcaaaaccaactttaaggattttgtattgtgtatcccttatttccatgctggccaaatacaagttcacatcacagcagcaaagggctttgtctgttgccctgcttggggaagctggtaaggcttcctggttattcctgagccatgtaggggagaaggaggcacatatggcaggaagtgcaggagtttaggatatctacagggacactgcagtgtggaatagctgcatcaggaggtttgagacaaggcattagaggagatcagatggagagatgcagaggggccagatcacaagaaggcttgtttcttaagcacaggaatttagagtttagagatttgggtggaaggatatggagaggaatgggagactgtcagaaagatggggttgtaccagcatcaggaaaacaagaaaggatactggtttggacaagtttctctttaggacatccaggtcagaatgccttgtgtggctaatgaaagcccttgcttctgaatagggggcccacactgcaggatagtcgatcccctcaggcatgtgtcattcacaaggctgtgtcccagtagaaggccagttaggtttgcacacctccgtgaatgctttactagatcaactgttaaagctgtcagatatcttgccaatcctgtcaaattatagttgcttgcaaaattggagctgttctcaattccaaaattaaaaggaagccagcatcatttatgtggtctgtttagggtgattctacctcaggatatcagagccatgaaaattccctttgcaagtgctcttggttctctaggaaaagcttcaggttttgtttttgttttctgtttttttgtttttgagacggagtctcgctctgtcgcccaggctggagtgcagtggcgtgatctcagctcactgcaagcactgcctcccaggttcatgccattctcctgcctcagcctcccaagtagctgggactacaggtgcatgctaccacgccaggctaatttttgtatttttagtagagacagggtttcaccgtattggcccggctggtctcgaactcctgacctcgtgatccacccacctcagcctcccaaagtgctgggattacaggcgtgagccactgcgcccggcccagcttcaggttttaaaggtgtgagtgttgagtgtgctactgtgaataagattagatgtgactgggccaggtgtggtagttcacacctgtaatcccagcactttgggaggccaaggtgggtggatcacttgaggtcaggagtttgagaccagcctggccaacatggtgaaaccccatctctactaaaaatacaaaaattagctgggcgtggtggcgggcccttgtaataccagctacttggggggctgaggcagggagaattgcttgaatccaggagacagtggttgcagtgaaccaagattgtgccattgcactccagacagggcgagactcgatctaaaaaaaaaaaaggtgtgactagatatcacttgtaagtaaataacttcaaagtataatgtaggggccaggtgtggtggtccatgcctgtaatcccagaactttgggaggccgaagtgagaggattgctcaaggtcaggagttcaaaaccagcctgggcgacatagtgagacccccttctctataaaaataataaaagactttgccagagatggtgtcttatggttgtagtcctagcaatttgggaggccgacctggaaagaactcttgaacccaggagtttgagaccagcctgagcattatggtgagaccctgtctctacaaaaaaataaaacaattagctaggtgtagtggtgcgtgcctgtagtcccagctactctggaggctgagtccggaagatcacttgagcccagaagttcgaggttgcagtgaaccacagttgtgctactgcactccagcctgagcaacagagccagacccagactcaaaagaaccaaaaaataataataaaaaatttcaagtgtagtgtaggatggaatgggagaggcttggaatcatccttcttaagtttgactcctagctctaccgcttaccttctctttcctcacaaagccacatgctacgtctctgtaaaatggagaaaattctacctattccatgagggttattgtgaggataaaatgaagtcatttcaataacattcttagcataacatctaagctcactaaataaaaggtactttttaaatactacgtatatttttaagtgggagaaatagcctgacaatgacattatgctgcattaaggtaattgtcagacagttaccagacccataagtattaggacatgagtttgtattccagatattaggtttattatccctgaaggctttaatggctattttctcttctggaaccacagtatcaaaatcagttgttttcagaataaaccagtgagcactaaatatctcataataacgtaattttcataatattgctgaaacttccttggcccttgataacattgagtgtagagtctgagttatctagacttctgctagctaaaatctttgcctctaagaagtcttcctactagaaaaaaacaaatgaaaaatgaagataagatgcagaggttggatttaggcattttaattttttctgtttaaatttgggagtgctccgagtgtgctaacttgcacacagctgcactcagcaaaatactgtaatatattgaggcacacggaattgcaaaacctttcttccctacacacccctcatctaaaaaaaaaaaaaaatcagcagcttgactgagcttaaataactgacttttcatatcctttcatggaacacaaaggactagtcctgaggctacttgagccaccaatgcaggcagcagtggagaccaccactgaatgtgccagtccctcctcccacaaacaaaacacattgactgcagctttatgaagtgaaatgcccaagaaaaagaaaatgtgaaggaggtgtcctcagtcatttcttccctaggggggtgggagggcaggatgaggggcaggagaaaaagctgctgcatctggatgtggagaacaaagccatcctaagacttgagtataataggttgggtcactcgcttttatagaagcaaaagagtggaactgccttgacttgtctcagtaccactgacccttacatttcattgtgtagagatgtcagggaaagtgtgtagaaagcacactgaacaatgactttgtcattttgagatttctgaggtttgttcaccccttcccccaactcctaccctcaaatccccattggacaaaagagatcgttagttaggtcgccttgccgtcatttgaaagatctctgttttactgagtctttcaaaagtaaactcatccattttaactgaatcacggcgttctcatgctttcaaagtcaacaaaagagttttagtcactgcatttacaaggatggactagtctgtgaaaatgccagccctagagataatgattcatgccaactgccacattaaagtggatttccttgttaatagacagggcagttgatgacatgagttactggaaatatttgccaactcttgacccctggatttctgagatcaggatgataggattcacacaggcccactctaacaattcctttaccttttcttttttaatgaaagatgcaatggttgggttttttccagtgtgatagcacatgtagaaagcagtactgtcaccattagtgtggtgacagttaatcactggggaccctcccaggcttcccaggctggcaaccagtgttccaatttttcccagcatgtgtgttccaatgataatgtttgtagtttaacaagaagctaattaagacctaaagaaaaaaattaagagtctcatttttatcaagtctggtggtattcagcagagcatagaactttccattctggcatattggatgatgtccattgcaaaacaatagtggccattcgtggtgctttctcttcttgtcattttgcatccttagtaatgataaaatggacagctattacccaggagaggaaaatggccaaatgtttacttaattgaggacctttaaattctctctatgctattcttgattgattacattcatttttgtctgtatacctactgagttttcttgataagatgaacaaaaaaaggtttggactggagaacttgcctgagttttattaaaatcttgcagtcactattttctatatggatgtatcacttccatctgatgtggggcatgggtaagtgtaatctgttctacttgtgagttttgtgactcacttgttttctttcagccctttccctgggttcattgacttagtgttctctctcatttgcgttgagtcatgaagccgatagtgccgcttgtgcatcgcagcaaagggccagccacctatgggacacgtatcaaacatggatcaggagccatttttgttctagggcacatgggctggttaccattagttctcacatttgccctttcccaccctcaatgcacctgaggagatcatctcttagcgttatggttgtgtattgatacactgcccaacctctgcctgaacatggccaaagggatgggaatgaaattctagtgtcatattttttttaccctatctatttttattgaggtatagtttatatacaataaaatcgacagttttttttaggttgaattttactaattgtgtacattccaatatccaccctctaaaacaagatgtagagcatttccatctcctcaggaagtctcctttgctcctctgcagtcaattttcacacctctacacctcttccagatttctgtcaacatcaattagttttcctgttcttgaactacgtataaatggaaccaataatttttctgtggctggattcttttgttcaccatgtttttgagttctgtgtatgtttcagtggttcatttctttgttttctttttctgagtgatatttcattgtatgatgacatcaacatttatttgtctactctctgattgatgggtatttgaattgttgccagtttttagcaatgaatgttcttatagaagtgtttatgggtacactacatatgttttcattcatctcagataaaatgcataggagtggaattgctgggttcgtaaagttcactttaaaaaccaaaaatcaaactatgacaaggatttttataatggttgtactattttacacacccagtggcaatatatgagcattctagttgctccacatcctcgccaacatttagtatgatcaatctttttgtttttattctttttagtagagtatagatgatccatttgcattgccttgatgattaatattgagctttttccatacaggctaattggccattcaagtgtcttattttctgaaatactggttcagatctcctgccagctttttaaaacgtgtttttaaaaatcttgttgattttttagtttttaatatacataagtgtatttgtatatgtttaatattaggcatttgtgaatatttcctgttttgcaaattgtggtttttaatacatttgcttatttcgtcttcactggagaactttttgcatgaaactgttcataatctcacatttgtccatttaatgtctttataatctatagtgaaatttcttcttttattcccgacactgataatttgtttctgtcaatcagtttagcttggagtttatcaattttgattttttttccagtgaattcatgtttgattttgtaattttctctgtagttggtagattttctatttcattaatttcttatattttttaagttacattgatttaatttatctttttctttagctttttaagattgaacattaatctgttggttttcatttgtttcataatatatgcatttaaagttatacttcctctaagtattgcttagctgcatccaatgattttgatatgttgtgttttcattatctacagttcagaatatttatgagttgacttttttttttttttttttagacagtatctcactctgtcgcccaggctggagtgcagtggtgcaatctcggctcactgcaacctccacctcccaggttcaagcgattcttgtgcctcagcctgttgaatagctgggattacaggcgcacatcaccacacccagctaatttttgtatttttagtagagatggagtttcaccatgttgcccaggttggtctgaaactcctggcctcaagtgagcctcccacctcagcctctaaaagtgctgggattataggcgtgagccactgtacctggcccatgagttgactttctgaagtaatattttagtagtgagttattatggagtatataacttcatttctaaagatttagggattttttttttttaaaaaaccttactgctactgatttctaattagccttgttgtaattcgataacatattctgtaatatttctaacctttgaaatgtattgagacttctttaatggcccagtatttactttactttggtaacggtcccctgtgcatttgaaaaaaaaaaaaaaaaaaaaaaaagaatgtatattctgtagctgtggagtatagagttctaaaaatgacaggtcaagttggcttataatatctggatcttcagtatctttactgaatttttgtccactgttctgtcatttactaagagtggggtgtttttgcttggtatctctctctctctctgtatttacagtctttgttgtaagcagcatctaattaggtctggctttttaaatgctcagctgaaattctctgtcattttatgtggagtttcatccatgtacatttaatgtaattatagatatggttggttttaagtctaccatcttggtatttgtcttctgttagtctcatatgttcttttccttctttgcagtgaatagaatatatgttcttattttttctatcacatttttagctctactctttatgttattgtttttagtggttgctctagagtttacatatccatttaagtttattgcaatctattttcaaataatttcctaccaaatttgcaaacaatagaataatcttactattatataatttatttctgctattctttgggcttatgttgtcatattgtttacttctacatatgctataaacttcatgatatattgggtccattttgctttaaataaccaatggtcttttaaagaaatttatacatatgtatgcatgtatgtgcatacatattatagaaaattgtgttttatatttattcacatatttgtcctttccagtgctctttatttctttctgaagtctgagcttccatctggtatcattttccttaagcctgaagaacttcctttcaggctggtctgctagagaccttctcctagcttttgcccatctgagcatgtctttatttcaactttgtttttaatgatcttttcaacagatagaagattctaggttgacagttttctttttttttcctttttttggcactgtacatatatcacatcattgtcttctcccttcattgtttctgatgagaaaccatcattattatgcttgttgcactatacattatgactcttcatggctgctttttaaaacaatttcctctttgagtttttgctgtttgactatatgtgtttagtatccttcttgggattaatgagcttcaatatatgggttggtatttttatttaattttggaaaattatgagtactttatgttttgatacacttttcttttctttctcttttaactccttaacttctgggactgaaaatgatagtatgttagactgtttggtgtagctccaagatctagggtgttgcattccagtctttcagtcttttttatttttgtctttcatttggataatttgtattgctctgtctttagggtcattgattctttctcttatcccaatctgctgccagcccattgaatatgtttttttttttctttcatagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttttcctttatggtcattgatttttgtgttctgtttaaaaaaatctgtatctatttcagtgtcttatttatttatttgttagttttccataagttactgaggtacaggtggtatttggttacatgactaagctctttagtggtgatttgagagattttggtgcacccatcacccaagcagtgtacactgcaccatatttgtagtgttttatccctcgccctcctcccactcttccccctaaacccccaaagtccattgtatcattcttatgcctttgcatcctcatagcttagctcccatgtatcagtgagaacatacaatgtttggttttccattcctgagttacttcactcagaataatagtctccagtctcatccaggtcactgcaaatgctgtcagttcattcctttctatggttgaggagtattccatcagatagatagatagatagatagatagatagatagatagatagatagatagataatctcacagtttctttatccactcattgattgatgggcatttgggttggttccatgattttgcaattgtgaatcgtgctgctataaacatgtgtgtgcaagtatcttttccaaataatgatttattttcctctgggtagatagccagtagtgggattgctggatcaaatggtagatctacttttagttctttaaggaatttccacactattttccatagcgactgtactagtttacattcccaccagcagtgtagaagagttccctgatcactgcatccatgccaacatctactgttttctgatttttttattatggccattcttgcaggagtaaggtggtatcacattgtgtttttgatttgcatttccctagtcattagtgatagtgagcattgtatatcttctttccagaattttctcttcatgtcctaagtccactttctgatgagatttttttttcttactgatttgttctaattcattgtagactctggatattactcctttgtcaaatgtgtatagattgtgaagatttactcccactctgtgtgttgtctcttcactctgctgaatgtgccttttgcggtgcaaaagctccttagtttaattaagtccctactatttatctttgtttttattgcatttgcttttgggttcttagtcatgaaatccttgcctaaaccaatgtctagaagggtttttccaatgttatcttctagaatttttatagtttccaggtcttagatttaagtctctgatccatcttgagttgatttttgtataaggtcagagataaggatccagtttcattctcctacatgtggctagccagttatcccagcaccatttgttgaaaagggtgtcctttccccactttatgattttgtttgctttgtcaaatatcagttggcggttaagtatttgggttctctattctgttccattggtctgtgtgcctatttttataccagtaccatgctgttttggtgactatggccttatagtacagtttgaaatcaagtagtgtgatgcctccagatttgttctgtttgattagtcttgctttggctctgcgggctcttttttggttccatgtgaattttagaatttttttttttaattctgtgcagaatgatggtggtattttgatgggaattgcattgaatttgtagattgcttttggcagtatggtcattttcacaatattgattctatccatccatgagcatgagatgtatttccatttatttgtgttgtctatgatttcttccagcagtgttttgtagttttccttgtagaggtcttttgattccttggttaggtatattcctaagtattttattttattttaatttttgcagctattgtaaaaggggtttagttcttgatttgattctctacttggttcctgttggcgtatagaagagctactgatttgtgtacattaatcttatatctggaaactttgctcaattattttatcagttctaggagctttctggaggagtctttaggctttccaaggtaaacgacagtttgacttcctctttaccaatttggatgccctttatttctttcttttgtctgattgatctggccaggacttccagtactatgttgaagaggagtggtaagagtgggcatccttgtcttgttccagttctccgaggaaatgctttcaacttttccccattcagtatcatgttggctgtgggtttgtcatagatggcttttattacattgaggtatgtctcttgtatgccgattttgctgagagttttaatcttaaagggatgctggattttgtcgaatgctttttctgcatctattgagatgattatgtgattttttggttttaattttgtttatgtggtgtatcacatttattgacttgcatatgttaaaccatctctacatccctggtatgaaacccacttgatcatggtggcttatctttttgatatgttgttggattcagttaacaagtattttgttaaggattttagcatctatgttcatcaaggatatcggtttgcagtgttctttttggttatgtcctttcctcgttttggtattatggtgatgctggctttatagaatgaattagggagggttccttctttctctgtcttatggaatagtgtccaaaggattggtaccaattcttctttgaatgtctggtaaaattctgctgtgaatctgtctggtcttggacttttttttgttggtaatttttaaattaccatttcagtcttgctgcttgttattggtctgttcagggtatctaattcttcctgatttaagctaggagggttgtatttttccaggaatttatccatctcttctaggttttctagtttatgtgtgtaaagatgttcatagtagccttgaatgatcttttgtatttcagtggtgtcagttaatttttctctcttcttttcttggttaatcttgctaatggcctatcaattttatttaccttttcaaaaaaccagctttttgttttatttatcttttgtgttttgttgttgttgtttcatttcatttagttctgctctgatcttagttatttcctttcttctgctgggtttgggtttggtttgttcttgtttctctagttccttgaggtgtgaccttggaatgtcagtttgtgctctttcagctttttcaatgcaggtgtttaaggctatgaactttcctcttagtactgcctttgctgtatcccagaggttttgataggttgtgtcattattgtcattcagtttgaaatattttttaatttccatcttgatttcatttttgacccaatgctcattcaggagcagattatttaatttccatgtatttgcatggttttgaagattccttttggagttgaatcatatggtctatcttggaaaaagttccatgcactgtcgaatagaatgtgtattctgcagttgttggatgaaatgttctatttatgtatgttaagtccatttgttccaaggtatagtttaaatccattgtttctttgttgactttttgtcttaatgatctgtctagtgctgtcagtgaagtattgaagtcccccactgttattgtgttgctgtctctcttatttcttaattctattagtaattgttttataaatttgagagctgtagtgttgggtgcatatatgtttaggactgtgatattttccttttggacaaggccttttactgttagataatgtccctctttgtctcttttaactgctgttgctttaaagtttgttttgtctgatataagaatagctgcccctgctgtgtttcatgtcgatttgcatgaaatcctttttccacccctttaagtttctgtgagtgcttatgtgttaggtgagtctccagaaggcagcagattggttggtgagtttttatccattctgcacttctgtatcttttaagtggagcatttaggcaatttacattcaatattagtgttgagatgtgaggtactgttgtattcatcgcgctgtttgttgtctgtgtactttgtgttttttttgtttgtttttgctttttaacttgtatttttgttttataggtcctgtatgatttatgctttaaagagtttctgttttgatgcgtttccaggatttgtttcaagatttagagctccttttagcagtttcttacagtggtggtttggtagtagtgaattctcttagcatttgtttgtttgaaaaaaactgtatctttctttcatatgtggagcatagtttcactggatgcaaaattcttggctgatcattgttttgtttgaggaggctgaagatagggccccaatcccttctagcttatagggtttctgctgagaaatctgctgttaatctgataggttttcctttataggttacctggtgcttctgtctcacagctcttaagattctttctttggtcttacctttgggtaacctgatgacagtgcacctaggtgatgatttttttcaatgaatttcccaggtgttctttgtgcttcttgtatttggatgtctaggtctctagcaaggctgaagaagttttcctcgattatttgcccaaatatgttttccaagcttttagaattctcttcttcctcaggaacactgattattcttaggcttggtcgtttaacataatcccagacttcttggaggttttgttcatattttcttattctttttccatttgtatttgttggattgggttaattagaagaccttgtctttgagttctttcttctactacttgtttcttcttctttcttctacttattcagttctattgctgagactttccagagcattttgcatttctgtaagtgtgtccaatgtctctcgaatttttgattttttttaagctatctgtttctttgactatttctccctttatgtcttgtattatttgttggatttccttgcattgtgctttgcctttctctggtgcccccctgattagcttaataactaacctcctaaattctttttcaggtaaatcagggatttcttctcagtttggatccattgctggtgaactagtgtgattttgtgaggctggtaaagagccttattttgtcacattatcagagtgggttttctagttccttttctcatttgggtaggctctgtcagagggaaggtcttgagctgaaggctgttgttcagattcttttgtcccacagggtgttcccttgatatagtactctctcccttttggtgtggatacggcttcctgtgagccgaaccgcggtgattattgtctctcttctgggtctagccacccagtgagtctgcctggttcccggttggcactggcggttgtctgcagagagtcctgtgatgtgaacctcacagagatctctttgggtctctcagccatggataccagcacctgttccggtggaggtggtcggggggtgcaatggaccctgtgacggttcttagctttggtttaatgctctatttttgtactggttggcctcctgttggaaggtggcactttgcagagagcattagctgtggtagcatgaagaggaactagcagtgcacaggaccctaggactccctggattatatgccctttgtcttccactaccacagtgcgtagggaaggaccatcaggtgggggcagggctaggcatgtctgagctcagactctccttgggtgggtcttgctgcagagtatttggggtgtctcctaggtcctgcagtagcagtccacttccttcaaagggtctgtggctcctcttgggattgctggtttgttcttgaagtcgatccagagctaaagttcacatgcaagcctctgcacactgctctgttagtccgagtcagagctgcaatctagtcctgcctctcgtctgccatgatcccacctcttgggattggcttctttttttttttctttttttgacagagtctcactgtcacctaggctggagtgcagtggcatgatttcggctcactgcaactttcatctcctgggttcaagccctggtgttttcttgccactatttatatgatcatgtggttcttcctgtttcgttaacctgataaatagcattgattgattaattgtcagatcttaaatcaggcttgtattactggtgtaaacagtttataaagtataattattttttatgttcttagattcagtgtatttagtatgttatttagtgttcttttttgttgttgtttgctttttcacccaagctggagtgcagtggcgtgatctcagcttccggttgcaagtgtttctcctgcctcagcctcccaagtagctgggattacaggtgcccgtgaccacgcctagctaaattttgtatttttagtagagacggggtttcaccatgttggccaggctggtctcaaactcctgaccttgtgatccgccctccttggcctcccaaagtgctgggattacaggtgtgagtcaccgggcccggacttagtgttcttaacacagtttggtttataattttcctttctttggtttttatatcaggataatgctggattccaattctctagaagaatttgataaaacttctgcaaaatcatcttgtgacccatctttgttttttctatgggaaatttttgtgtcatgaattcatattcttaaattcaataatagaattattcagatttaggttttttattatgtcagtctttgcccatcatttttccagaaatttgccttttgcatcaaaatttttaatttattggaacggtgtttattatatattctttttaatgcctgtagtatctcttctgttattccctgttaattcatgataatgataattttcctctctttttttcttgattagtctttttgaagtttattgatttcatcagtttttttatataatgaggctttgggtttgttgatttttctccttcaaattagttttctatttaatcattttctccttttttctaatttccatttttctcagattttaatttaatatgctactcatttttctatctttgtaaggtatatttttagatcctttacttttaacctgtctttaaaaaaaagtttgaaggaataattttacttgtaaacagcattagttgcagtcctgaaattttaatattattaggttttcattttcttttatttgaaaagtttctaattttattgtaatttatttgaaacaggtgttatatagaaatatattgctgaattcctaacatttctagttacatttctaattacattgatttcatgttaaatccacttatgtcagaatatattctgtataatatctgtctcttgaagtttgatgatacttgctttatggcataataaagatgcacttgaaaagtgtgtttatgcagttattggctatagtattgtagcctttaggtcatcattaagtcaagtttattaatcatgttttcaaattttctctgtcgatttttatgtgcttgttatatcagttattaagataagtgggttaaaacttatcttttatttccacttttatatgccttttctaagatgtgtatttttaaggtagcatatagacggacttcagccttgaatttcataataaacattaacatggaaaaaatgtacaaaggaaaccatctgtcagtgagatatgctgaccacaaaggaagggagaggtgcaccacattgctctaatgccttacaccattcactcttcattggagttagctgggactcaggattaagcactaaccgaagtccaacacaggtaccagcgctggatgtcaaaagatcagattagcatatgagggatgaaaggagtgattaatgtatcccaagggaaggacaagtttagaaaagcttagagaatgtttgtttagatcttgtcatacacagaagacataccaacactccataaagttctgatttaaaggcattcactgggttggatgaggtaacaaaaaaaacagatgtaaagtagagatctccccaggtgggacctgggaaccagagttgacctctgaactccctgaggcaggtgagatgctacagtagcacataatttacatctgctgacttagtgctgatgctgtcagtatttgggcttaggagcttacatttaagtgtcttccatattgtcccttttgcttctattcatcctgtaattgaaggtaatgataatgatttgacagaattacatttttatttcttaatattcctgtcggtttgtataccctgttcataattttagtggctccagaagaaatcctgtattagccaggagcacaacctgttatgttagtcatttcattgagaagtaggttttatttttttttgagacagagtcttgctctgtcacccagtctggagtgcagtggcatgatctcggctcactgcaagcctcagcctcccaagtagctgggattgcaggcatgcaccaccacgcccagctaagtttttgtgtttttagtagagacggggtttcgccatgttgcccaggctggtgttgagctcaggcaatctgcctgccttgacctcccaaagtgttaggattataggcgtgagccaccgcaccctgccagttttttgtttgtttgttgtttgtttgttttttgttttagtctcatgtgttcccaaaataaataagtagaagaatttcttctgccaccctatcagtaaacaccttactgatcaaaaactagtgggcaatttttttctctctaaatcagaagaaaatcttgccatagtctctcaccaagaagtgaaccctgctttgtttattacacctaagatttgtcttctgcgaagtcagtaatcgtttaaagcaatctggatgatttgtacttatcacagcttagaacacaattcttcagtggcttacagcagaattaaaagctttccactttctgtgaggtgttagcaaccttaatgatcctgattttatgttttaataccataaacaaatcatgaaaataccatctactgattaagtgacctcatgattaaatacatatttcatcttgtacctaatagaaggttgacagagagagggagagttcaaatgaggaatagaatgagccagaaggatggatggcatttttatttgcagaaaataggaatacatttttactgctgtttatagaaaacatgttcgttggcacaagcttcacaaagactagcaggaacagaatcccacaaaatgaagtttaaagtaaatagtggatagatacctaaaaatttctccaggactcaaagcagtttggtggttaaatgccaaacaggcattgtagttaaaattatgcttgttaaaagaatatgttccattctgtaatgttcggatacaaaattaattctagaagagtctgccgggggaaattttatatttttcactaccattcaaatatagatattgaatatgaaatgtattcaaccttcattttgtgtcctgaggttttatatatttattaaaatgtggttcttctttttttcttaagtcattttgttttctgggtctagaactcatctttttgtaagacttttagatgtaaacaataattcttaaatcaatatgtgttgccatgttctattagcaaatattttaagactttttaaagatcagctcttctttttgagctgagaagtctgttatttcctaattagctgggagctgggattggtcacctcactgagagaccagatataaccacacacacacacacacacacacacacacacaataaccttaaaaactagagaattcagaaaacaaaaatataaaaaatacagatatatttcggtattaaatgctttaaaaatatgaatcgtgtgtaggatatagtatcttgcagtgattaagagaacaggtgtaaggtcagtatgactgaattttctgtctttgaggaagttactgaacctctctgagactcagtttcctcctgtgtaaatggagatgataatccctcctatttagatatgagagtgaagttagataatggatgcgaaatacatatgtactaaggtttggatataagcaaggcttatgacatgttgcctcttcttggtttttgggagggcagggcaattgtacctttctttggctgtcagctaggtacagaaaattgtgggtggcctagtaggccagatgctgggctggtgggtcaagatgcaggtggtggtgctgagaagacacacacagaactgcctgtgttcccgcagcaagcaaactgtgattgcgacccgcaagtgattatttatgctgtactttctggttgtctgttaaacctgcctgtgaaaatcagttgtaagtcttccttagaaacctctacaaagtgtgcatgtattcctccttatatttctttttgtttgtttgtttgttttgttttttgagatgtagtctcactttctcgtccaggctggagtgcagtggcaccatctcggatcactgcaacctccagctcccaggttcaggcagttgtcctccctcagcctctcgagtagctggggttacaaatatgcggcaccacacccggctattttttttttttctcagtagagatagggtttcaccacgttggccaggctggtctccaactcctgacctcaggtgatccacccgcctctgcctcccaaagtgctgggattacaggtgtgagccaccacaactggcctctccttatatttctatagcactctgtactttctgctgaagtcatgtacttttatgtaagacagtgaactttggaggcctcagagcatgtataacgtgaatctgcacgtcccccactgttctatccttctcaagaagcaagcgttgtggtttcagagtaggtagggactaacttgagttgcactcatatttcccgaagccatagaccgtgatatcacatgtttcctaataaagatgaatactgaaatgagcatcatccagtgtcttgggtttttatgcttcttgcttttgtttttatatttcaccttttagaccaaggtaatttccaaagataatgtcaccttgctgggtgaggtgatgggtaagtgaacattcacagacccgttagcacagtgccttgcacgtgctcatacatgtcatttgctattgttatcatgtgcctctgaaatagacgtttgaaatactctcctaatcgtggaaaatttaatgcatatccaagtgttaaagctaaaaaaaaaaccctgttagacattttgacttgttttcttgttatcaaacctcttcctcagtgctactaaatgtaagagaaatagaagacaaaaatttctgacaatataaaattcaatatattgtaataaaaagaaaaaagtctcaggtcttttaaaacatgtaaaatttaattacatttctcttatctattctttattgggcatgttaatgaactctaatttcttatgtaagtgtgtttaggggaaaaattagagaaaaattcagggattttatcctgaccaataaaaagctagccgtatgctggggacaagctaaaatgtagtggctgacaatgcatgctcctcagctctgtgactggtgctgtgtgttcttgatcaagttacttttttctccctgtgcctcagtgtctccatctgtaaaatggtgtagtaatactacttcatagggatattgtgagatttaagtgagttgatacatgtgtatttaatatacagccagatatacaatcagcattcagtaaatgttagcaaaggatagataccaagagagatgactccccacttccaaaggtgaagatttaaattatttcctttttttctgagcactgaatttgcaattagtcacttccttatcccgtgcatagctgaggcttctgggttccttgtctatgatgcctgcttgctcatttcccgcataacatcaactgactcatgatagtttgggattcaagtcctactctaaatctcagttttctcatccattaaatagggaaagtaataatgcctgactcatgaggctggtgagtgtttcaaaagaactaatgggggcctggtgtggtggctcacgctcataattccagcactttgggaggcagaggtgggcagatcacttgagatcgggagttcgagaccagcctggccaatatggtgaaacaccatctctactaaaaatacaaaaattaggcatggtgacatgcacctgtagtcccagctactcaggaaactgaggcaggagaatcacttgaacacgggagtgggaggctgcagtgagaggagatggcaccacttcactccagcctgggtgacagagcaagactccatctcaaaaaaaaaaaaaagaaaaaggaaaaaaaaacctaatggataagtttatatcatagtgtttggcacatggcaggcatgtaatagatatcatcaggaccacctatacttttgttattcctttgtatggaaaagcagtccctggtactacaataagtctttcagagaaaggagtgtaatcctaacaacaactcatgcaagtatttttgaaaagaatacttgataaggaaaacctgcatctacttctgctatttcagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaagtgagtatggaaactcgggttggtatagacatgctagctagtttccatttatgccataaattacagagaccccctgaaattcggcagactctgtcttccagaatttctctaacattaggtaattgaacgtattggccattatgaatcattgtgtcccttagagcatgtggaattgatagcctgcaacgtgcaactttgcatttggaataaggaaggagtgaaggccatatggggagtaatattctacaggaatgtcagcactgtgaagacagggactctccgtgtcttgtttatgacatactttcttacacaaagccggcacttaattaaacatttttcttagaaataaaatatttgatcatggtgaaactaatatagaaggaaaataattagggtattttagtatctttccccgaagatactaaaaatgacaaggaaatgagaaggatggagaaaggaaaagaggtgtcagaagcaatgtatttggtaaatttatgacttttgcaaactcacaaaatggctaggaagttgcagttttaaacgttttgaaaagataagcattgttattttcagttttccatttgttaccagcggtgcttgttctaatgtcacagtttgaggtttttccccctcaggctgtttatatatatatggacactgaaaataatccccttagatcacaaggagatatatcagtttagaaaacatatagtctgttgctctcttcaatttcctagttttggaatcatgaggaagacattttatgattaatcactctattccacatgtaatcgcagagatgaaataatccagagttcatctcattatgcatgcacaaattaacatatttcatcattgttaaacacaaactcataaggagagtagaattgctttactttttaataaaaggtataaggataatagccaaaaaataaagaaggaagatatttgtatcagaaaagctgaatgccaactcagctctctggaagccacgcctagaagagaagcattgagtcccatcattttcagtatcttctactgagtggtaaatagaagtttattaggacaaagcagtttttggttgtgacatatatatgtttctcttttaacaatgaacatttatttatttatttatttattttgagatggagtcttgctgtcacccaggctggagtgcagtggcgcaatctcagcttactgcagcctccacctcctgggttcaagtgattctcatgcctcagcctcccaagtagctgggattacaagtgtgcaccaccacacctcactattttcatattattagtagagatggggtttcaccatgttggccaggctggtcttgaactcctgacctcaagtgacccacctgcctcagcctcccaaagtgctggaactacaggtgtgtactgctgcacctggccaacagtgaactctaagaggcatttatcctaagtgtctgcatgaagtagaaggggtgacagtccataaaagttgtagaaaaacttttcagtcatcaagaaaaccagctaagctaccatgaggtctagtcttgtaaggttttcagtgggcaggccgagcagtggagtccacatgtgagtaacacttggccaataggacttgctagggaaggtagagtataattgctgggagaccttccttgtgcagatgactggccctagccagtgttgtgtgtggacagcaaggctgtgcaggcattttatggtttgggcccgctcatgaaatgaagttattcgagagtcttgttttaagggagtctgtggtatgttgaaggaagcagccgttccagaaggaacatcttgacgtagactgtctgtgtcaacagccacatccgatccatgtggatgtggagaaaagggggacttaggaaggctttttgggaagcagtgtaggattttctctcttgaatttcagcatgtaccttaaagcttgaaaacattttcatgtggagattctgacaaccttatcatggcccctgaggcatatttgggtgttcctgtaccctgattggctgtaacaatgagttaaatatgcaggattctttctccatgcgctcagatcaccaaccacgggggctggttggttggaactatttactgttattcgtccagggtggtgggtctctgccataagtcacaattccactgtttcttctcagcagcagtggatcgtggtttttgagaccactgctggagtcaccagctgaaagcaggatgcctgactgccgtggcagggaggcataatccagcttcatccttgtgccctcaaggatttccaaagcctctgttggactgcctcactgcccctggagtcatagccggcatttaatgaatcttaataacaaatctgggccgggcgcattggctcacacctgtaatcctggcactttgggaggccgaggtgggtggatcacttgaggtcgagagttcgagaccagcctgaccaacatggagaaaccccatctctgctaaaaatacaaaattagctgggcgtgatggtgcatgcctgtaatcccagctacttgggaggctgagacatgagaatctcttgaacccaggaggtggaggttgcagtgagctgagattgtgccattgcacttggcaggctgaggcaggagaatcacttgaacccaggaggcagaggttgaggtgagccgagattgcaccattgcactccagcctgggcaacaagagtgaaactgaaaaaacaaaacaaaacaaaacaaaacaaaaaacaaaaacaaatctgcagttgatcattttatgtttgcaagagtcaccacatcaacagtcagtcatagagaagtacataaaaaccggaatggcatttggctgcatttctctagccacctccactcatttggcaatgcctgaaatgtgaagccgtatccaatttctgtttgtaaagatattgtgatccactagcaatgtctgccatgagtgtgaacccatgtgtcccatgttcgttcatcctagattcccagggactttgttcaatgcaaggtggttaataagcggcacaggaatagggaaggctgttggatattagctaagtaagattaggggatttttaaagcgtgggctacaaagtctggagaaaaatgccctcaggatgcatgagaacctttaactctgattattctctctctctgatactgtggctcagattaaaagcacagccttggaaataaaacagatatgagtccatgcccaagtctaccacttgcatggcttactttacttaaccttgggcagtgttttttttgttttcttgtttttgtttttttgagacatagtctcactctgttgcccaggctagagtgcagtggccgtgatcttgggtcactgcaacttccacctcccgagttcaagaaattctcctgtctcagcttcctgaatagctaggactgcaggcacccgccaccacacctggctaatttttgtatttttagtagagacagggattcaccatattgatcaggctggtctcgaactcctgacctcagatgatccacccgcctcagcctcccaaagtgctgggattacaggcgtgagccatcgcacccagctttgggcagtgttcttaatgcctcaagtctgtttttccctctgtcaaggatataatacttatgagggttgcctgagactgcttggaaaccttgaacatacgggaactaccagaggcactatagccttgagaattaaaaccgtaataaccctgagaggtcctacacagcgtcagtaccccgcagcaagactggtagaccagatctttgcatgcagttccttttcatgttcttttcagagaagacagaaaatctctgtagagtgtatcctaaagagttctctgtgttgtggaaaacacagctattgatcttgtcaaatggcaggttgtgtcagctggaaactgctgactagtacgttagagctgaggcttgacatacgctctccctcggtactagttagttgtctttgcagacctcccagctcaccctcactggcagccctctcagccctaagtggggtgtgaaagagaaaggactatcttttcaaaggttacaaattcctgctataccttggtaatttggtgtgaattaaagtgtgtagcttgatcttcatgatattcccgggtgttccaaaactgggatggtacctaatttctcaagttgaccctgccctgaaacccagttggagataaaacagtggcgacttggatctcctgatgaggaaagcaaatgacaatagctatgttgaagaatttcattccaggactctgtccccatgactgccacatctccttccttctcagtggcattctctatatgatggacgcgttcagtcacaacactcccttgctctggaggtaagagcatggttctagtgatttctctgaactactgggagccaaactctttgtagggtaatggggcctggaattctcttgtgttattcctaatatcaccctgtttccagattgaccaagttccagggtgcaggctagaacatctggggcgtgcagaaaagacctgtgcagaacatccagcctttctcacagaagcaccagctcagtcctcttacggtcatgtcacctgccaccttcccagtgcaaagttacaggttatagagagctgacacaaataacgagtaaaaggttactctgtgtgttgaagagtcatctttttgttttcttgcttttgtttttgtttttttgagacatagtctcgctctgtcacccaggctggagtgcagtggccgtaatcttggcttactgcaacttccacctcccgagttcaagcaattctcccgtctcagcttcctgagtagttgggactacaggcgcccgccaccacacctggctaatttttgtatttttagtagagacattgtggatgccagagatagagaatagagagaaccctgtggactcgtgggaggctctctgcctgaattagacataagggaagtgccagatcacattctggtggagaatctatgctcagggaaggtctggtttcttaaagcactatcacaggagagggcccctaaaagttagtgcccccagtcagatgtatcagtcaggaaagagccccaaggatgggtggacagtcagtaacctgcagctccatctgcctttccccaacccagggcttcccactttctcagaaccccagtgtctcatacctggcggcctcctccttcacttacggaactgtggactctggactctgatatatgtggaacctccatgtcttggcacactggtaccccagcacccccaaatgtgcagtgtctgtgtgtacagtgggcacaccagtattgagtcagctgtagcacagatcggcatggggatgctgtactaagagtccgacccagaaaatgagttagaatttttctcttaaattttccactccctccgccccttacccccaccctaccccctcatcattttataaaacatatgtagccatcgcctgtaagatagattggccacgcacggtggctcacacctgtaatcctagcactttgggtggctgaggcagcctgattgctggagcccaggagttcgagaccagcctgagcaatgtgacgaaacccagtgtctacaaaaatatataaaaattagctgagtgtggtggcacacctgtagttccagctactcaggaggctgaggtgggaggatcacttgagcctgggaggttgaggctgcagtgagccaagatcatgccattgcactcaagcctgggtgacagagtgagaccctgtctcagaaaaaaataaataaataaaaagttatcttaacttctcccggacaccccatgttttactaacagggtcttctctggagctacacaggtagcaaagtcagtgtttgctaattgcaaagcacaaatcatttatctcagaaaagaatgctaaagacattgtgctaggtcacgtgtccccaatatgcacctgccccagtatggcctcattcatggtagacaattgaaactctcaggaattcctccctgcccaaaagtagctagccctcatgtccgctgctatgcaggagggaggtatgtcctggtagtcatcaaatggtgtgcttgaaacacagtggcctgctggaaatggtggctcacacctgcctgtaatcccagcactttgggaggccaaggcaggaggaggaccctcatctctatgaaaaactcaaaaattatccaggcacggtggtgtgcatgtctagtcccagctacttgggagcctgaggtgggaggatcccttgagccttggaattcaaggtggcagtgagctatgatcacaccactgcacccagcctcggtgacagagtgaaatcctgtttctaaaaaacccaacaggccaggtgcggtggctcacacttgtaatcccagcactttgggaggccgaggtgggcagatcacctgaagtcaggagttcaagaccagcctggccaagatggcaaaaccatgtctctactaaaaattcaaaaattagccggccgtggtggtggacatctgtaatcccagctacttagggggctgaggcaggagaatcgcttgaacgggggcaggtcggggcagggcggcaactccctcttaaaaaaaaaaaaaaaaacctacaccacacaaacaaaaacacaatggctcaaggaggagcagctggtcagggaacctcatgggatatacagctcccaaagaaaaaagaagtcacacaaaaaagaattcacttcttaaaattctgtagagatgaagaacccactgagaccacagtcagattctgaaaaaagcaatggcacatgccatagagacctccagagatcaggacaagtttgcagtggggcagtcataaaaacatctgtccggttcctggagccaatgttaagaccattcagagacatcttggctgggcaggttccttgggcacggcacaagggcattgcagcacccaggtccatggagatcacaaaggattcttccagcatgagtgggcacagaagattccccaggatgcagggaagtgacagtctgtctgttcagctcacttactgagtacatgtcctgtgccaggtaccatccagttaccagggtgcaatggctatagctgacccttgagaaattagcaatttaaggtggggacagacacatagatggctaattgtaattcagtatggtgagtactcttaacagagaattgttttttaaaatcctactggctcaaaaatcagaaaaatatcatttctgcccaaagagatgtcagggaagaatatggagaggaggaagacctggaaggctgagttaggaaggaaagaattataactagatttgaatgtggtcaaaaataggacgtttatttccaggccccttatgtgaggtgtggtttgagcaggagcttgagattccagtggcagggtcccctcaggctattgggaacatttatttttccttgaaacatgaagcctcctaggaggcctgcgtgtgctgtttggtggatacgtgaccatggagcttgggaggccgcaggtttttctgcacccagcctcactgagctgttttctctgtctgtttccccagctcggagtccagtgttttcccacttatcatcttctctccaggggctctggaccatccgggcatacaaagcagaagagaggtgtcaggaactgtttgatgcacaccaggatttacattcaggtctgtctatttctggaaatggtttcaaaggacaggatctgctgctttttctggcttaacctccctggtcagatgagcttgttggcaggcacctcagggcccagccccacatcctgctttttttgcgcatcttcgtctccttccccatccccttcttctgggcttggactcctctcggaatcgctgctgcacgttccctctttgtgccccctgactggcttgtggggtctttctctcaccatgcatggcctgtggctctgtcagcaaacgttttctgcaaaaggccacctagtaagtgttttaggcattgtgtgccattattgtctctgttgtgatgaatcacctttgccattgtagcacaaaagcagatgtcaatacattggcaaatggctgtgactatgtttcaataaaactttatttacaaaaataggtgctggctcacgtgctgtagtttgctgaccccttgcatcagtgaagattttttcaatatggaaatttcagaatttccaccaaatctacaaaattcagatccgtcattccaatctttattttatcttgctgattaaatggcactttaaaaaccacatgctaaaaggaaaaaagaagtagcaaacaaacaaacaaaaaaccacatgcaaatcctgttagtgaggtcatttttatatagcccctaagcaatagtcagtgtgtgtgggccttctggtaagtatggaaggtgggagaagtaaaatgggagctgcactctgctgttggagaactggaccagtcaaccatgtgtgtgggtggacttcacatgagatgcacttcacataagtatttctcagcactgtacgagatgtccttatgagactacttttctcagttctttattaggatcatatttctgggtttcatattcgcatgcatcctcacagaaagccacggtaccattgtgtatgtgtatcgtatattgcctgtatcacttagctttctggaatctaaaggttccttgggtgtgcaactttggtgccctactccacgtaaaaatcttctgtagctcaactgagcaaaacacactcgcacattcatctacttattcatcatgcttattaccgttctcaaattcagaggcttggttcttgtttttgacaacgtcccgctggtttgccgtccgtctggatgccatctgtgccatgtttgtcatcatcgttgcctttgggtccctgattctggcaaaaagtaagtacagatgtgaataactatgtatggtatgattacaatttatagctgtgtttacatttattaaactcttgccaccttgtctactactacatactgtttggtcctaatgaagtgtattaaatcatttacgatgtgtcaggttgggtaggattcagcagtgtgactcatttaaggagtcatttgggtcttgatgggtttatctttctttgaatgggttgagatatgcgcagttgagattctgaacattcctgttagtgtctggtagttgtgaagagaaaaccaatttattctgaagcattttgtccaacttagggtgttagccttccaactacttgaatctattgtttgtagttgcctggtgcatgaggttgagaaaaattctcagcaggagagtattatcttcaatgccacatgggtaccagacaagcagggcatgagttcaccaccccagtaacaacagtgcattacaatacttaataatggaacaaggagagtagtattttagtctcaaaagcattggcacttacaacctattgctttgtttttagtggtttccagctgtggttgcattgcacgtagaaagtggaataatgtaatgagctttgaaaccataataatgaatgtctgaataatgacattatttcttgcgtttgtaatactgttaattaaatctatgtcgatcctgttggaattcataaaatcatctaaaaatttttctaaatatacagtgttgttttccccattgtatcttgatctcaagcaacaaatggtaaaagtatagctattaatgtcattaaatgtgaattgtttcaacattatgaagggttcctcttggtaagtggcagaaggagccaggcttaggtttgaagtgagactgactttattcccttcttcctccttacgtagctctggatgccgggcaggttggtttggcactgtcctatgccctcacgctcatggggatgtttcagtggtgtgttcgacaaagtgctgaagttgagaatatggtaatatttaccttcacgttctttgccttttcaatctccttgccattaaatggtataaaagccattcttatgtgaaatattaaaactgttatttttacatctttggtaacagattttttttaagatccttcctccatctgtttaaagttaatgtaaaataaaatatatacatctttttctgagtcttatggttgctctgtcagcaggttttatattcatcacaagctttttcagatgtaataaatgtctctgtaggagggaggttctgaaattctagagaggatataagctaatttcttagaagcctgtttaattttgtttcttaacgggtaattcctcattcctgttaaaagaagacttcagtattttgaggttgtttacatttaattaataggtctcctcctctcccagttctagcgtttactctcttatgtgaagaacagaagggaggaaggccttaactttgctggtgtgccttcttggtacagaaagcctcctcttggaatgtgctagtcaaagggtattagtttatggtggtataggaggctttaatcaatgttttaaatatttgcaccttcccctaaagagagaaaagcaataaacataaaaatcttttcattcttctcatagagcaaaagttgagtaattattacagtgaggtttcacgatcatccagtttaactgacctatatcaggtgatccttctatagcaaaagattcttttttggggggtaggggtgaggggacagagttttgctcttgtaccccaggctggagtgcaatagtgcgatcttggctcactgcaacctccgcctcccgggttcaagcgattttcctgcctcagcctcctgagtagctgggattacaggcatgcagcaccacgcccagctaatttttgtatttttagtagaaatggggtttcaccatgttgaccaggctggtgtcaaacacctgaccttaggtgatccacctgccccggcctcccaaagtgctgggattataggcatgagccaccgcgcccagccagcaaaagattcttgattggtggctctaagtattcctttcctttacaaaattttcttgcctttaatacaggtgtgagaagtggataaataaaatctaagcattcatttctctcattcttttaacctaatgttgaaggaagtggttgtaagtgaaggtgttacacaatgatgaaccaaatttgtaagtcatcaacatcctcgtctgtctcctgcttctctccttaaccaactatgtatgaaagaagaacatttcattgacagtctcttaacatccataaatgacaccctccattcctaacccctcgggatgtcatatttctttcagatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggtttgtttaaagcatcttgcctcttctcaatttcagaagatttagtgctatgtctgcttgttgtcttccttgtggatgtgtgaaggggatcagtgatacgtaggttaacctgtcttggaaactaaccatggaatgtggataccaacattcttcctgctgtgaactgctttactgtggttggtgggccccgggcctcagggctggagcttaacgtgacccaggatactctgtttgatacctaattactcatggatttttccaggaagtcaactctggctttgtgtcaccaacactcctatgtctaattctgtcgatttttactttgttgcatttctcaagtccttctcttcccctccactgctgcagcttctgttccagcctttctcctcctccatcctttggtcctgtattagtctgttttcacactgctgataaaggtatacccaagactaggcaatttacagaagaaagagaggtttaatggacttaaagttccacatggatggggaggcctcagactcatgatggcaggcaaggaggagcaagtcacatcttatatggatggcagcaggcaaagagagtttgtgcagggaaacttccccttataaaaccatcagatctcatgatacttattcactatcatgagaacaccacaggaaagacctgcccccatgattcaattacctcccaccgggtccctcccacaacatgtgggaatttaagatgagatttgggtggggacacagccaaacattatcaggccctttccttagtctttcttgccttcctttaacctgtgctttgctttccctccccatccctttcactgcaaactctttctttctgaaacagtttgatcacagatctgatccttacgtggccagctccttgcctgggtgagcagctgctgcaaccttaatgagccccaggcccaccctgacaggacctgtctggctctcagcccccaagggaagacccagatcccatgaccccatcagtgctcagaaatcagacccccaagctggaggcagtaaaggcaccagagactcactcaaagtcagtgaaaggaaaacaaggagggacttgggaggctgtgtggagttttgtgagctggttttgcaggtatctaagtctgccagcaatgtccctttcacatgtgtcctggggcccttggctaggactaggacagcctcttgaaggaactaaaccagaacaaacaagacagtagaatctcttccccttcccacccctctcctcacaactcccaatatggacacacatcccctgcactcagggtgccctccttctccccaagcacctgtctgccttgctcttagtgtgcacccttttcagtcagttcaagcatctctgcctctttgaaactatattctccacatcatcttatagattcttttttcgagacagagtcttgctctgtcgcccaggctggagtgcaatgtcacattcccggcacactgcaacctccacctcccaggttcaagcgattttcctgcttcaacctcccccgtagctgggattataggtgtgcaccaccatacccaactcatttttgaatttttagtagagaccaggttttgccatgttggccatggctggtctcgaactcctgagctaaagtgatccgcccaccttaacctcccaaatcatgcctgggattacaggcatgagccaccatgcctggccagattctttaatgtaacatctgtggcccacccgtgttcataacagcattatttgcagtgagcagtaggtggaagcagcccaagtgtccattgactgaggaatggaaaaacaaaatgtgatacgcacgcataatggaatattatccagacttaaaaagaaggtgattctgacacatgctgacatgtgtgattctgacatggatgagccctgaggacattatgctgagtgaattaggccagacacctaaggacggtgctataaggttccacttacatgtgggtacctggagtagttagtcatggagacagaaagtaggatggtgggcggcaggggtaggggaatgggcattagtgtttaatgggtacagagtttcagttttacaagataaatggagttttagagatggatgatggtgacggttgcccaacaacatgaatgtatttaatataattgaactgaacattttcaagtgattacaatgatcaattttatgttactttaccacaatttgaaaagtacataaagtaccttttgtgtattttaccacaatttttttttaaagaagatagcacgatggcatgatttataattctgggtcagcatctcacagtaccctgagcctcttaaagtcagggagcattttatattcgtctctgtacccccagaaaatggcatgctgcagggcacatggtgggtgcctgtgagagtgagggatatgcacatacaaagaaatcggtaacaaaacacacacgacagctcccgcaacagcccgttctctgggtgtcagtgttagatactttcggaactgctcttttcagctcttcccaccacagacccatttaatgggctatagtcacaattgaatgaatgatacccttgtgccatgaaaaataaatatacagcttcatgcccagaagatacccagggaaccagcaaaagctgattcctcattatctacccagcatccttgtgagtgtgaagaaggtggagaccactctgcaggcagcatcagctgtagctcttgctgaaagcaaggtttctcagattctgttcctgatggggccagggggatgtttgcttactctcagacaatgtgttattaggtcctacctgatcaacatcattctgttagtttggccacgttgtaaatttctcttgtagccataaaatatgaattatctacaaacctctgttgtacacattagaaaacaacctatatccccacattgatatcgttccatcttaaaacccccccaaatcataggattacctgagatctgaaatgtgggagggtaaattgaatttgaagactgaattatagctacaaccacttggcttttgagacagagtctcgctgtgtcatctaggctggagtgcagtggcgcaatcttggctcattctgcctctcaggttcaagcgattctcctgcctcagcctcccgagtagctgcaattacaggcacccgctgccatgcctggctaatttttgtatatttagtggatccggggtttcaccatgttggtcaggctggtcttgaaccccgacctcaagcaatccacctgcctcgacctcccaaagtgctgggattacaggcatgagccactgcgctgagccccacttggcttttgatttgtgtcctggttcactcacagtgtcacctttagcttcatttgtgtattcaggcaacatcgtggtgagttggttccactttttgtgtgtatattcagggttcgtctcctccacacctgcctgcagccccaggatctcaggcagtccctttgctgttggagctgatggagaggggcattgtttccagtggagatgtaggaatgtgtccacacagcagaaacagggcttcattctctttcaattgcttcatctgctcagatttcctggacattataacaaataggaaaaagtaataggcgctaagtaggtttctaattcacagaagaaatagcaagtaaaaaagaatgaaccaaaatgaggtatataccaccctagccttcctggttagattccaaacactggctgcatttttcatttagatggttttgtggttgatttaatcattttagagagtactgggccattttaaagcatttttcagctctagaggtagattgattttggtttgttatttttttttccttgctcaaagctattacttggataatacctttttacagatgtgtactagaccttgctatagtgtgcaaaaatattagtttcttatattctctccttttttacattaatgtttgctgagaaacccctcctctcacagccagattgtcccacttgccctgcctgcttgctcatctcaggggctgggatcagcatcacctgcctctgcttggaaacatgttagaaatgcagactgtcaggcccaccccacccttttgattaaaattgcactgggacaagaaccacccccactcctgcccctgcattaaagccgttgctctccggtaagcaattttggatgactaataatctgtgatttccaagaaacttcctttgacaacttgaagtggagctcgtggattgccccagcccctcttgtgactaaacatgagactctggatagtcctgggccaagtgccaccctacaggttttttgtttttttacttttatattctgcaaattatgaatttacattacaatttaattctgtgtgattccccatttatgcattcatttgcacctttccggtcatctctgtcttctatcacagttttcatcccaccatacagccttccatgaatagcagtctctgtcctcataccagctcagcacagcgatgtatttgagttccgttcactactgatgggatcaaaatgggtctcactgccccacagtacactaggtctgtctggcctgtttcccagttgccccatgtccaacgtagctgcaggcttctctcccagcctcttctgtgggtgccagttcttcctgtcaacagctgtaatccaccctaatacaggtactgtcttggctcacagtagtcagcttcttgtcctagccaccttcttatactcacgcatgtccacagcatgcattaaatgtatgacaataggaccagtatggcaggccagtgcctttaaagacaaccacacttctccccgctgtctcccttctagctacaccaagggaatacagagccaggctatccaagtgattgggaggccatcggcagaatgggcaagaggcaggcagacttgggtttccgtcccattccatcacttaggggctcagtcatttcaacagtttaatcaatcttactaagcctcgatttttctcttttgcaaaatgcaagtgatagggcctagccattagagttttataacttaaacaagataagaggtgtaaaacacctagcttattgtatacctgaacaatatggcaatagatttcccataaatgtttcaagcctgagttaaatgcttaactctctgggggatttctggttttttttgcaggacaccacaggtgatacaaataatacaaagctaattccaatataggccctgcccacagcacctgtcgcctagtagaagaaacaaagtagtatataaatgcctgctccgtaagatagaaggaattcgcagattttatggctgtttagaaaagatgttacgacagccattaagtgtgggagaaatccacacgaggggacaagtggaggattttaaggcaattacacatttgaaacagactttagaaggtggttaggatttcagcaggtcgaaatgcatgtgaaaggcacgatggcatatgccaaggctcgatgccgtgatttgatatgaagaattaggcatctctgagcatacaagggcatgaactaccaggtgaataacacacatgtgcacacttagtcctcacagccaccccgcaaactcaatcctgctcatggagctaaggatggaaaggttagttgggactgttttgtagaggaggtttcccagtgtggagtgccaggcagagagctgtacttcggaagtttaatctgagaaatgagtgcacggggaagacgctgaaggcctgaagccaattgattttatgtactgctggcaagatgtgatggggcaagtgattccactttgtagaatcaaactaatgttgattaaaacaaagttataataccctggttagtgaatttgcagggatacaggtgggagtagaaattggtatcatatttctggagggtagtttggcatcacttaacagcctcctttgaaaatgttcatacctgttcctcagcaattccacatctaagaatttattttaagaaaccaattaagattgcttgcaaagatgtagcttcaaggatatttaacatggtattatttacaatagcaaaatattggagcctaaacatccacaaataggggatttgttgaataaataatcatatatactgtaatattatgtagctactgaagtaaatacttttattaaataatagattataatattctgtgcatattctcattttgcctaaatatatgagattatatctttaggaacacagataactcacactcaagttcagaaagaaaaggtattaacatgtgacaaggattctgtcagattgctggggttgtggccagcatttatttatttttcgaattcacttgcactgattataactagcaaaagagtttttgtttttcaaatgttaatgcagccttgcactgaggtaatggctgcagaaattaaagtgagggtattgagtcaagaaacagaacaagtaatatttttagtgcttggagttgagaaaacctgggagatgggtgttttgagcctgtgaacttggggaagaatttattagattaaaatggaggagttagaagcagcagctgtttggaggggggctgttgggtattaatcatgttgagtttcatatatgaagagagatccaagtacaaatgtctaatgtttggccaaagagaccactcttggcccagttggggaaacaaaaagggtcaattgtaaagcaattaaaataaaactaagtgtctctttcgtgttatgaatgtaaacttactgatattagtgatattctccagaggatttggtgaaacccattggtgacttatgaaagacttggagactgtaattttgatgactttgaagagaactaaccagagccaggttttctttggttgccttttgctgattatatcctcacctgagtttggagtgcctagtcttatggttgtaggcagccctcagtgttccctacctttgagggggtccatcctggccatctactaataatggcctacaaatgtccaggtttgcacagatggatcagtttcccatagagctgataacatgagtgtccacacattctcaaaaacacagcatttgtctatgtctagatacgtgctgatttactgagaaacacacataagccccacacacacacacacacacatacacacatacacgtgtgtgtgtgtgtatgtgtgtgagagagacaaaatatagtcaggtatttaatatttggaagtttctctaccaaagaatgtgtcatcttaaatgatagaagtctggaaaaatgaatacctgtttatgtcacttgtgacacctctgtcttgaattaatatccctgtgaaattatctcagaaattcaattggtgtgtgtgtgtgtatatatatatatatatatatatatatatatatatatacacacacacacacacccggatgtacctatgtgcagaaaatggcccacctataaagtataaactaggatttaccataaggtagaatatgactccaaagttaataaaattagctaaagccactttttaaacatttacatttttatattttgtacatgtatctctttaaagataaaattccttgtggaaatgccattattgactttacagatatggaggtgttcaaatgaggtaatatgtcacatttccaacacatacccagtgcccagtaaagttttgcagtgagttttaaaatttattaaataatggacaaatgattgaaggcatgttttatgtccttcgttgactccagatttctaaataaggaggatgtcatttcttgggaagttcccaccaggaaatttgcagttgtgcaaggtcattggtgcagaggccagtttctgcatacagatttatatgcacacatgtgaaagccagtttttacaatatagacgtattgcccccacctttttaccagcattttattgattctttgatcgtattggcagtgcacttcatttctctctgtcttggctttaatagaggagtgatacttgacacaaatgtttctcaaggggcaattgtaagtattaattagtttgcagcatgccttttgaactgtgcagatgaaaggccttacgtaaatagcaaatgttacttgcgttgttgttgatctcattatgtgttttttggctactggttactactgtcttttaagacattgcaatcttcacttcagaattttgaaacattttgagacaaaatataggcagatatttaatatttggaagtttctctaccaaagaatatgttatcttaaataatagaactctagaaaaatgaatactcgtttatgtcacttctgacacctctgtcttgaattaatatccctgtgaaattatctcagaaattcagattactcagatcctgcaagcaaagctaatttaaaagttgccttttcatgggccacttaggagactgttgacttttcaatgccagtaaacagattctgttattttcaactcttttttagaacagtggatctcaaccaggggcagttttgccccagaggacgtttgtcagtgacatttttggtggtatcattttgggagtgtgctcctggtatctatgcagtagggtccagggatgctagcgaacctcccacaatgcctggggcagcttccaaaatgaagaagtatccagctcagaaggtcatcagtgctgaggttgggaaactcttagactacactcaatatagaatgtccttaattcttcttcaaaaaccgaaagttttctcctagttttgctgcatcctgtgatttttttctttttttttttaatcctgccgcctggatctctctgtaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggtatgcaagtcatagcgtccttacctgccccttttataagagctactatgtttaattgcttttactcttattgctttttttaattggatgaaaggattgttttttttttcacccaatagagcatgtttttatgagcagatattttcaacaggtattttcatcagatatccagctttgttcatttctctctctctctgtgtgtgtgtgtgtgtgtgtgatatttaataacttacgcagatagatttctgtactaagatgccacagttttatccactgataaccataaagaacaaaatgatgcattgtttgtttagcactggggaggtttctatggggagatgtggattttaagtgtcttaatgttggaattttgctgtaggaactaaagctaccttctcaaaggtgattacctccatgaagggctttctgtgaaactgtgggctgtgagagttaaaaaacttatagttggctttgtggtgacttttagaatctagctcttggtgaatgattttaaccaggaggttgttaaagaatagcaaggaagaacatgagagacggaattccatctctctgcacttctgcttcatcttccttacgatcaccattgtgagagtgtgtggtgtatttcacacagacccagtgagtgtttgctctgatggtggagggttaaattggccatcctttcccggactctgattctattttcttttcttctcctttgcagaagtgactctcaaggagtgttctagagattggattatttgtacaataagagctcctgtcattgctttggttcatatttaacataaattcagaaagtattcattgagtaattactattctccaggtgtatagtcatgagcaacatagaccttgtccccaccggcatggggtctgcagctgtggggcctcatggcttccatcggacctcacagttccatcctgtccttcactttaacacctccacatattcaactccagacatggctgggttttttgtttgttttcttttaatgtgggttttttttttttttaacactctatagtcattgaggggagctgaggaacacacacacacacacacacacacacacacacacacacacacaaacacatattctggagaagagaaacacagagaggagacaagagcaaaacccaggcagtaatgagctttctgggcatgtggatataaacaactcttcaatgcctgtttagtaggaagcatagagaacgtgccaccggaagggaaggagaatgtgatttttatcttagaccaagtacagttatggctatcctagcactgacctctaaaacaattggaatcacgcttaagtaatttggaggatgtgaagaaattggaaccctgtgcactgttggtgggaatgtaaaatggtgcagccactttggaaaacactgtagagattcctcaaaaaatgagagctaatgtgatccagcagttccacttccagaaagaattaaaagcaggatctcagagttttgtacatccatgatcatcacagtacccaaaaggtggaaatagctcgtgtccatcgccagatgagcagatgaataaaacgtggtctatccatacaatgggaaattattcagctttaaaatggaaggaaatcctgacagtctataatgcagatataccctaaagacattatgctaagtgaaataagccagtcacaaaaggacagacactagatggttcccctaatatgagatacctagactagtcaaattcacagagacacaaaggagaagcgtcgtcaccaggggctgagggaaggtggggggttgggagttacattatttcacataggacttcagttttgtcagatgaaaagcgtcttgtgaatggatggtggtgatggctgcaaaacagtgtgaatgtccttaagaccactgaaatgttgactttgaaatggcaaaagcagtaaattttatgctatgtgtattgtaccacaatttttatttttagtttaaagaaaaaaaagtatccctttcaggataaaatgggaagaaatgtttagcacgttagattccctctggctattagaagcatgacttagtgcttacagtagaaaatgagagtataaattctcaagttttatattttggttatgcccatctcaaaaatgggccaaatgaggtttacttagcagagataatgggcatgtctgtaaagtgcttttatatccttggatgaaaggttctaggaacgtgccctgcattactttgaatgaattcttaataagaaatagttgtgtgcttgtgtacataaaagaactctaaataaagaagtaacattagatgattcttggctctgccagtaatgttttggaagcacatctgagcaaagactaaatataccttgacatcaccaggttttggttcagttccataagtttccaccctacttttgagcaaatgctctatgtatgtagtccagggagcatgcttacaaaacactgctaagctttgtatccatgtagatcctgatctccaagcattgtaaacagagagactttcctttttaactttgtatggctttgtctccaaggctcaatgttggttgaaaaaaagaaacatagtctagagggactgtgcaatacttaatgcgacccaggaaatcattcagcagactgcctgggatagaatctttcagagcatcttctaagcgtcaacacgacccacatttttattccagcactgcctgatagaagtgtgacctcaatgaagtcacttagcctccaagcttcagtttcctcatccttaaaccaaacctagtaattactaacttacagatttgttgtgaagattttactagatgagaacatgtttgtggccctactctgggttctgaggaatgctcaatagtaactatttctaattaaggattggggtgcaggcctttagggcattattgctactcgctattctagaaggacttggctcattaacttctgtttctatttttgtgatccttggtgaattcctttaaccaaattgtttatgtaaatttaaatagtgaagcagcaacaaacaaaaaaaaatgtgcacaataaaagcctaagagagaaatctaatgtttttctcacaaggaacaaaaggtgaggctatcactttgttttctggctttcccccaccccggtcttagcggcattcctcaccactctcagtacccctctaatgctttgcatttcgcgagcaggcagccgacactggttctcagccctgcgtgagaacaggggcttgtccctcttagatccagtgctttagtgattgttgcgtcccagacaagttacacaagtagtgagaattcctaacatttgcagaatccttaacatggttatcttctttccttgccatctcccacttcgtcctcacagcaattctgtgtcatcctcatttgacacattttcaaactgaggcacagagagcttaacccacttaacaagtaaacagcagagtcaggattcaaatggaatttacggcgaatctcaatgccagatcctgagttcctgaaccctctcctagggactttaaacccatgttggctggcgcagtccccgatcagaactctgctttgcaacatgatttagtgtgggcttgtgcaggtgcgcacacacgcacagaaacaaaagtctcacaacacgatattactccatgcttctgcgccctgatattttctattatatccattctattctggttcatataaaagacataaggatggtcatgagtcacaaaagtgatttcatgatccattggttgcacctgccatttgaagaacagcgtgcctcactgtgctgccctgcttggccgggctcctgctgcctggcagcaccgtgcaaggagccttatgacacagtgattgtcactgcagccctgcagggtgtgtcaagttagccccattctccaggaaggaaactaaggctcagggagattaataacttacctggagatgaacagctaataagtagtagaatcagaactcagaactatccagctcaattttttttcagtaagtatttgttggacagcatgatatctcatcagacattttactcattgtttttcttttctttttctttttcttttctttttttttttttttttttttttttgagatggagtcttgctctgttgccaggctggactgcagtgacgccatctcagctcactgcaatatctgcctcctgggttcaagcgattctcctgcctctgcctcccgagtagctgggattacaggtgcgtgccaccacacccagctaatctttgtatttttagtagagacagagtttcaccatgttggccaggatggtctcgatctcctgaccttgtgatccgcctgcctcagcctcccaaagtactgtttgtttttctgtctacccaacttacaaaaggttcccagaagccataaccaaagagagcaaatatacagcaaagtcaaaaggtatcttttctttgaactttatctgtcatttggacagttaggtcattttgaaagactgaatcatttgtgatttatttttatttttatttttattttttccaaaaccttaagtgacactaagcactaaaagaaaatcattttggaaacagagtgtattcacttatgtgtcgtgggctagtgagcgtcagaagatcctccaagccttaccttgtgggagctcagagccctttttcttccgaggcctcgctggctgcagagggtggagaaggctggagacttgaggttgcatgaaggttactggtctgcagtgcagaaagcatacacccctcttcctcagaagtgagtggaaagccaaatggcttgtgtcaccacacactgatgtagggaatctaggaagtttgggagcaaacacagcaaaagcagaaccaagtgctgtttcttcgaatggccatgtttgggcaagtctagcctgcatggcttcctggggttgtgtggagcacgagtttctgtgttctctctcttcctggcttatccctttcatttatggttcagggtcctctgtcactcttgaccacaccattagcaactcaaattcgtggttaggattaagcagcaaggacctgggaaagaactggggcacagaaatgatgacatacatagtcaggggccagtcctggagtcactttaagaaacaaatactgggccgggcacggtggctcacgcctgtaatcccagcactttgggaggccaaggagggtggatcacgaggtcaagagatcaagaccattatggccaacatggtaaaaccccgtctctactaaaaatacaaaaattagccggacgtggtggtgcgcatctgtagtcccagctgctcgggaggccgaagcaggagaattgcttgaaccccagaggcagaggttgccatgagctgagattgtgccactgcactccagcctggcgacagagggagactctgtctcaaaaaaaaaaaatactgaattcttaagaaagtacccctcaatttgtattcaaaatttcaggaagaagcgaacagtgaaagtacttcctaaataatttccctaaacagaatagttagctgaaatgtatgcttcttttgtgttcatgacacagggtagttaagtgcacttcccaaggagaacaccaaggtgatactataactcagacaagagtttgcttaactgaaggatctggaaaaatggatttcaaaactttttttaggatggattatttactcctccaatcctactggcacaaataaatgttttcaactaaagagtaacttcatgcaaattcaacatttatgatagcaccctaacggttggcatacatcaacagctataatctttgttaggattaaacagattcatttttcatatttgatggacttttttgtttttctatcaaagcaaaagctaagtagtttttaagcagcccactgctcagacttctgctatcttggtatttctactccctgaattttcttcagtaagttgaaaaggttaaccagagtgtgtctctttaagacttctttttttattacctgattttctttcctttttttttttttttcttctttttgagaacaaaattcaaagggaaaagaggtaggtatgcagttactagtaaagaaatacaattggattctggcctaatgcagtcagtcctttgtttctgcacactgaagtcttcattaaggccatggaactgctccctggagctggtgacctttttgtatctaaagaagactttacacgacttaaattctttttcctttgttggtgaacaatgttcttttcttctgaaaatggatgatgatcagttcattcagaggctacagggtttttttaaaaaagaagggaaaccaagatttaaagtgacttcaggtgattccctgattcttgacacagggagatgagctgccctgaatcaaggtcttcaggatttgaaatgcacacatagctctgaggacatcaggcagcagcagttgtggctagctactgtgcagtgtatattttaagagagcgaagtttcctggtttgggacaagattagggtaaagtattgtgctttgtcctgctggtttgtaactccccatgcgatttttgtcttggtcccaggtcgttttaagtgtctgaaggttggtggatagagtttcttcttgagataatgagaggcttgtcttccagaagtttatatgaaagctctaggaagactgtaattttcagtcttgcagtcctgctgagggattatcaatttactgcactaaatgctttgattcagagcggccatttttaggtcacgtggtgggttttttttttgctgttgttgctgttgttttgagacagtcttgctctgtctcccaggctgcagtgcagtggtgctatcttggctcacttcaacctccacctcctgggttcaagtgattctcctgtctcagcctcccgagtagctggaattacaggcgcaccccaccctgcctggctactttttgtatttttagtagagatgggatttcaccatgttggccaggctggtcttgaacttctgaccaccagtgaaccacctgcctcggcctcccaaagtgctgggattacaggcatgagccaccacacccagcctggtcacatgtttaatatcagcttgtcttatgtgagtaatgaggacaaaattactactcagtatggcgcaaagatttttaaaaagtatgacctttaaaccctaatgaaaaacaggtttgatctggtgcttcatttaaaataatacgttgaacagaacattggttttgctaacaatggaggttaaaactcgtactaaatgacattttaaaatatataccatcaataaatatgtacttaggctactaaatcttttacattttacatgaagattgtatgtttaccataaatctctactctgaaatgttctgcctgcagaggttggaattttagagttgataattacaaagagtaagtcaagtttttatcttttaatctgaaataaccagaatgatggttattcccctcacaagaaattcccaccattgtttagatggttgttcaggttttggtcttcagttgggtacttttaagacagaccttacctgtgactcttggaatttttcagttccatttggtaattcagaaacatcatgtgaccagtgacttttcagtgcttttggaaggatattggccactttatcagctttatacacacaaagtgcccattttaccgtcgtttccatttttgcattttgctgaggacttatgtttttggtggcaccctgtctgccttctacatccatttcttcctcaccagccttaaaacggagacgatagggaaagggatgagagcctccctggatatcatttttctttatggctggagaaaaaagaagtctaccacctttatctctcttctcaggcttttgggaagtgaggaggaacagtcctgccccaaagccaggtgagatttgaggccagtggttcccttgagcatttctccagtacctgtggaagagtctcaccttctcttgttcccacatctgtgcatccccttgttctgcccctatccttgaaagcagttgatggggctcctatatccttatggcctggcttattagagccttccagaagaaaagtttgtgtttttgtttttttgttgtttttttttttaagatggagacttgctctgtggcccaggctggagtgcagtgacggaatcttggctcactgcaacctctgcctcccaggtcaaagtgattctcctgcctcagcctcccaagtagctgggactacaggtgcccgccaccgcacccagctaccagaagaaaactttcacacagcctacctaagcttatgttcaagagtctctcttgaaatccaggaagaggctgatattccaagagtgatttaattgtgggatcctcctgaagcagatgaataggaacagctatttaaattgatgtaattttattatgacctccttcacagtggttttcaggtaaccctgctttcttagttaataatgaggttctgtgacccaggtaaccttgatgcacagatgagataatgtggggattcactgatgcaaaatcagaggcaatcctttcataagtagaggtgcctctggccccagttgtttagatctcctttggccaaaaaaaaaaaaaaaaaaaaaaaaaaaaaaaaaaaaaaaaaaggatgtcccattctgacattggagagatttttttttttttttttgagaaggagttttgctcttgttgcccaggctggagtgcaatggcacgatctcggctcactgcaacctccacctcctggattcaagcgattctcttgcctcagcctcctaagtagctgggattacaggcatgtgccaccatgcccagctaatttttgtatttttagtagagacagggtttcactatgttggtcgggctggtctagaactcctgacctcaggtgatccacccgcctcgacctcccaaaatactaagattacatgcgtgagccactgcgcccggtgagagattcttaatcttggaaaactgttttgccaacggagaaaataatcctaatttattctttagtgcaaattggaaaatgcttaataatttggctttgaagcacaaactttaatcatgctgtcggtattttccagtattacatgattgatagttaatttctatagctctattcatgtagaccctcgaataattatatccttatatttcatgttaagctaataatatgaggaaaacagttttaaacatcaggcctgtatttttcattttcttcttaagatagcacattgcaacagttttgttagtgttcagtggtctggaaggtattttggagcacgctttgtacagtggaacattaatagatatgttgttttgtaaacaggcatttgtaacgctataattattatcatgaattttattttttggtatcttaattctattgttgatgttagcattggaataaaatgaaaaaagagtctgtggtaatgaccgtgactattttgggcacttaggaacctgttttgttcactggaacaatgaggaaaaacctggatccctttaatgagcacacggatgaggaactgtggaatgccttacaagaggtaattgataaaatgtaattatctttagtctgttagcctcagtatgtgtatatgtacctttacagcattgcaggaaattaagaggagcttagcggtttaactaactttgttcaccacccaggagatcattgaggatgtggatatgctataatgtgtatactgatgatgatgaaaaccaaaaataaaatttccctggttctcattttaattttcttcctgttgtccaaaacagtttggtgttgttttatttgtctttagcaatgcgttaaactagaagttgtatttatgagttgagatcctattagtgactaagttactctgcaccatttattttactgctctgttcttagggaatttctagtaagggaagaccatagtcgtttttcattaactaaaagatagatcatatttatgaaatgctttaagttttataagaaagtgtttataaaggtaaattatacagttggaatgggataataattatttattggcaaacgtgtaattttaatgcagataacagaaccctgcagcctctgctaaggttttatactaatatgttgatttctagaggatttttctattatttatgtggttcctgttgggccacttcttgaaattttctcacccttgcatgaaaaaaggactttgactattaaggtgctgttggtttgtgtattttaacactgattttctgtgttcagtctagttctgcaaatttgtgccagtctacttgatggcagaaaccatatcataaaactggtaatccctcacaggacctagtttagtcttttgcttttaaaaagtaagcatttaaggctgggtgcagcggttgatgcctgtaatcccagcactttggaagtctgaggtgggtgaatcactggaggtcagaagtttgagaccagcctgaccaacatggtgaaaccccatttctactaaaaatacagagattagctgggtatggtggtgtgcgcctgtagtcccagctactcaggaggctgagacaagagaattgcttgaacctgggaggccaaggttgcagtgagccgagatcgtgccactgcactcccatctgggcgacagagcaagactccgtctcaaaataaataaataaataaataaaaataaaaattggccaggcccggtggctcatgcctgtaatcccagcactttgggaggctgaggcggatggatcacgaggtcaggagttccagaccagcctggccaacttggtgaaaccctgtgtctactaaaaataccaaaattagccagacgtggtggtgcgcatctgtagccccagctactcaggaggctgaggcaggagaattgcttgaacctgggaggcggaggttgtggtgagccaacattgtgccactgcactccagcctaggcaacaagagtgaaactccatcccaaaataaataataaatattaaaagttaaaaaaaagtaagcatttaataagtatgtattaatatgtttgatctcttcatttcaaagaagtgtggagcctggacaacatggtggactttgtctctactaaaaataaaaaaaaaaaaagaattagccagatgtggtggcatgcacctgtagtcccagctactcagggagttgaggtgggaggatcttgtgagccctggaggtcgaggctgcagtgagccatgattgcaccactgcactccagcctgagtgacagagattaatttccctccattgttattgttgttgttttgaattggtgcatttgtcattgttgcccttccagggatagctctgaaatctttaatttatagatgggttttgactgtgagcaagtagacttggaggcctgacagtttcctgccagtaattcttgtttctgaaggcatgtcattgccgagtccttacacacccaccctgctttccagcaactgtggggattttctttttctaaattaggtcgattacttcacctcctgatacttgataagcaattgacctctgatttcatttaaatttgtgaatctctgtacagtgaaattctaggagagaagaggtgggtacagttaactgtcaaatgtaaagaaagataaggcaatcctgtgcccctaaactctcaggacaggtttaatagtgaaattgtgacacaccctaaaagaacaagaattactcataaagtgtttttctatttgtttcagagcttgagattccttgtcacagattctcagagagcaaaagtactttttagaaacacatttctctatgaacagtgaagaaatgttaattgggagatgatcctatcaaaaaccatcatggaacttgactgtaactcatacttatttcatttgttatagccaaaattaaaataaaatttagtagcctctcaagaattctagaaatgatgaggtggaagacgtggtaggtccccctcagaagtgaaaaattatcccatcattgtctttctctgggaactacttctttatggcattgtaggtttttctgtgaatgatttggaagagttactaaaaattagggtacaacattgtatttccagtgtgattccagctgtttttaatcattcttatattctgacacctgacctaagaaagacaccagagcatttacattgctcgtttgggggtaatgagacaaagactggaggagagtgttttcttttctctacagttttcctggattttccaaatttccttctgggtgcttgtattctttttaccttctagatggtcaggggaaaggctgagcactcctaacaaatgaagcattgtgagtttttcacaacaagtttcatgactacaagttgatggaggctgggggcattctgataggtcaggaattcttcccctggggtccgtggagtctgagggtcttctcgtagagaattccaaatcttacttcctggtgattgtaaacgtgaagttatgtgtgtgtgtttatcttgagagataccacacaagggattcagcaccacgactctggtgccattcaagtttctctggacttctctgtcacattctgtctctctgctgtctccatggttttcatctttcattgatatccagttcagaactggataactcatcttgctctttagtaggaaacctggtgtcatttggaaaccccctttaaagcagacaaaaaacatagtcacttggtttataaatgaggccaaactggaaatgggaacccaaactcagagggttggcttgagattaggacagcactgtcagttttttcctctttaaccacttaaaaggtggtttaaccacataaaaaggaaagatgccttttatttcttggaagttttttttatttcttcttacccatgatcccttggaaagggtaatacctgacatgcaaaagaagttcgggcatctggagggagacagtcctatggatgtggttgtgtcatcttggttatttttttatttatttatttttatttatttatttatttatttgagacagagtctcactctgtcatccaggttggaatgcggtggcacagtctcggctcactgcaacctccgcctcccgggtccaagcgattctcctgcctcagcctcccgagtagctgtgattacaggtgcctgccaccatgccggctactctttttgtatttttagtagagacggggtttcaccatgttggccaggctggtctcaaacccctgacctcgtgatccacctgcttcagcctcccaaagtgctgggattacaggcgtgagccaccgcgcctggcctatttttatttatttatttatttttttagacagagtcttgctctgtcgcccaggctggagtgcagtggtgcaatctcagctcactgcaaactctacctcctgggttcaagtgattctcctgcctcagcctcccaggtagctaggattaaaggcaagccccaccatgcctggctaatttttgtatttttagtagagacagggttttgccatgttggccacactggtctcaaactcctgacctcaagtgatctgcctgtctcggcctcccagagtgctgggattacaggcgtgagccaccacaccctgctcgttttttggggtttcttttctaatgctgaaagttatcgtaaatactgaaaaatagtcagctgtaaatggaagaaagtttactagaattagtgccacttcgggcccctaaataagagcaactctgtaaatataacgtaagtaatgattaaagatggaagtcgtttatgagaaaaaagtcaaaagatcacacagtaggtacaactaagaaaatgaatcagcagcacgttatttctgttaattaaaaaacgactttaatactgggatctacaattaagactaggttatatcatgttggaatagtggagaaattatctaatcatgttcaacattgatagaattgctgttagaatacaaggatgtcttgtattcaggacaccataagacagaaatctgcacatcagcagtgtccacatcctctgggccttctattccccacaccttgcacctccatttttcccaggcctgtattgcccagaatgggcttccgctcgcttcgttcacacttagctgtgttcttgttaaaggttgttcccatctgttgagttgctgtttatcacatttcagtctctggcatcagagacttcctttatgaaaagtcagaaagttcaaagaaacatggaaacagaatctgacatccacatgagtctctttgaggctttgaaaacatttatgatgatagaaatgggctgtcttagaaagttcagttcattattttcacttttcctgtagtttcctattttttctaagcttcaaaataacctgatacattgtgtttgaaatgtatagtttcaaatagtatgatttgattttgttttcctgaaattacaacctttattaaatgtagaaaacattaagttttctatattttaaagtataatgttatgatatcttggagccaattaattttataaggactgtttcttttacaatgacatttagtaagaaaattgtatgtaaattctatttctttgtggatttactttgtaatttataagaatagacatgtcacaaaatgaggtatccttgtgacttcatacattcaacagattatgtgtggggaggtttttacataggcattgtagactctggagctatagcagtcatcaagagagataaaatccctaccctcttagggcacaaattcttgtatggaagatagaaaataagaaaatgcatatgtaatataatattaggtactggtaaatgcagtgaagaaaactacagcagtgcatgaaaagaactagctgactgcattattaaaaataggcggctgggcgtagtggctcacgcctgtaatcccagcactttgggaggccgaggcgggtggatcacgaggtcaggagatcgagaccatcctggccaatatggtgaaaccccatctatactaaaaatacaaaaacaaaattagccaggtgtggtggtatgcacctgtagtcccagctactcgggaggctgaggcaggagaatcgcttgaacctgggaggcagagattgcagtgagctgagatcgcaccactgcactccaacctgggtgacagagcaagaatccacctcaaaaaaaaaaaaaaaaaaaaagaataggcagtatttcattgtccaggaaggagcaaaataaacaaaaagaatagatattatctattgatctcttacttggtaccaagcactattgtaaatgctacacatactgactgattttatactccaacaattttaggagataaacatcttcaaaataatcttagtatggtcttatttacaagttaattaggaagctaagatagagaaagttcaggaacttgcccagttggcagagccaggcaggactcatacccatgctgtgtgtcttcaaggctccatttttttattttaaaatgtccaaatcacagaacagtcaaatgaatagtattatgaacatacacatacccttctccaagattcaccatttgttaatacggtattttgctacatttgcttcctctcttatagcccttgaaagtaagttgcagacatttccatgaagttgcagttcatccttaaatatgtatgtgtacctcctaagaacaagaacattcaactacatgacataatacagttatttacctcactgaagaaattgaagagtaatgtaataccattgtttaatatattttcaatttccccagttgtcactcttagtcactgtgttccactgcctccattgtctttttctcagtgctaatacttaaccataacttgaatgtatgataacactacagagggccttcacattcatatcttttttttttaattgagacagagtcttactctgtcactcaggctagagtgcagtggcgcgatcttggcttattgcaacctccgcctccctggttcaagcaattctcctgcctcagcctcctaatgggattacaagtgcccgccaccatgcccagctaattttttttgtattattagtagagatgggatttcaccatgttggccaggctggtctcgaactcctgacctcagatgatctgcctgccccagcctcccaaagtgctgggattacaggcatgagccactgtacttggccatacattcatatcattctcataaccatccccgattcaatcatgatgacagagtctcagaagacactgttatctgggaaatgtgttcattattcttcacctcacaaccctattcttcatcaagtcaatgtggataacctcaaggagggtcaaaacccagaagaatgatgggttggccccttaatcaagggcaagtgtgagattatttcttcaaatctggctgccggtcttagaaaagacctttttgcacttaccagtattatcaaaatcaactcagaaggaaaagctaataaaaactttgctaacatctacttttgatcagttccatcacatggggtataggtctgtgagtatgtttcataaaaagattactcagcaagtcctcttctttgtaatggagagggtttgactaagctgacatattccatcctataattttcagggtaacattttgcaccacgagccaaatcttacacttcggattttaatttcctaccttgcatgctaatgccaaatatcaataccatatttaatcttaactcaaaattcctgtttcttggagttggacttccatcatgagtacaactcaagatcacattcatagaagtgtgcttccgtgtttaaggtacatgacaatgttacccgtttactcttggctttttgttgttgggcattgtagttctgtacacctgcttattggccatcactcatctatctgcttgctgatctcttaattggagatgtattgactcttggttcctctatagctctcaaatgtcacctgagtttggctcttgttctataaaatttctccaaaacaaacatcagtgaactgaaccaccacccaatgtagtatcagatcatcttatagctacaattttataaagatacattaatatcaacatcatctatccccgtcgtctggggcaagatgttatattgtgtcctgtttttttgtgagttttcattcactgcaaaacatttattagactgtagaaaatgtactgacctactttatagccataggggcttaaacttgggaaaggaccagcccaagaataagctcctgatttcctaacaaatgaggcacagtttcccattgtttgcatttgtatttttttaacttttccagttgattaaaaaaccttccaaaatggtaaagtgcctataagatgatatctttggaggaccatacttcctgcagtaattttctttttaaattttcccttgagttatactcactcgtctccaaaatgtgctttgggaaacttgactcaaccagaaagatcctttcaccttttcttcagactctatattgggagcatgagcttcattttttgagaaacttccttccctacctggaagaggggttcttgttggctgtcatgttggttattggtaagggagttcaggtgctgggggacactgatatgatttttttccaacaactctattgaggtctaatttgcatagcagaaaatgctccccttagaagtgattcagtgattttggtaaatttatagagttgtgcagtcattgcaggaatccagttttaaaacatctctcttaccccaagaaatttccttgtgtccatttacagttaatcctccagccccttggcaaccatcactcttattgtctctctaaatttctgtaatcttttaactaaaaagaagggaattttttttatctttctgtattttacctacagaatacttttattgatcatactgtgtttttcttaatgaaattggcccaggcagtattaacacgtgaccctgcatgaacagactgtgtttgctgatggtgataaaggagcatcttgggttccattgtttgttctcttaagtcagaatatttccgttttgtgttgactctaccatctttctcattgaacattaactagaggtaattcagcctcatgtgtgtgtccacttaagttatatctctcgagagaagggacttgaaggttctaatgtctatgaggcttgactacttccatagcggcttgaatgatagcagtcattcttctttgtacatctacaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaaggtataaagctgaggtccatgtaaccttgagtccacattttaagtgtgtaaatgggaaacatggaatgattctgagaaatatttctaagtgctctgtttgccccagacataacattttaacatggataaattcattctgaaaaaaaaagaagaaacccaaacgtgttttccagtgtcagagatattattcagtatcccaggagagctagattcctaaaatccactcccaataatcagctttaagcaatttggagggaagacatttttcgttgttttatgaaaattagtaaattactacatagatttttatacttgtttttaaagaataagattgtcctaaaacattttaacatgatttttaaaacattaaatagatatgatcttttttttttaaatctctattgtgaagtagagctttttaagtcttaagtctactttttgcatctttacgaaattaaacttaacttctttgattgcagaactgatgagttaatacaaaaaaaaatccgggagaaatttgcccactgcaccgtgctaaccattgcacacagattgaacaccattattgacagcgacaagataatggtgagtccttcacctgcggaattcctgttgctcccaattatgttcactttttcagtttattccttccttgtaaaacttgatagaaacccctagtaagttaattttctgttaattttggctctcttcccagcagtaattcatatgcttaactacaccctcagtgctactaacaatatatccaatgtatctctttgcatataatcatatgcaaaaatcatatgttaaaagtttaccatgaaaatattccaaatctaagattcagcttgtgatgctaactgtcatactacggagtagtatccaatagaagatcacagtcattgtcactgtcacagttgtttcagcatgcttgatccccttaatgaaagatttaggtttttatatactgcaaggggcttgttgggtaaggttgcagaacttctatgctgttgggacgttcacaagatacgtgtcacaggggaagagatgagaagatccatcacaaattattttcagagagggcctagccagaaaaacaaatgattccaacagaaaggatttaacataggaaatttgttacataagaattggagggcttagaaaatgaagggaaacagtgataattttaggaagcaaggccaggcacggtggctcatgcctgtaatctcagcactttaggaggccgaggcaggcagattacttgaggtcaggagttcgagaccagcctggccaacgtggggaaaccctgtctctactaataatacaaagattacctggatgtggtggcaggcgcctgtagtctaaatgtatcatatagacttcttgttgggatttgctgttaccgcattggtgatagctactccttttattatctaatgcttggaagtgctgtcaacttagaaggtctgattagttagagagacagcaagcaaggacagaacttggcagacaagtcagttggtcactcctaaatctgatcaatcagcttctgaccacataaatgtctagttcacaagcatcttcttgatccatcagcgctgttaccattattgaagtgtgcccattagtttattgctttatataccagtccctctaggtagattttgagaaccttaatttttttctctcttgagtaatgtctttatctaaactctgaacatggttctacaaagcaatttacagttggcccctccctacctttctagcctttcctccctctgttctctctctttcctttgcagtaaaagccacagtcctttagttattgtccttcagttcatcaaacgcagcattcactgttgcggtcatgccctctctacaccatgcacaatggcggcttagactatggtgtgagcagtgaagatggtgcaatggatagatttggagtaaatagcaaagtaaagcaactggactgtgatggattgaatgtgagatttgagggaagacaggggtagtcagtcctggtttctctgtttgggacctgactatctggatgaatgaggaagacccggaagaagtaaacttggaggagggaaaggcaagcattcccttggaggatgtaactgttgagatgaccttgcatttcaacatggagctttccttctcactcccaactccattagtgtctccatctatggcgatctctccaatgatattgggagagcttccatttagggctccctggccacgaggtcatcagtggcatcacaggaggtcctaccaggaggtataaatttaagtaaggagtcttattacaagctctgaattctttgtgagaactattttccaatttttcttaacaggcagtggcaggattcagcctcagggaacccaggagacatgcattctgtagcttgagattgggaactggcctctatgttccctcaacccctagctgaaagcatctcctgtattctagagcttctgatcatcagccagctttcaattcgggggaacaccataaataccattcttcctcagatctttgattttggaggtgttttgttttttttgtttgtttgttttttccccttgtttgctttagagataccgttccagaaaacacatgttctgttctgttattctgaaagctgtgaaaacatagagacaagtgaatcagctgcaaagctcagcactccaaaaggcaggctcagggagtggctggggaagtgacagatgttaatgaaggacataaccaacactattgtcatcatgcagtcctgtaattgcaagtgcttaaggtgtaataattacgttttgttgcattggtgaatacttctccacaaagacggatagatatagttttgtttactgtaagtaaatcaaacaaaaagcttgttgggaaacaactgcgacctaattaatagctttgtttatgtgttgactctccaaagggatttacccagttttggttcattaagcgccatcaatgtgttaagcttagaattttattttatgaagatgttctcccagttttaactttattaaacatggtgtagtcttaatgacagctaatttaatcttcatttgctcagttgccacaaaacagtagagcaagacagacaaattagaaatcctcttttttctaatacgcaccactatctccacattaaagacagcttcctccctgtagtttttaggattagctggttacttgtgacctgttttcctttcagccaatagcacagccttttcctccagtccctgcacacccgtccttacaacgctctggattctccctggtagtgtgagtgaacgaggaataagcgaatctgcagttagagaattcttcgggagtgaattacagagaagcaaaaccaggcctgagaaattcagattgtagctcttttctttgtaggcaatcttatgggtgtataatgtatatctttctttctaaacccaaatctctttttagtagcgtttcctcagagaaaacaaactagaaatcgttctagcagaaccagctggagaaacacaactcaaagctaacctgagttttatttaaattctatgtttcatcttcatggaacttctctttaagaaaccgacaacggccacaattagaacatttcagaagaggaaaaattacttcttgaaaaatatgctgagacatttaattaaagtgttcagggggacaaagaactaatgtgaaggtagaaagcacaaactggggctgggcgcggtggctcatgcctgtaatcccagcactttgggaggccgagaagggcagatcacctgagaggtcagaagtttgagaccagcctggccaacatggtgaaaccctgtctctactaaaaatacagaaaaattagctgggcgtggtgccgtgtgcctgtaatcccagctactcgggaggctgaggcaggagacgcttttgaacctgggaggcggaggttgcagtgagccgagatcgcgccactgcactccagcctgggcgacagagtgagatccatctcaaaaaataaaaaatgaacacactgggagaataaatacacacaattgcagagctttggggaagtggctgagtgggtcactgggacctacccttcatcttccccaggtgagaagaatcatttactgtttcaagacctgaggcaggattttaagtaatctttgccacatgccatagtatcttgtcccagagaagagtcacaggcacccattttaccagtgagggaaccaatctccaacgtcagatgactctccgtacacccctttcatcatggtggcccagaaacgacttctgaaatggaaaccctcccaccctcactctgcctgttgctaagtggggtttctctgtattgcttgctgccatagtgaaagctgttccgagcttttcttttcctatggtcaggctttatccttcaccctgccctgcccttcccctgttcctgagatcaccccactatcagcgatggcatcctgccaattaaatggattaaattgttttgcagtttgttcacttaatttttatatctaggacagctacctggaatatctgcagatatttaggcctgataaacacatcttcattgagcttatgtaactgagtaactgactaatgcattccagtataatgtgtttttccttgaccttctagagagcagcaagtgatttgaggtttgcattgctggagagatcctggggccacgggaccaacatcaatgcatggcttagtttacagttttacttgggtagaggaaaggtgaggaccaagcaggagatttcaggactgttttcatgtagctacagaagatatgaagatacaaattcaagattatgcccttttttctgtacaaaaagaaaattcagagtcactttattttgttgtaaaagatctagaatctttggtcaaatcagtaaatacagattgagtcccctaatctgaaatctgaaatgctcctaaatctgaaactttttgagctctgatgtgaagcttgtaggagacactcattggggcatttcagattttggattttcggattaagtatgctgaatctgtaagtatgtataatgcaaacattgcaaaattcaaaagtatctgaaatctgaaacacttctggtcccaggcatttcctaagtatactcaacatgcataaaggctaagtgggtaaagttctattcttagcattttttcatgtgcatcctaacttggcccttgtagcatcagattgttccttattttctcttttccaatatttaatttgtgagtcaagcctctgccctcattcctgctgtgtctcctttttgctttttctctctcttgtctatagccatcaacttgaggcatgtggtcctccaaggctatagcctgaatcctagcatccctatacctccttccatatctgttttccagggccagctagactctttctctgctggatctcactctgtggtcttaccagactgcaccactggtcagtcacccaattgtgccctgaatttcccttcctttgtatttaacttttaggcagtgtgcatggggtgcctgctcacacgtcatgtgcaatgccaggccatggagatgcaacagtgaacaagagcaagcacataaccctgcccttgaggaagtgataggtgagctgtcagacctctcggcatctggaatgaccacggtcctcccacccctcacctccaccaccatttctacgtgtctaagtctgtccattcctcaaggcccagtttgctattttctcctccctgaagctcctcctcagaaattttggccagaggtgacttctgctgctgctaaactcccgcttgttttgccttttttctggcattctagtcacttgagtgttttcttctgtctttttttttttttttttttttgagtatgggcttcctaaaagcaggggctgggacttacccatctttgcctcttccacagcatctagcataatgacatgaatgcagtaagtgtgcaataaatgtgtgctgaataaattcaggaattcatgaaggttcacttccattttcctccaatgtgttttggcagagtgtcacttgctcattattaatcctgaaactttaatgaagtttgttttcttgggccatatgtgggggctcatgcctgtaatcccagcactttgggaagccaaggtgggaggatcgctttgagctcaggagtttaaaaccagcatgggcaacatagcgaaaccccatctctacaaagaaacaaaaattagccaggctttggcggcgtgcacctgtagtcccagctacttgggaggctgaggcttgagtccaggaggtggaggttgcagtgaaccgagaccacaccactgcactccagtctgggtaacagagtgagactctatttcaacaacaacaacaaaaaatttgtcttctttttctgtgagtatatgccaggcacacagtaaataattttgagtcctgggtgtaataggactcaaattgtagtggaaagtgaataggtgaacttttttatgcttacaggcatatttttcttaaaatatgcagttattatccaaatgaaaaggtgtcttagaaaattagctgtttacagttctcattgcccatattttacttctgaaaacaaagaaactgaaagtaaataataatgtacctctgggaactcacatgaagaggaaagaagacaggtttacacccgggttcaaatcccagctctgccatcttccgatttgtgcagcctaggctaagttgtttaacttatttgcacttccatctttatctctggctgtcagcatcttgatagactgtttcttgctcatctttgaatctcccattcctaaaatgatactttggaaatagacattcactcaatattggatgaatggatggaaggaaggaaattaccttatccattctattttgggagttttctgggatgactgtaaaagcagagcatgttcaacccattttattttccttttcaagttcacaaactgatattttagttatggggtgctttcattgatttttatggtagccatactctttgttaggtcatatttatatgccaaggatgccttgtctcaaatcttgcagattcatctgcagctataataatccagttcattataagatactatatttggggggttatttgggattttggggttttttttttttttttttggacacagagtctcactctgttgcccaggctggagtgcagtggcatgatcttggctcactgcatcctccacctcctgggttcaagtgattctcgtgccttagcctcctgggtagctgggactacagttgcacaccaccatgcccagctaatttttgtatttttagtaaaggtggggttttgtcatgttggccaggctggtttcaaactcctggcctcaagtgatccacctgccttggcctcccaaagtgctaggattataggcgtgagccactgaacctggcctatattttgttttaatgcatatcaaaaaaatattaaagaggtcggttttattttatattttttaagtgtgaaaccttatagaagttaaaattttaagttctagtaaattattaaggtcatggttctatcacccctaaactcaaaaactctcctaacaaataaaatgcagttgctaagttgttgatatttataaggcttaaagtattttgaccaaatgatctttctgtcatttttattattaatctaataataataatgctttttgagaacattatttttttttttctggctctgcctttttagattctggtcaattttgagaactcctggtctcagtggcattcatgtgttttcagacaatgagagggaatctggaaagatttactagtcactcaaatgtgaataaatttagtaggaatttggacaaggaccaaatagtagtaggacttcctttccattaaacattatgtaaagtctttacagagaactcactcactctcaactctgtgggaataatttttaaaagtttacttgttgcttttgcagactaaaacttcatcattttagcaagtaatttggttcacttatttacttagtctttagcattagagagacctgtatttttaaattgcagattttttccttcctcgtcaggaggagtggttatgttctgtaatgctatgcttaagtaaaattacacatttggggtatctaaattggcatgccaaattataggacattttaattgttatgtggatgtgacagattcaattattcttgaactcttttgagaaagctgcccttagcagtgattcacagtagtaaacaaaagattaacaggaaaatgccctttatgaggcttaataaatgtgtccgattaaataccatgggacggaattaactgcaatatctacatgtagaaaaacaacctgtgtcctgcttggaggttcagcatattctcttaagataaatttactctaaatatggcctaactgaagaactaagtgccacttaacctcagaactgttttcctaggtacgtcatttgggccaattgttcagactctttcttccctctgaaaccattaaccaaagccactaataagtagaaatgcagagttaagagccccttcctccctctttcaatttccagtggacatattaatgagcaataaagcagctaaaaggcaagcagctcaagaaagagaaagaagcaaagaaaggtgattgggaaaacagatattcagccctcagcaatgcagactgggctgccccgtgtgccatgtgggctgtgatcacaggaatttggagctcaatttcttaattggttctttagtcttatccaaagagaaaattggatttctagagatttcttctgtgcagagagcaattatgctaaagctgcttaggtaacagctttttcggctagcctttctctctcggaataataaagtacacccagagccgatttcagaatgcaccttaacctcaccatccagagtttagcccctcttggcagctgacatgttctagaaccttaaagaaattccagaagcatttacttcttttccattgcttagagtctatgaaactggctcggcaattaatttactgtcaggtctctcccatctgatttttatgacattaccctaccttttagataaatttaatttgactttcttaaatcaagaagtttcccaactctgatcatatgtataaatacccctcaaggctgagagtctgagagttaaaagcactaagtaatgataagaacccaaaatgcctttggcagaatataaaatgccacaggactgctgagtgcccagaataatagtctagaactttcattttcttcctttcctataacattatagtaataaaaggtcaggttaggcctttgtttgcttcgtaaaacagggtaatcaaaccatttaaatactatccaggcctaccacccaaacagattctctccctctcctgcccctttccgaaatattgtctctgttataatatgttactgcaaaacattgtgtttcaatgggtttctttctgctgattaacaggttttagattcaggaagactgaaagaatatgatgagccgtatgttttgctgcaaaataaagagagcctattttacaagatggtgcaacaactgggcaaggcagaagccgctgccctcactgaaacagcaaaacaggtgagcgtgctccaaggagttgtaattaaagtttgtctcagcggctccctccgcacaatttggcaccatgggtatggtaacaagcactgtgtacccttttcaattataagcctgcagagacaaagcttcatgagtgggtcttaacggcacgtcccgggttgaagtaaggtctgcaaagagttggcagaagcgggtaggggttggggggtcgagtgtgtgcacacatgtgtgcatgccgtgtgcccaagaagcggagaggtgttagaccagactttttacacatttagactctgtgggttcagattctcatagaaaaaggcatagagcacatagtactcatattctgcaaacccattgcatttcattcttattgataggcaaatgctgttgaggtacatacaggagatttaagagtttgggcaaaaagtgtgggatattgtttattgttctagaatgatctacctagaaaatgttctacctagatctacctagattgcttttggtttctgttttattatttgtaaagaaaactgttacataatactctcactgttgacctgggttttcccctcattctttgttgtttagaattaggcccatatagcccatatgcttcctccaccttctataagaggcagttgtcaggctgggcgtggtggttcatgcctgtaatcccagcactttgggaggccaagcaggcagatcacctgaggttgggagtctgagaccagcctgaccaacacggagaaaccccgtctctactaaaaatacaaaaattagctgggagtggtagcacatgcctgtaaccccagctactcaggaggctaggcagaagaatcacttgaaccgaggaggcggaggttgcggtgggccaagatcacgccactgcactccagcctgggcagtaagagcgaaactccgtctcaaaaaaaaaaaaaaaaagatgtaattgccatcaggacaaatcaagaatttataatatgttatagctatagcctgaataatccttgaagtatgtttataaggcattaaagacacgcaggctacgtgatctctttccaacaatggtgatgtggaagtatctcattctacagatgtgataactgcagtttgatttaagggacttagccagatgtcacatggtcacctgtaattcttccttaaaattctgtgaggtgagagttgtattgatggagggagggaaggaacatccaatgttcttggcttagggtggaaggagacttctagcagtacatggtgaggctcccatcaaaactgttcatccataggcagtataatatgggtataattttccttcattgttttctgtatttttcaggttttcatcactgtaggtagaataaaattgcttgtttgtgtgtaatattttaaatatctattacagacaacagaataagaaaataggggccaacatggtgaaaccccatttctactaaaaatataaaaatcagctgggtgaagtggcgattgcctgtaatcccagctactcgggagactgaggcaggaaaatcacttgaacctgggaggtggaggttgcagtgagccaagatcatgacactgcactccagcctgggcgacagagcgagacaccatctcaaaaaaaaaaaaaaaaaaaaaagaccaggcgtgatggctcacacctgtaaccccagcactttgtttgggaggccgaggcgggtggatcacaaggtcaagagataaagaccatcctggccaacatggtgaaatccatctctactaaaaatacaaaaattagctgggcgtggtggcacacatctgtagtcccagctactcagggagactgaggcaggagaatagcttgaacctgggaggcggaggttgcagtgagctgagatggcgccactgcactccagcctggcaacagagcgaaactgcgtctcaaaaaaaaaaaagaaaaaagaaaaagaaaatatgttcccatatctaatggtatttctgtattaaagatttatccaaataaaacctaggttgccttcagctcctatttcatctcattctccacagaagtgaggaactatccttgccactgtctgtaggatatttctttgaatcctgcatttatcctcaaaacgattctataaatgcctttgtgtgcacagtattacgctgggcactaacaaatacattaaacatgcccctagtcattgacaatataagccaaagaatagagcagagcagagatttgattgatgtggtgagccctgatggcaatgatgatgatgatgatatgtgtcagatgtgcactgtgcacttctcattatgcctgtttaagaggctgaggcatagagagggaaggaaattgcccatgatctcatagctagcagaattataggcagagtccggattcaagcctggctttaggatcgacaaaaatctgtgttctgaattttcataagaatcacattgtgtatgaataaagagggaagctgtacttgaagcactgtatttcttttatacttgaaatttacagaatacttttatcttctagcgtgtctcccagccaaagcttccctcataaaacccgatcaatcatttgggattccctgtataatctagtcacaaaagagccaggaacctcaaaaaccctttttgttctttggtacctcaggcatttcacatcaaagagatgtgtccctatctatatatcaaaatacctatttaaaaaatatgttatatattatcaaggcatggagtaataagaaataggtcatagaattttagcatgttccaactaacataagataatatagttcacctttgttttacagatgaggaaactaaggccccaagaagtaagtgggccctgactaatttatagcagagacagaattaggaatctttttttaaatcaatgtttaatgcaagtataacatacatatagaaagggacattggtcatagaattgaaatctcaattactggtccagtaatcttccatctaattcaacaatattaatcgtaacttacgttcgtatagttctttataatttattttacattgtttacatagttcttacatgtatgattctacttaatcctcacagcagtctgtaagtcttactgtattgatgaggatgttgggtcatgtgtcttcatgtggacacagagctggtccgtggagaacagaaggtagattgctgggggaggccgatgtcttcccctaagtagcgttctgtgtcaagcctgaaaacgctgctccttgtctcatttggtatccaagatgcagctagtcgcccaaattcacacagtggcagaatttccttcctggattttagtcctgcctaaccactggctcaggtcacctcctctacagaaagacataaggaaatacacagcttgattctcatccaagttgaatattttcttgacatttctgcatacacttggtcctcttaggagaacaagctgtcagattgtcaaccttttaaatgtgcaagcatcaaatatcaatgcatcattcacaactgtaacaccatgaggattagtctaaatcaacaagcttttcgctctcacagattagaattcatttgttggaaggaaaactcaacatctgggaaaaggtacttccaagtcacgtattcttgaccacggagttgctttcctgaaaatgctggtgcaggcaaagctgagtctctcttttgactgacctttgcagatgactcagtattttaatattttaaagtaaatttaaattgcataattacatttcaggtacataaagctgaagggtgcactggtttgctcaggctgccatagcaaagtagcacagactagctggcttaacccacagcagattatgttctcacacttccgtgctggagtctgagatcagggtgtcagcagagctgctttcttctgaggcctctctccttggcttgcagatggctatatgttcacggggtctgttcacggggtcttttctctgtgtatgtctgtgtcctgatcacctctttctctaaggacaccagtcatattggatcagggcccaccctaaaggcctcattttaacttaattacacctttaaagactttctccaaatacagtcacattctgatgtacttgggggttaggacttcaacataggaatttagggggatgcaaatcagcccataacacagggtaaattcaatcattgtcttccctgatgaagccgacctaatttgaggttcccagtgagtaacagaggtgccattttatgcactcatgaaattgccagatacaactcaaaagttatgaaatcctggccaggtgtggtggttcacacctgtaatcccagcactttaggaagttgaggcgggtatatcacttgaagtcaggagttcgagaccagcctggccaacatggtgaaaccctgtctctactaaaaataaaaaaattagccaggcatggtggcgcatgcttgtaatctcagctactcgggaggctgaggctggagaatcacttgaacccaggagatggaggttgcagtgagcctacgtcacacgactgcactctagcctgggcggcagagcaagactccgtctcaaaaaaatatggatggatggatggatggatggatggatggatggatggatagatagacaagaagtcctgacatcctggatcctaggagcctggggcctgtttgaataggtggaggagacacttagcagccaatggccttacagaagtcacccaaggcctgtgagcctcagaggcctcacctgtcatgccaggattgcagtactgctccggtttcttcactgttaacatgtattaaatgagatagtgtatgtttaagtgagtcaaagaatataaggtgttttacaaatataagcgaattctagctattggttataaaagctcagtacttttttaagactgtagactgaactcttagctcccaataatagcaaaagaagtatccaaagttttgtagctttatagactaaataattacaaattatttttaagaatcagcttaccaaatgatatatgctcatgttacaaaattcaaagcattgatagttttgcaaaaaactttaataagtaaaaagtaagtcactctgccacacctgcccttcatcacgcagttcctctgccaggtttcagccctggcaccttcttctccactttgttgatgtattctgtgcataaacaagcatctgtgcatatatagcttttctggtttttgagcacaaataatagctattctttacggtttttcacttaatattatattccatattatatcaatacatatagttacctcattttattttatatgtgtattttttattagcgttctctctctctctctctctctctttctctctctctctctctctctctctctctctctctctctctatatatatatatatatatatatatatatatatatatatatatatatgtattttttttaaagcagtttcactcctgttgcccaggctggacctctatggtgcaatctcagctcactgcagtctccatcaagtgattctcctgcctcagcctcctgagtagctgggattacaggcgcccaccaccatgcctggctaatttttttgtatttttagtagagatgggtttttaccatgttggccaggctggtcttgaacttctgacctcaggtaacccacccaccttggcctcccaaagtgctgggattacaggcgtgagccaccatgaccggccagttacctcattttttaatggctacctagtatttatactttttccactctgtacttttcacttttcccaattaacttccaattaagttagctatttttgtttttttcctggtgaatgacttaccagatttatttactagtttatattctgttttccagttgatcagtttctgcttttatctttattacctttgttttttggtttttctcgttgcttcttcttgaatgcatttgtgtccattctttcttccttagtattttagcgctgtgaattttcgtattctgttggttttgatatgtagtgctttcactcatagtttattttttatttatacattctgcaattttggattttaattttctctggcccagaaattattgaagagggaagtttttaaaactttttggtggtagcggtttgttttttctgttcatttcttttctgttttacgcatcagtttcattttcattgcatgtcatccatatcctttctatccatttggaattttctttgtgtcctagtttttctagatgttctttgggcattgaaaagatggtgttatctgtttaaggtatagagtttaataaggtttaattagttctactttgttaattacattcttattaatccttatttatattggtctattttctgtgacttggatctagaggtgaattagtttcacactgtacatatttctctttgtagtacctgtcatttttgttttggtaactttgatgctatggttttcagtccacagatgttcataacttgggtttccactatgaattatatttcctgccattttaacacacctttctttgattcgtgtaatggttttggtcctaaatccacactggttcaaaactagactgggtcgcgtgcttttactttgctttctttgtctgctatatatgggattgtctttgaatatccaaaggtgtgtctcctgtatatggcgtggttaggttttactctgaggtttaatcttagcctttgtttttaatagatgattttagtacatttacatttattgagattataagtatgttttgtcttagttctgtcatgttatgctttcagtttttagtattcctttttaccttttaatttgtagtagataatttttgtttctttgaatattgttttgcatgtgttccttttgtttcctctaaatgctgtttcttgactccccattataaacaataacaatataaatacacttctgtctccatcctaccaccaaattttagcttagtttttcttctatttgccttcaaaccccaaatatacttaagcctctgttatttggcttttctttaaatgatactttctccatcttttagttagctaaagtttatccttcagtgctttttaaacctcaggctacaacccactagtggtgctgtggaatcaatttggtccatcatgactagtgtgttttaagatgtaaaatagaatacaatggaatagaagaaaaataacatgtatctttcatagtaatggtaatattttttgaaatgcttttcagtatagatacagatataggtagtggatgcgtaccaagtccctgtgtacagtgaaatgtgccacccattattgtgggtggcagtttaaaaaaaaaaagttgcaaaacaatgctctataccatctcaaagggaaaggttccttggaatttagaatccctgacttattgcatgtctgaaatctttgttacccctctgatttaaatgtggtggctgtaccatggcacacatttacctatgtgacaaacctgcacgttctgcacatgttatcctggaatttaacataaaaataaaaattttaaaaagttgtggatataaaattattgggtcacaccttctttcacttagtatgttgcagcctttgctctaaggtcttctcgtgttgtctgttcatatggagacatctatgaccatgtttgacataactcagccttttttctttctttctttctttttcttttttttttttgagacagggtcttgctctgttgtccaggctggagtgcagtggcacaatcatagctcactggagccttaacctcccaggctcaagcaatgctcccttctcagcctcccttaaagctggaactagaggcacatgccaccatacctggctaattttttttccccccatagagacaaggtctcactgtgttttccatgctggtcttgaactcctgggcttaaaccatcatcccaccttggcctcccaaagtgctgggattacagatgtgtgccactatgcccagccagatcttttttcttgtatgctgaaagggtcattagttttcctaggacattattgtgcagtctttcagactttgattcaagttttcttttttttctggaagtttacttgaattatatccttgaatttttttatttgattatattctcttctttacaaatatctatcatgtatatgttttatgtcctttgtctattttgtaaagctattttctccttaatcctttttagttctttattaacttttagttattttgtttgtttgctcaatcctatcctgtgtctcacactgttttttcagcattggctaatctttgtgctgccttcagtagaaatgccacttatttttttattttttattttcccttttttgagacagagtctccgtctattccacaaactggagtgcagtggcgtgctcttggctcactgcaccctccaactcccggttcaagcaattctcatgcttcagcctcccaagtagctgggattacaggtgtgcgccatcacaattggctaattcttgtagttttacaagatttcattatgttcattatatgatacaagttttcattatgttggccaggctggcctcgaactcctggccctcaagtgatcctcccacctcagcctcccaaagtgctgggattacaggtgtgagccattgcacctagcccatttctttgatattttcacttttcttttccacttcacttttgaccactgtcaactcatgtttcagcatcttctgttgctctgccatgttttcctgtatttttgtatctctgttatgcacagcctgatcattctgctgcattttctttgaatgaattatattcataaactctatgtgctcaacatttgtcatgtgtttatcttacttcatttcttatttgtataatctccaggccctgtactactcttaaaattataataataatttttattattcctactcctcacctatgactaaaacgaactcttcctagaccagatagttacaggatagttgtggctagggccttgtttctggctaaagggaattttctgtgcttaatgtagaagtactttatgacccagagaggctgcgtgtgtggtgggggggatgcagggagggatgtgagtgtgtatgtgtatgggtgtgtgggtgtgtgggtgtgtgtgtgggtgtcaggggatgtgggtgtgtatgggtgtgtggtgggggtatgtgtgtgggggtgggagggtgtgtgtggggtgtgggtgtgtgtgggggtgtgggtgtgtgtatgggtgtgtgggtgtgggtgtgtgtggggggtgggcgtatgtgggtgtgtgtgggggtgtgtgtgggggtgtgggggtgtgtgtgtgtgtgggtgtgtgtgtatgggtgtgtgtgggggtgtgtggggggtgtgggggtgtgtggtgtgggtgtgtgtgggtgtgtgtgtgtatgtgaaattgagagtgcatgttttgcctttcttcctccttagcttacagaattgggcaattgcaatctgtcttctgtcaggacctcaccaatgtacataggtcagtcaaagatgtttctaattgattctttattgacataccttagcgctcctccaattaactggagaattcctatgattgttgaggcttgctcttcatagacatcttctcagccttgccacagccccattggttccagttgcatatggcagcccttcatgatattttaccattcaggctctcctgatttcacaaagatttagcttattttttattaatgaatatctttgatgttcagagtggtttctgaaaggaaaaggagaggaaattcattactccattatattaaaagcagaagtcctttctaagtctccattactctttgacaatatgcatgccaattatgtacaccaaaattagactggctttaaaaatgatgaacttgaggccttgagagttactgtgattgaattagggccatacacatcagtaaaaatgaactgacagggtcttgagcctgaattcaacacatcagatggtatcttaggaatgcaatgtcaatcaaagcccagttgctctcctttgtccacgtgcgggagcttgtattgctctgttgattttagtaaaatctagctctgttacggtggctttactgatgagttagagtttaaatatgaacttagtttcaacctacattagaggaactataatggagcaaactcaagagaagaaggaaaagagggacaaggtttcccatactcactgacctgatactcttcttgccgcaaacgtgaacgcttatggcattgtctcccttaagcttcacagtccttctgaactgctgttattatccccttttgacacatgaaaatgctaaagtacaagaagctgagtaacttttttttttttttttttttttgagacagtctctcactctgtcacccaggctggagtgtagtgttgcagtctcggctcactgcaatctctgcctcctgggttcaagtgattctcctgcctcagcctcccgagtagctgggactacaagcgtgcaccaccatgcctggctaatttttgtatttttcgtagagatggggtttcaccatgttggccaggctggtctcaaactcctgacctcaagtgatccacctgccttggcctcccaaactgctgagattacaggtgtgagccaccacgcccagcctgagtaagttttcaaagccaccagttcaaaagtgttcatactccatcttctatgatctttcagttctacctttctgcctcccaggttaccatattcattcagttgaaattgtctcagccacagctttgggattctgtaaagataaaagatgcaccagagggattcctaaatgctttgtcttcatccttcgagctgggcgatacctccacgttctgtgtgcttaggggccacttctctgagcagcattcatcatgacacccaacactaatgcagcaggttttcaacctgtagtttgtagccattaatcagttcctgtgacgtaagctattgttatctcatgttacagatgaggcagctggtagagagagtggttaggtaatttttccagaatcagcagtgaatccaggagagagctgagactggacctgtctatcccagacatagcttacaacatgagggctttgctaaaagtagttcagtaatctcaactcccttcatcacctgcactgtaaaaaagatgtttcatctcacctgtgctgttacccatagtgtgttataaaacctggtagcagaagagaaaaagaaaggtcaaatcaaagaatatatacacaggaagtttgtttttgactaagtatttcagaccatgaagctaagaccatttgggtttaaagttgctaataacaacactttctttatatatatttaaaaaaatacatcaagagggttacacagaaggaagcagcctatttggggaaggctatcaagcagtagaaagtgatgtgaatgtctatttgttcttttggctgtttttagtttcactacagaatagcctttttggagtacataaatctataaccacacaaaatatggctagcttaaaaaagtgggagagggagatgatatgaaattatcccctgaaaagtcttacttttgaacacttgcattataatggaaatagcctcagatttcttctggtggcattccagcattattggacaatttattttctccttaagtgacattttagtacattgtgtgttatatgtaatgatatttctggagtaacaagtgtgcaagaagtgagagaaaaagaaagtacacttaatatgtaggcaggtgtctcagcactttcttttttgtacgtgaatcccattatctccagtgataactttgttgacagcacccaccaatatattcagagcaaggttttataaaatagatccagaatcgtatgactaagagacccaggtgacacgtgtcagcctcagatagttgctacattttctgttttaaagattcaaacaaaacttttcacattcttctttggggaaaaaaaattacatttgaagtcctttttcacccaaacacgttttgagataagagctcacaagtcttgacattatttcattttgttatgcgcatctgtcaaggaaccaagatacgatacagctactaaaaactgatgattgtggaacagagaaacttgacagcatttcatttcctttatgttctgattatacgtttatcagaaaacctgtatctcttctagttcagctagaaattggtagaattcaggaactcaaaggcttggcaaagaactgtcctattatttggtatcatcttacattttagagaagttgcttggttgagtcattgttaaagcttttgcttctcttttcattattgtgggccactatccacagaccacatttctataggccctataactgctttgccgcacaaattaaacgccgggatgtttcatacgtatatgccagcatttcaatgcttgtcaatcagagtttataaaatatagggattacaacttgatattaacatccaaatctattgtgctcattttacgtgtgaaaatgagaaaccctcatgcagacgctagatttcccagcctctttgtcaccctgtttttaatttatctccaggttttgagtcagtaaaatgattccgcttatcaatttaatacagagataaaacatatctatgaatcagagtgatcggaactaaaatggatctacaggttgtttggcattcagcccagccctgctgagggttttagtggggctaatttctctgtacagtagattcatccctgttcttaaattgtgcctcagtgagggatatgatttgcttcacatgaagaagtagacacagaagtgcattgtttcagggaggagactttaaaattttgaaacattctttttatgcttaccttttttttttctaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 36362 - DNA, 6523 bp, Homo sapiens
gcaacggcaagggccgcagccagcaccgggcggagagggctaccatgggggtgaggggaggccgcccgccgcggggacacggaggggaggtggcgagggtctgggaggcaacagctcgcgccaggaggagatgaagcgagtgggtgcgcgctgaaggagcaggaggcagaaggagtgtctccctgtggcacccacggctgggaatgcgggagggtcgggcaggcgtggggctgcgcaggcacggctgacgcagtcgctctggccctccccctcagaaaatcgcgctgcaactcaaagccacgctggagaacatcaccaacctccggcccgtgggcgaggacttccggtggtacctgaaggtgcggccggggcggggcccggggagaggaggcccgtcctgatctcagtgctgaaccggagccttctctccggcagtatgagaaaatatttaaccaggcacattaagtgttcggggttttcctagttagaattttacgtttgctttctattaaagtgtattggtttatctctaattggcagtcttggaaagcttcattttgtagttcttccctgtgttaaatatttcgtggtctgtaaatggacactaaacgaaatgctacttgaagggacgcttgtgattatttaataaggtgaatagttcgcctttcgtttattgatttggttttctttattgtgaaatagtttaattttgtgcgtaatccacccttccttagccctcccacactggtaaagctggtaccctagtggcatggtctacagaggcctccccttccccagcagttcgaggctcttcactcttccagatcccagagcttctgctctgttttactcctggtcaaaaatcccagcatccttctgtacctctcaaaagccctgtttttcgggaagctgcctccggactacttttgtttcccaggattttgaagcctgaataccagggcttacttgggagaatctgttctttggcttgaagaagcggaatcgagtgaaggagacagaaaaatagagtaacaatagagtgataagtgcttataccagtgacatacagggcctgtgggaacataaagctaaccaagcagagtgggtcgggggcctgctgaggccatttctctttttttttcttaattgacacagaattgtacatatttatggggtatatagtgatgttccgataaatgtaatgtattgtgatcagatcaaggtagttagcatattcacctcaaacgtgtatcatttctttgtgttgggagcatttaatatcctagctatttgaaactatatattattgtcagctatagtcatcctacagtgctatagaacactagaacttattcctcccatatagctgtaattttgtatcttctaacaaatctctccatattcccccccctcacctccgctgaaaccatttctgcaccacaggtgccttgaatccccggccacactgagcacttcatagaggagggtgggcacgccggcataggaaacagccttacctatcctttgcccagagatagttctagttttgtccttgttggggcaggtgttagggatgaagtgagattgccatcaagaaggtagatcatgagcctgcccacctcccactgttcttaccctttccttggtgtctgtgcagcagagccagctgctttactaacattctttttccccaaagatgaaatgtggcaactgtggtgagatttcggacaagtggcagtacatccggctgatggtaactgttccccgcccaacccccaacataaacactcacaaacacacatacacttctgggcagggatttggggaaactggccttcatctctccagttctttgctccctgctttttgtggtttgggagggtaggtgtcagtgtgatcagcactggattcaataggcatctttgaggtatgaggcagagttcaaaatcaaggggaagccctttttttattttcctcaggaagccttcccaggagtcttgtcctagtaagttaccctttctgggtcttggtctctttaagtggacaataaatggtgggctcgatctcctcaggactgtacatctaattcatatgtgactgaaagttctgtttgctttttgccaggacagtgtggcactgaaggggggccgtggcagtgcttccatggtccagaagtgcaagctgtgtgcaagagaaaattccatcggtaggtcaggctgtgcgtactgagttctgccagggtggcccacagcttcctggcaccaggctgaaagtagactcatgttacctgagggtggagtcaggcctaagatgccgacacctgtacagcgtgatctttttcagggccacatgtgggcacctggctggggcgagggtatggactcaagtcaactttgtgttctcttttctatttcagagattttaagcagcaccatcaagccttacaatgtaagtttgctgctgtagtggcagggatggtgggcttaaatcctaactggagttagtaggtctgggttctagagtcatgcctgcatcagagtgacctgccataggacattcactcatgaacttagttcttctttgactcagtcatttatccactgtacactgagtgcttggtatattgcctcttgcagtgccttcttatgagggctgggctgtgagagctcaggggacctctgacacaacctagctgttcagtttgcatcactgagagcacttgccttgtcttcattttaggggactagcaagctttctctgaaaccatgggtggggtagtcgtttggtgcatcccatcctttatatcatcagtgttaacaagttagcccaaaggtgagggagggtgtgctttggatctgtttgtttaaagaaagccagttatatgtattcacctattccttatttggtatttatttaaagtatcttgagttgtgccaaattcttggctttgtcctgaagttaaagagaaattaaatgaggactcgccttcacgtacataataatctagtggaaaatacaaaaaacaagaatcgaactagggccctaacagagaagtgccttaccagtgccagagatgtggtcagtgtgcaggaaattactttacagtgaatgacaggatgagactgaatgtagggcatggcacttgtggtccctaagcccataggtcaggtaggcatgaatttcctggccacctgccccccaagaggtgccccctccacatacataaccatttcaaaggctataagacagccctctgcccttactgcatggcagatggtcagcaaaaggctatggttaagtgtactgggtctgtttggatgatctagagactttggagcttaacattcttgttcatatttttggtgttgataattttatttactatttattgagcactgtgctgggcactttatatgcatttcaaaatctgacagtaaaattgtagaggtttcctcggctctatttgacagtttaggaatcttgggcccagaggggaagataggcagagcttaccttacatccaggcaggttgaccccagcatccacgctcttctgcagcctccatgtctgctgtctacagaaagcttcatagggagcaggtgcccaaggcaggcttcctctaagaaggggatgagttcttcctgggtctcatactaggcctccaggggcagtaagtgcccatttggcaggaaggagaggggccatggggtcatcctgagagctcatttgggcctgcctcctcaacacacttcctttctaggctgaagacaatgagaacttcaagacaatagtggagtttgagtgccggggccttgaaccagttgatttccagccgcaggtgtgtgtgtatctttctggggaatctttgtctttggggaggggatgtatgaagtgacagccagaactgtgctacctacagataccatggactagacattctcctttctagcggtagtaataattgtcccttaagtggctgctgtatgcttgggcacccatgccatcatttttacatgttaccacatttaattcttatggtaaccctatgaatttattcatcctgttcttcagatgaggaaggaactgaagagattttgcaacttgctcagggtcacacagtaagcagtggagctatagtttcaacccagatctatctgacttgagctggtgctcatccccctttatttgtgcatgtttcacctcacaacaaatctgtgaggtaggcagaagagcaaatacttcatccccgttttatcaataactaaggtccaacctgggaaatgacatgcccaggagccttcagcaaaccagggctagtggaagggattacgctgcccctgctgccttctggtccaaggctgtaattcagagaaaccaccactctagttctgaggcagctgccgggtcctggaagctcagcagttattccaagacaggtactcatactgcatctctgtcctccatcccagaagtgtgagaagagccagcagcctggccggcccttacttatagcccaatgccttcttttgccaagactaactggtaccttcttgtgccctgcaggctgggtttgctgctgaaggtgtggagtcagggacagccttcagtgacattaatctgcaggagaaggtatgagacttgggggctttgggaggtactgtagggcacctggtgggaattatttttttggtggacaaggctcatcaatggaaagccaactctgtatttttgtgctttttgttagtgattttgctgttgaaatggccacaggtatagtgctaaagtgctttctaatgttcctacgtatgagaaagctatgatgccccttacagagagaatacgtgttagataagctttattcaggcatgagctatagtgctgctggctgtgagttcatgaatcaacaatatatattaaataagttatctttaaacagaaacacataaagctagattattgattggttgatgaaaatgtgaccagaggctcataggaacctaaccctgtatttccccggggagtattcattcagtattccctaattcagtgtttgtggtggctttactgcacctaactaccatgaagaacaagaaatagtctgtattactggacatattactaccctgcagatagaaaagccttgtgctcaagccttgaaggaaggacaaaaacttcatttcatttgctcagcacctaataacagcagctagcatctactgagctcttacatgtgccaggcactcactatgctgagtgcttttattttattttatgtattttttgagacaatctcactctgtcgcccaggctggagtgcagtggtgcaatgtcagctcactgcaacctctgcctcctgggctcaagtgatcctcctacctcagcctcccaagtagctgggattacaggcgcctgccaccattcctggctattttttgtatttttagtagagaccgggtttcaccttgttggccaggatggtctcggacccctgacctgaaatgatccacctgccttggcctcccaaagtgctgggattacaggcatgagccaccacgcccggctgctgagtgcttttaaatgtgttacctcatttgattctttcaacattcaatatgaactccattgtcctttttttgtttttgttttttttaaatagaagacaggactcggagaagggactcagagaagttaagtgatttgcccacagtcatacaactgaaagagctagaattcaggcctgagctatctggctctgttcagggtcatacatgttcatgattatttgagtcagagcctgagctgggccttttaagtcccagttttctgctctccacatggctgcattctgcgttgtgaggctaacaatgccattttgtttcccaggactggactgactatgatgaaaaggcccaggagtctgtgggaatctatgaggtcacccaccagtttgtgaagtgctgatccctcttccttcccagttgcccttaagaactgagaaaggacaaagtactctaagcagcagagcccacagaggctcgttcctttgacccttgtctcctggtggctatacgaaaccttcacaatctgcatgctggactttattacagcttcccaagccccatcaataaagcccctgttcacgctgcactggtgcatgaaggtgaagtaaggaggcagctactccctccacaaataagaattcgtgcagcagcagttcactccttaggaaaatgaagagtatttttaaggagatggtatctccccagtcaagggcaagtttacagagatgaaaccgcgatcccaccatcactcaatgagccagaagccaatggtgacgtactgttacctgaacttactgaacttgctgttggaaagatctttgtgaggattaggaattaggttaaaagaaattaagaaccatcttcaagcaaaaattaaactttatttctgcttaaacaataaatacacctgagttagttttccaaacctttcctcctgattaaatgcccttaaaacttaaatc

SEQ ID NO: 36363 - DNA, 51492 bp, Homo sapiens
gttcctcgtgccaacgtgtcttgtaaggtgcggctagaaactggggacatggcagcgcctggcccagcgctctgcctcttcgacgtggatgggaccctcaccgccccgcggcaggtaagtggcggccggcgggctgctggcagccgacgcggagcccgtgctgttcccagttggggctatcgaccacccagggtaggcgccaaggggtggctaaggaccgcctacgtcctcacggcgctgaaccctattctgggtgcactggaggaatgagagggaggccctaaccagctcttgaagagctctggtgcttggaaagatgagacggggctgaagaactcttaagagcaggaaacttgtgctaggttggaaaatgtaatctggactcaccgctagtgctcgggactgatagaccaggatttcaacccaagatcaggcccccttatcagctatgtgtcggccccaatcctgtaaccaatgggctgtgccgtgagtcatgatattaaaaacaggtttccaggtcaaaccgacctagtggagtctcatcttcacctcttgacatctgtgtgaccttcagcgagtcattaacctctctgagcctcaacatctacagctttaaatggggatgttacctgttccatatggtgtctgtgaggatcaaatgagattgtgtaagttcttgaaagtatgttggacacaacacactaggcctcagtaaatagtagccacctccaccacacccatctccagcccctgcaatggactagggagatggaggagccctaggttattacaggctgcccgctgagagcctctttgggcccttggaaacttgctttccactttcagattttgctgctacaggcacagataagtttcagttacgatcagccttgaggtgaggctctcctggccccttttcagaaattggccactgaacactggccatttcaacttgagactggaccccaatggtctcactatcctcagcttctaccctcacccctcatagttttcgcttggtggtaacaatggtgtgctccagaagtccaggtcaaatgcgtgtgaccttagacgtatcattttgcccttctcagccacaggtttgatttacctagtgatgacgctcaactcccaagttcttcaaaggctttttctgattctgaaattcagtgatcacacacttgggtttgttaaaagcccatagtggtctaaaactccggtccccaattcattttttgtaaagggccatatagcaaatacttctctgtctttgctgactatgtggtctatagtaaccactcaactttagtgcaaaaccagccataaaccctatataaataagagtggctgtgtaccaataaaattttatttatttattacaaaaacaaacagctgcccaatgtggtctgtgggccatagtggtctagggtttacattgccaccctttttcatatcactgaaccctctcaaccttcctccatctttcttcccaggtaggatagttgttattaccgttttaaacataaggaaacacactcagtgaagaactaacctcctcagtttcacacagccaacctggtacaagtctctgggcctcaggatattggttcctgtcaagtttgccatttcctatctgtgctaaggtggaagctgttctagtcactgggtatgccattcaggaaagtgcttctgattttctgattttcacagttctgactctttttttttttttaagacagagtctcactctgtcaccagactggagtgtagtggcccaatctcagttcactgcaacctccacctcccaggttcaagcaattctcctgcctcaggcaaccaagtagctggtgctacaggcaggcaccaccacgcctggctaatttttgtatttttagtagagatggggtttcactgtgttggccaggatggtctctatctctggacctcgtgatccacccgcctcggcctcccaaagtgctgggattacaggcgtgagccaccgtgttctgacttttaaaggccactcctccaattctagattctgtctaataggtccagattccactgtgagagtagaaaagattgcactctattacaaacccttctgtacaattttaatcacattcatgtattactctaaaaaagttttttaaagaaaaatcattgaactccaagtgtttatatactgaggttgaattaaatggttttttgtattttctaaatttctagtaaaaagatattcagccgggcacggtagttcatgcctataatcccagcacttggggaggctgaggcgggtggatcacttgaggtcaggagttcgagaccagccttgccaacatggtgaaacccagtctctactaaaaatacaaaaagattagccgagcatgatggcgggcgcctgtaatcctggctacctgggaggctgagacaggagaatcgcttgaacccaggaagtggaggttgcaatgagccgagaccacaccattgcactccagcctgggtgacagagcacgacttcgtgtcaaaaaaaaaaaaaaaaagacattcagtgtaaatgtacaactgagattgctcaaagtgctgagttataagacttgtaaaaatacattgtgatgtgtcttaatgtagggctattttttcatcttagtttataacttttttaaaattatcacacagtttggaatttaccataagattataccactaagaccactctttctagataggagctttgcttttagaagagactaaaaaatctagttatcttactcttttacatttttgttttgttttgggtgattgcaataaaatcaattctaagcttctccttttttttttttttttgttttgttttgttttgttttgagacgaagtctcgctctgtgacccaggctggagtgcagtggcacgatcttggctcactgcaacctctgactcccgggttcaagtgattctcctgcctcagcctcccgagtagctgggactacaggcgcccaccagcgcgcccgcctaatttttgtatttttaatagagacagggtttcgccacgttggccaggctgatctcgaactctgacctcaggtgatccacccgcctcggcctcctaaagtgccgggattacaggcatgagcctccatgtctggccctaagcttcctctttaatttcattatgttgttttattttaaaatcaacaacttaaatccataaatggagtatagtgtagcatttaaaaggaatgatgagctagatctgtgttggcatgaaaagatcaccacagcatagtgctgaaaaaccaaagtccctgcacaggacatgattccatttatgtttcaaaaataagacctatttgtatatgtgcccatagatgggtatataaatgcatagaaaaatagctgggacagtgcacaacagctactaacatattacctgtgtttaaaatttggtaaaaataacacttaagtttattctggtaaagatgcccccccagttacaactaaaatatttgaactatgtacagagctggtaacttaattggcatgtatgaaaataaggcttatagacctggcttatacctgtaatctcagcactttgggaggccaaggctggtggatctcctgaacccaggagttccagactggcctgggcaacatggcaaaacttagtctctacaaaatataaaaaaattagccaggtgtgctggcacataactatggtcccagctactcaggaggcagagataggaggatcaccggagtccagggaggtcgaggctgcgatgagctatgaccatgccactgcactccagcttgggtgacaagtgagaccctatctcaaaaaaaaattttttctttaatttttaaataagaaaataagacttatgtacttgtgttacccttagagttttggtctcctgattattgtgtggcttatgactgttgtattttctttcttgaaatttagaaaattaccaaagaaatggatgacttcctacaaaaattgaggcagaagatcaaaatcggagtggtaggcggatcggactttgagaaagtgcaggagcaactgggaaatgatggtaaatgatgggttgctaattacatctggtaaaagattaacttcttatgaggatattgttgccaagtatcataggctgccctaaaaccttgtccccatatggcgggctttctgcttccttttttgggaaacattttcttggcctttgcttttcctctgcttttaatccagtacatttctggagttactgatggagaactgggtactcagatgtgtgagtagattcacctagaaaggtcagtggctgtatctgcacatgataatctctctgcctggaatacttcttgcttgtacccgttgacagcccttctagccccagtcagaccggtcttcatattgtccctctgacagcccccctcacctccccatcactgaaacagaatctccagcacaggaccccgaaaaaccagagaggcttattgaccccttcactggagagtctgacttgataggtctgtggagcctgggaatcctatttcagtgagtacctctgagagattctagtgtacaaccttgctaatgtagcattctgtaattattgtaaactatccgattatatgtttttgaagagcaggagtatgggttattcatctccatagccacagggcctcctggcctgtaagaaattgtaagtggatgccaggcgcggtggctcacgcttataatcccagcacttggggaggccgaggcggatggatcacctgaggtcaggagtttgagaccagcctggccgacatgatcaaaccccatttctactaaaactacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaattataagtggagaggtggatgaattgattgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacatacggctatgactaccagaaatgtctccagacattgccaaatgacctctgtgtaaaattacccccgtttgagaactactgttctcaaagatgtaatatgttacagtccaaatctgtatggactgtatttataggatcaccattactagaagagtaatctctgcaatctctttaaaactctctcttccacttccacttcattttcctggtagatctcctacttagaaatgctataaaccgcatactggggatcacgaagccctgaaaatcctgttacctgctcatgatcgccctttctgcatctagttgtgtatttaaccacttgctcagggaagttttgtgtagtgtagcatagtgtctgcacctgtcagagacatgcaacaatagaatcaaaacattcacaggccaaaagacagttgaaggcccacctgtatcagaatcacctgggaagcttattaaaatatgagtgtggggtccccacccaacacataggggatctgcattttaacaggtacctgaagtttgagaatcccttcattaaggttgacaacatggatagtttccaaaccaaactgattataagaatcactgaagagctttttttaaaatttattttatttatttatttatttttatttttttgagacagtcttattctctggtgcagtggcacaatcttggctcactgtaacctctgcgtcctgggttcaagtgattcgtgtgcctcagcctccgaagtagctgggactacaggcgcccaccagcacgcccggctaatttttgtatttttagtagagacggggttttaccatgttggccaggctggtcttgaacttgcgacctcaggtgatctggccaccttggcctcccaaagtgctgggattacaggcatgagtcaccgtgcctggccaccaaaggtcttttagtgctttgttttttgttttttgggttttttttgttttttttttttttttttttgacgttagacagagtcttgcaccgttgccgaggctggagtgcagtggcacaatcttggctcactgaaccctctgcctcctgggttcaagcaattctcctgcctcagcctccggagtagctggggttacaggcgcacaccaccatgcctggctaattttttgtatttttagtagagacgggggtttcactatgttggccaggctggtctggaactcctgacctagtaaaaccccgccagcctcagcctcccaaagtgctgggattacaggtgtgagccacaccgcacccgacccaaagagcttttttaaaaatatatttagcctgtccctcagcaattctgattcaggaagcgagagagcaaagcttggaaatctgcattttcacactgccctggttgctgctggtgaaccatcagcatcatggacgagtatcttcctctacagacagtcaggctgaagtcagggacataagataacctgtcaccaagtccctaatctcctgcccagtcatcatcgtttaaatgtgtaaccaaaaagagccattaaaaaaacaaggaacttttttccatactcttctcttagtctgtaagatgagatagtctttcacagtccttgctggagtttagcggttttattggtggtcattgttaatcaaggagtaaaaacacaggttttgattctttgcattctaagtgtttttttggttttgattgtagtggttgaaaaatacgattatgtgtttccagaaaatggcttggtagcatacaaagatgggaaactcttgtgtagacaggtaggttcttgagtatctgaattactatatactattaaaagtgttttctaaaagggcatttcacaatgaatgcctctaggaagatgaggaacgggtagaaatgaatctttactctgtattttttgttttgcattttgaaccatgtgactattacatattctacattgataactaaatttttatactttttaaatctaatatttctctcttttcttattttgtttttgagacggagtcttgctctgtcacccaggctggagctggagtgcagcggcacgatctcagctcactacaacctccgcctacctccgcctccctggttcaaacaattcttacgcctcagcctcccccatagctgggattacaggcacacgccaccacacccagctaatttttgtatttttggtagagacagggtttcaccatgttggccaggctgatctctaacccctgacctcaagtgatccgcccacctcagcctcccagagtgctgggattacaggcatgagccaccacacccagccttttcttcttgttttaaaaagatggggtcttgctgtgttaaccaggctggagtgcagtggtgcaatcccagtggcctagaactcctgggcacaggtgatcctctgcctcagcctcccacgtagcagggactacaggcacatgccaccaagcctggctttaaatctattaataacatttctatgatgataaaactagagcagactgcttcactataagcatttttttttttcttttttcttttttcgtggtggaatctcactcttgcccaggctggagtgcagtggctcaatcctggctcactgtaacctctgcctcctgggttcaaatgattcttgtgcctcagcctccctaggtgggattacaggcatccaccagcatgcccggctcatttttgtatttttagtagaggcagggtttcaccatgtttgccaggctggtctcgagctcatgacttgaagtcatccacctgcctcagcttcccaaaatgctgggattacaggtgtgagctgccacgcctgggcactataagcatttttaagaggtactgtgtagctcttagtagtagtaagatcattctattcagacataagagaatgccgaagtggaacaaatatattgtctgtcaatatctggagatattttaattgaataaaagtggcagcagtaagctctttggaccttacaggaagcatttgaacaataatgagtacaaaaatcttgggtgatgaagcagaaaatgcttttgactaaagcttttctggcttgcctaatgcttttgaccagagaaataagagaaggaattaaacagacagtggggcatgtcaccatcactgctacatcagcctactgattttcagcaatcgtggctgaagaccctgggtttgctatgaagctgttttgaaaatgctcctgctaaatcaagtaactcaagtattttcttcatctagaatattcaaagtcatctgggtgaggccctaatccaagatttaatcaactactgtctgagctacattgcgaaaattaaactcccgaagaagaggtgggtttgcttttaacaaagaggcgtcacaggaacatagcgtagtgtcacatggtgggctaatgtgggcattctccaaataggattataaaaatcacctaaagagttttaaaaacaaagtctgatatttagcccgccccttggcaattctggttcagaaagcctgagagccgagcttggaaatccacattttctctggctgccctggtgctgctggttcacagcagggttcagtagccaccatgggccagcgaatttaaatccgaatcccagcacttagtaaggaataattggaaacagtccacaaagccaacagtacaagaatgattacgtaaatgatggcttatccacatgatggaaatttatacaaccattgaagaccatatgctttcaaaggctgtcagtgagaggaaacagcagtgaagcagcatgtacaaaaagcaacagaaaccctagatcgggaagtctgagacaggaagccttcgggccagatccacgtaaaacccaaatctggttggcctgcagtgttaaagaaaatcggattaattgccatcatgtaaaagtctgattttatgtttgttttatttatttatgaatttatttttgagaccgagtctcactctgtggccgaggctggagtgcagtggcaggatctcacagctcactgcaacctccgcctcccaggttcaagcaattcttctgcctcagcctctcgagtagctgggattataggcgcacaccaccatgcccagctaatttttttttttttttgtatttttagtagagatggcatttcactctgttggccaggctgatatcgaactcccaacctcaactgatccacccaccttggcctcccaaattgctggtgtcaaaggcgtgagccaccttgcccagcctgattttatgttttaaacatctggatttctggcttctgttggcaaatctgagacctggctactccggctcccagttccctgccggcaggtgccacctgagcagctgccacctgactcatggacatttgttccagtcacagactgcttctctcattttctgtctccctaggctttctttttgttttttgttttgttttgttttttgagagagaggatctcgccctgttgcccaggctggagtgcagtggcatgatcatagctcactgcagcctcaacctccttggctcaagtgatcctcctacctcagcctcctgagtagctgggactacaggcacatgccgccatgcctgactaattttttaattttttgtagagatagggtcttgccgtatggcccaggctggtctccaactcctggcctcaagcgatcctcccacttcactctcccaaaatgttgggattacaggcattagccactgcccctggctttcataaatgtttggtttggggacctaccttctgccatgggtacaattatctcagttccatttttaaaataatagtaataataataatgatgaacataaatgccgacagtaaatttaaagactggcaggaaatagacccaaatgttaacagtggctatttcttgatggtgaggttgcaagtgatttctttgaaatccttctcatttttacccccagttttcaacacttactatgtaacaccttaatcatcagggttggaattaagtggcaattcaatttcagggctgggtgtacttcagaggctgcttcacactattaggattcataacctgagcgcctcctgctcagcatctccagccagagtgcaggaatgtcccttagccgagggggaggcctgcatgagacaggctggacatggacttggttattgttgcagctgggtaatgagcacatgaggacttatcctattctgtttacttttgtgtgtgttagaaattttccatggcgaaaagataaaatatacaaatatcccaggtcagttccatttttactttgggctgagcactaagggaggatttaaaaaaaaaaaaggcataatcctgtcctcaaagagcgtatcatttagcgagggagagggatgtggagagccataattccagaacagtagaagagacctggtgaatccaggaggcagaactgagacccaccttgatccacatttgtccacatttgcctgacaacactaactacatgccccacaacggccaggcagatgcagtaagacttcagagagcccaggtctttagggcggaactgattgcttagtaaaccaccttcagccttgttttggggaaggctttctaaactgcatcaacttctctctgtgccttggaaatgagaagaagaatatgtccttgagtgggggggcattaattgagctctttttctgatcattaggacctttagccctagggtcacccggggcacggtcacccgtcccctagtgcctcagtgctcatacacacgtggtagaggacaggctgggcctctgccaactccgggacggcctggacatgggattattgagagagatttttaggctcgcatattttgttacatcatttgcctctttctctgcaagttgagcaaaataggagagaggatccagacgattgagattttgctgtttttactttaatgagtattcattgcttcccagtttacaaagtacctttacataactggcatgtttgatttttaacaaggccctttggaggtaaccagagcaagtgccattagcctttctgtaggtgaataagaggaggcttggagaggtgcccagagccacacagcctcctaagaggccacactgacatggaatcaggtcatcagccctgcacgtggcatgtggtctctcggtatttccaatggccagtgccaggacatcaggtctgtgagattaaaatagtagaaaaagatgagggaaaatgtttcatagggttcccaggcatcagcgtttagaactggaagacacttttcactgcatagtttgtcagaaaatgcttaaatttcattggtcagaatgatatctagcttacaagttatctgaacttttaagaaactgggtggttttctttttttggttgtggggtttttgtttgtttgcttgttttgttttttttgagacagagtctgtctcccagactggagtgcaatggcatgctctcagctcactgcaacctccgcctcccgggttcaagcgatcctcctgcctcagcctctcaagtagctgggactacaggcatgcgctaccatgtcccgctaatttttgtatttttagtagggacagggtttcatcttgttggccaggctggtcttgactcctgacctcaaggaatccgcccgccgcagcatcccaaagtgctgggattacaggtgtgagccaaagaaactgttttcagactcaaactggaaaccgtggaaaaaaactctttgttttttgttttttattttttgtttgttcgtttgttttttgagacggggtctccctctgttacccaggctgtagtgcagtggtacgatcttggttcactgcagcttccactgcccgggcccaagcaatcctcctgtctcagtctcccaagtagctgggaatacaggcatgtgccaccatgcccggctaatttttgtattttttgtagaaacggggttttgccatattgcctaggctgctctcaaactcctgagctcaagccattcacccaccttggcctcccaaagtgctggggttaataggtgtgaggtaccgcgcccagccaaaagaacatctttaaacatcgtcatttgaagtgactaaactaatgttagcttctcattttctgtgatcaaatcaaacatttaggagctgtctgctactgggtaaattgaatttcctcagttattactgaggctcgttggacaattctcagagcctttttctgtgtagctttgcttggtactatcagtctgttcagaagctccgtagcaaaatagatgtctggtacatgtattttcaaactcttctaggaaatgactgctgttgccagtgctggaaatcattttcatagctctttattaaccacaaaattatctgcccagtagcagcactgtgcaacagaaatagaaagtgagctatgtataattttaaattttctgtagccacattttgaaagaatgaaaaggaagaggtgaaatgaattttaataatatattttatttagcctgatatttctaaaatatgactttttttttttttttttttgagacagggtctcactctgtcacccagactggagtgcagtggtgtgatctcagctcactataacccctatctcccaggctcatggaatcttcctgcctcaacctcctgagtagctgggattataggcatgcataaccatgccaggctattttttgtattttttgtagagacagagtttcgccatgttgtccaggctcaaaatatgagcattttaacacaaagtcaatatacaacatgattgatgcaattacattcctttttcatactaaatctttcaaatctaatctcaattcatattagccacatttcaagtcttaatagtcacagtagttcatggctaccatattacatagcacagagctgagaaacattgaccacactagcctctgctttttagaatttcccaagattttaggctgtttatctatgttgcccaaatgaataacgtgtttttggagaaactctgtcaccctttcattcccaggggtactttcattgaattccgaaatgggatgttaaacgtgtcccctattggaagaagctgcagccaagaagaacgcattgagttctacgaactcgataaagtacgtctttctgaaatatctttggtgaatggctgggtttatggaaataagatatggcctggtgtggtggttcatgcctgtaatcccaacactttgggaggccaaggcaggaggatcacttgagcccaggagttcaagaccagcctaggcaacatagtgagacctcatctctacaaataataaaaaaaaaaattagctgggcatggtggcacacacctgtggtcccggctatttgtttggctgaggtaagaggatcacttgtgcctgggaggttgaagctgctgtgagctatgatcatgccactgcgctccagcctgggcaacagagcaagacccccatctcaaaaactaaacaaataaataaatcaataagataatcctacctttgtggccagtagttaaaactgtgctttctaaactgcaatacaagaaacaattggtatctttttgtttttctcagaaagaaaatataagacaaaagtttgtagcagatctacggaaagagtttgctggaaaaggcctcacgttttccataggtattgtatatattgcctgtgttccaaacttggatacccatttcccagagtttgttgtgggccagtgagctattgataatgaagtatgtgcagttttaggtgggcaggaagattaaatgagcagtccagtctatagacaaaaaccaaccactctcttttctgcataattagccataataggacttgcctagtcaagaaacagcttacacgctgttgggcttggttctaaattcttacccaacagcattcttcctacctggactcctctcatcaaaagaggagcactttgattactaaagagtaggaacttctcacacctttgggcagaagagaagcactatagtgaactccataagggagacatggaattgaaccccttaggtaaactagaccgatgttttggaatcatagaatgtttcaacagcaaggaaccttaggggccaattgggtggcttttacagatcaagaaactgaggcccagaaaggagaagagacttgtccaagttcacaaagctgttgtttacacagccagtgtgtgaacgtttctggtgtctaatgcagagttcttcctgcagcacggacatctcaggcttgtcttttgttagaatattcctgccaaatgctttgcacaccgatttctcttgtcagtgctaatgagtcattgctcaaagcctcctcattttactagctttcatcaaggtagaggttgtaggaaaactggaatggcaaagggattatatttaacagatgagtgggtgggttttttgtcttcctgaactgtgagatggacatctttctgacaaagctttgaaagggtttttgttgcccgtgagcactgcctgtaaatcaccttcagtgaagattctcatttttcccgcaaaatatgccggatgcaacctgcttccgggcatttccccctgagggtgtgttaaagcccgagacaagcacagcagaatgaggctggtatccgatttttcataagcatgcttcctttaaaccacacgcttgacagggcgcttaaacgcaaatgcatttctcactctgagttggcattctgtgcctcaattttagacctatgtgaaataatgctggaaaaaaacaatgtagaattaatttctagaacctatgcatgaagtagtctaagtagcaaactagagtactgaaaatcaaccttggcaacccactaactgacaaaagagtaaattgtttttttcagtgacatatcattagcccctttttcaccttttgcctttgtgtgccccgtccccacccggcaggaggccagatcagctttgatgtctttcctgatggatgggacaagagatactgtctgcgacatgtggaaaatgacggttataagaccatttatttctttggagacaaaactatgccagtaagtagagaagtgtttgtgcaccttcattgttgcatttgcgcttgatgggggaaattgacaactgggctgtttttcctgtacctacactttacccacccgccctgctcaaactgagcagtggcttctgtcctggagaggtgggtgattgagccaccttcccctctaagctcagacccccgacgcctctgtggaggcaaggatcacactgcatgttagttgaaccttttcaccttggctttggaattaaacgttggccaccctatgtgccttccagaataccagtccccggtgccactgtcaaaccctctgcgtttcaaagctctggctgtttcaacctcatttttccactgtatttgtccacccgaggcattcattctaagttgaacacgaggggccatgaacgatgggaggatagggaatgatctcatgagcctgaaacaggagaggacaccagcaacagcaaagaggccaagtgagtcccaggcatcacacacggcgggtgcttggagctgcccccaagggatgtcagaaatctcgagttcagggccaaatctaaactgagaactgagagcagagcccagtgttaaaggccagggccagcaggaggaatacatagaagaaatgcccccaggtgtcctctccgtggggcaaggtggatccccaggaggtcagagaggcgttgctgccatcaaaggcccaagaggaggctcatcaccacccagctttgggccagctccttttctttctctttttttttttttttttttttttttctgagacagagtctcgctctgttgcccaggctggagtgcagtggtgcaatcttggctcactgcaacctctgcctcccaggttcaagcaatccttgtgcctcagcctcctgagtacctgatattacgggcatgcaccaccacacctggctgatttttgtgtttttagtagagatagggttttaccatgttaaccaggctggtctcaaacccctgggctcaagtgatccaatcaactcggccgctcaaagttctgggatgacaggtgtgatttttagtacagacagggtttcatcatgttggccaggctggtcttgattcctggcctcaaggaatctgcctgcctcagcgatccacccacctcggcctctcagttctgggatgacaggccgcgcccagccccatcaccttttcagttactcccatcctctgggcccctctgcctccctcccacatgcaggctgggggtgttggttaccttgccatcagcaggcccgtgtcaggctttctcgccatcctgcacctagcaggtgcatcataaatgctgcatattcagagtttctcatccctctgatctctggtccactccaaaatccttgctgcactgctaagatctacccatgaaagatttgcttttcagcagggtccccacgtcacagtcttccagcatgaggggtacacagtggtagtagaggcttgttacttattttcagaatgataaaactgaaacccataaagggtaagggatttgccgaaggtcacacggctaatgacagagctggtggcaccagaagaagtctacctgttctttgtatgttttaaatagctttattgaggtataattgatcagcaaaagctgtacatatttaacgctcacagtttcgtgagtttaatcattgtgcctctttggttttgggggcggtttgggatttttttgttgctattgttataagaacacttaacatgagatattccctcttaacaagtttctaagtgtacaatacagtattgttaactataggcacttctgtttgtccaacagatctgtagaacttacacatcttacataactgagacattacacccattgaacaacaactctccatctccctcctccaccgccccgtccctggcaaccaccgttcttttctctgcttatatgactttagcacctttagatatctgatacaaggggaatcatgcagtattcatccttctgtaaggggcttattcactcagtatgtcttctcagtttactcatgctggcacaaatggcaagtttccttattttttaaggcggaataatgtttcatggtatgaatacactatattttctttcttttttttttttttttcttgaggcagaatctcgctctgtcgcccaggctagagtgcagtggcaccatcttggctcactgcaacctccacctccctggttccctggttcaagtgattctcgtgcctcagcctcccgattagtggctgggattacaggagcctgccaccacgcccggctaatttttgtatttttagtagagacagggttttgccacattggccaggctggtctcgaactcctggcctcaagagattcacctgccttggcctcctaaattgatgggattacaggcgtgagccagcgtgcccggtcagaatatactccattttcttgatccattcttctgtcagtagacacatgagttgtttccgtatcttggccattatgaataatgcttcagtgaacacgggggtacagatacctctctgagatcctgacttcgtccttttggccatctacccatggattaaagacttaaacacaggacctgaaactgtaaaactcctagaaaaaaaacatagggaaaaagcaatgatattttagatgtgacaccaaaagcacaggcaacaaaagcaaaacaaacaagttggacaacgtcaaactaaaaagtgtctgcacagcaagggaaataatcagaatgaaaaagcaacctacagaggggaagagaatatttgcaaaccatatatctgataaaagggctagtatccaaaatgtataagaaactccaacaactcaatggcaaaaaaaaaaacaatttaaaacatgagcaaaggacttgaatagacagttctccaaagaagacatgcagatggccagtgggtatataaaaaaaggctcaacatcagtgttcagggaaatgcaaatcaaaactacaatgagataaacctcacacctgccaggatggccattttattttattttattttgagacggagttttgctctgtcacccaggctggagtgcagtgatgcgatcttggctcactgcaaccactgcctcctgagttcaagctattcttatacctcagcctcccgagtagctgggattacaggcgcccgccaccatgcccagctaattttgtatttttagtagaaatggggtttcaccatgttggccagcctggtctcgaactcatgacctgaagtgatccacccaccttgacctcccaaagtgctaggcttataggcgtgagccaccacactgggccaggatggctaattttgttttttttaatgttggtggctgggtgcggtggctcacacctataatcccagcactttgggaggccaaggtgggcggatcacctgaggtcaggagttccgagaccagcctgaccaacatggagaaaccccgtctctactaaaaatacaaaattagctgggcatggtggtgcacacctgtcatcccagctacttgggaggctgaggcaggagaattgcttgaacccgggaggtggaggttgcagtgagctgagattgtgccattgtactccagcctgggcaacaagagcgaaactcggtctcaaaaagataaaataaatgttggcgagggtgtggagaaattagaacccttgtacactgttgtgggaaatgttaaatgtcatagctatgatggaaaactacatagtggttcctcaaattaaaaatagaactgccatatgatccagcagttccacttagagatatatatccaaaataattgaaatcaggatcacaaagagatacctgctgtttaaaataaaataaaataaagacagggtcttgctgtgttgcccaggctgtactccaactcctgagttcaagcaattgtcccgcttcagcctcccaagtagctggaattagaggcgtgcactaccacagctggtgatacctgctgtttaaatgagtgtgctttccactacgataagctctctctcagtggggtagaaagatcttgttctaaatcccagatgaactgggtactttgaaggaggtgtagcattcaggtttgttcttaatgacagttacatatggttttataaccacatccttttgttgaaatgcttttgatgcagaaatgctttcagtgcaggctttgaaaaagatcaccgtctgacttcatgtctttaaaaaaattaagctaatgaaatgacacctaggatctaagggatgcccggaagcttcctcagtccttctctagcttggtgccatttcttgtagacagagaggagagctattaagacacacgacagcagattgttctgtaatgatgacattcttgcttcatgtaaatagccatttagaagcctcagttgggactttgcagaatggaatgcagttcttggataatcagaaaatgacttattttgggaattcttcatttgggaattagagggttttctattctgtttaaccattgcattaccatgcctggattctatttttaaaatcttacctacgttttaaaaaatgagtattatttaatggaagctttcccccaattgtaaattaacctgtgcattcattatagaaaattagagaaagtacgaagaagaaaaagaaagtcacctataatcatccaacaatgtcccagcctttctatgtatatgatcccaaaagtgggatccttacatgttgttttagttttagttttctttctcttaacgtattttatttttatcatattagtgaatattctttgcaaagaagatttttttttttttttgagacagagtcttgctctgtcacccaggctggagtgcagtggcgtgatctcggctcactgtaagctccacctcccgggttcacaccattctcctgcctcatcctcccgagtagcttggactataggtgcccaccaccacgcccggctaattttttgtatttttagtagagatggggttcaccatgttagccaggatggtcatgatctcctgacctcgtgatccgtccgcctcggcctcccaaagtgctgggattacaggcgtgagccactgcgcctggcgcaaagaagatttttaatggctgtataatattctctcattaggcatcagttactcacctcccttgcagaggcacgttgggtggtttaaggggttttgctatcataactaatgctgtggtgaacattcttgcacgattctttgcccccatccctgatccttttcgtcagcggttttctagaaatggaaattagcagtccagccatgtaaaccttcaaacaacctatcagttcttgaaacttcaggtgcagagcaatccaaatactagccttacactttgcattttcagtgatagacatttagaaagctggggttttttcctttcctaatgaagtttgatgtttttgccggcgtccagggaagtgatcctgagctgaggctgtcagtaaaaaagccatttctcagccaggccctgaggcttagcagcctcttccagcagcacagcctccaggaggcagagtctggtgttacataaagggtgccatctgcttggagcaactcgagagcagagtgaggaagtgtggcgttggccgttgcttttcaaaatatttgccatcttcagaaaccctgtcattcttcccatcagccacaaaagccagtgtttcttaaaatctggctctgagttcagcatggaggccctgggcctggcatggagtaccttggtttgttgcagagagagagagacggcaagggcagagagcacacaccacacatggctctgcatggctttccagaaaccaccctggctggatcaccctcagccactctgaattcgcaggcaagagaacctgtacttacccatgctttctgtaaaagtcatcttggctttaaggcagttgcaacatgaaaacattctaacacttcatgaatatcaagcagctggtttggtttttgacttgacgcttccattttgggtaatttggctatcagtgcactcaagcatgtgtgaaagactcacgcagagggttcagggttggggacagccccgctgctcctcaggaggctggccacatgacagtggtctgtctctgcactgggatgccatgtagctgtaaaaagagtccatgtggacccatctctagggctttttgttaggtgatcaaagcaaagtgcaggacaatataagtaatgtgctggctacatttttgtctaaagagggcaaaggaatttctctttttgttagcttataaatgcataaaaggagtctgaatggatgaaatttacagaggttactgtgggggtggggaggacaggagagagaattgccacctaggtcttaactctttcttaatatgtttgaactatatgaatgtgctatctattgaaaaataaaatttttaaatcaacttgagaaaaggatctgagtaatccctgtaatcctggctactagggaggctgaagtgggaggattacttgagcctaggagttcaagattatagtgagccacgattgcgccactgcactccagcctaggcaacagagcgagacctcgtctcttaaaaaaaaaaaaaacaataaaaattaaaaatttttaaaaattgaaaaaagggaggaaatgtaaatcttccagcacttcctcagtgtcagaccctgagctggacacttatgttgtacatgctcccaggggagacagcagcatcctccctcttacagaggaagcacagtgggaagtccagggtctcagctagtcagagactaagctgggatctgaaagcctcgcctctgtcattctcctacatcgcttctaacatgctacctgccttccttttaagtaaattgtgcaacattttattctccagaaatgttaataaggaagatctgcctttaaaattagcttaaaaatacaaaaattagctgggcgtggtggcgcatgcctggatcccagctactcaggaggctgaggcaggagaagcgcttgaacccgggaggcggaggttgcagtgagctgagattgtgccattgcactccaggctgggcaacagagtgaaattctgtctcaataaacaaataaagaaaaacaaaattagcttaaaagaggtttgtatcagtgtggaccatgttgacccagatctggccccaccattcaccagtgaccttgtgacagtgaggacagtgacagtgacctcgtcagcccagtgaggacacagttcttctttttttttttttttttcctgagacaaggtctcactctgtcacccagactggagtgcagtggcgcaatcttggttcactgtaatcttgaactcctgggctcaagtgatcctcccacttcagcctcctgagtagctgggattaccggtgcccaccaccacgcctggctaatttttgtatttttagtagagacggggtttcaccatcttggccaggctggtcttgaactcctaacctcaagtgatccgcccaccttggcctcccaaagtgctggaattacaggcgtgagccaccactcccgaccacagttgctcttctgaaggagtcatatgagaatgaagtgaaggcatctgaggaaagtgggtgacgcagggcctgactcaggaaaggcagctgggacatgcatctttggcctggtccacaaccagcgtctgcttccttcactttctaagaaagttattcaaaggctcatctgttattgagattttcctaagagattggagcctgccaagtccctcagtgaagggccatccttgtgagtgagcaccttcctacacaccttccaacagttcattagagcgtgaattagtgaaccatgtcctcctgtcctcaggttccaagttaggctttggatggcagttggcctttgcgatcctggacttaaccatgcctagcatctgtagctctttcaggactcaaggctaaggagggcacagaatggattctgtggatagatctgtcttactacttattgctgggaccacatgatttgagacccaggtcttcttgtgtggctggtggcagacttagcttcttaacatgtgagtccctcactcctggagggaccctgagtgaattgccgctcccacagtcagcttccagaactgactggcagaaattgatgagaggttctcagcctggtggagatgtcccacccgctcctgtgtgggaggccaggaagcagggtgtcatgcatgggagccacgagcttcagatgttcctgctagcccaccttcctcctgagtgccagactccacagagtccatggccctgggtgttggtcccaggaataggactgtggctaacaaccagcccacagagtgagcatccctgcctgtgtctgtgctgaagctctttcattcagggagacactggcttcaaacccctggagtggggctggccttccagggagccccttgatgtccgcagaatcggcatctcctgtgggcattccaggcccagatccgtcacagagctgtctcctctgcccttgaaggccggagaggtgaaatgagagggctgtgctcagagccgtcaacagacccaagggtcactcgccctagggccactagccccttggccagctcaggttccaccctcgcccccaagccaaggggtgttttttcctagattctaagtcactggtgctcagccctggatatatattggaatcacctgatcactttcaaaacatcatgaccctgggcttgggccatgccccaaacaagcatttttaaggcatccccagggactctagccagggagagccactactgctctacgccatttcagagcaggctcttgtctcattggccctgtaactgcccaacaggttctccttgcccactgcctagacaagagccgatttatcaagacaggagagttgcagtagacaaagggtaattcacgcagagctggctgtacaggagactggagttttattattcctcaaatcagcctctccaagaatttggggatcagagtttttaaggataacttgctgggtaggggcttgggaagtggagattgctgattggtcggcttggagatgaaatcatagggggtggaagtgagtttttcttgctatcttctgttcctggtgggatcaaagagctggttgagccagattacctgtctgtgtggcatcagatactgcatcagaacacagggtctacaaaatatctcaggcacaatcttaggttttatgacagtgatattattttcaggagcaatttggggaggttcagactcttgtagctaatttgttagtcctacaaaggcagactggtccccaggcaagaagggggtttatttcagggaaagggctgttaccggcattgtttcaaagttaaactataaactgaattcctcccaaggttagtttggtctgcatccaggaatgaacaaggacatcttggaagttagaagcaagatggagtcatttaggtcaccatcataattttctcagttaaaatttttgcaaagacagtttcagttcctcctgttgggttttataataccttattcctaatacttcatactgtgggatatgaagatgggaaaagagtgataaccgctctagcttctttctgctgacagggagcgtagtcagggtaggtgttgacccaaaggtaggaggagtgaaaccactttgcagctgtctgcttctactcaggggttcctggttagggtttgaaggcctgcatgacaaaggcattagtattctcatctatagttttaacaaatgagtcctaggataaagagtgaaagtcctggcttcagaagcttttgtagaattgatcctaagctctgagggacccaggtaaatagctccaagaaccaatcagacatggggttactagcagagagagatttgggtcagaggttgttagacagacagattggggtagacaggaaagaggaaatttaaatatactcatccttatctttttagtcagttttcctagtcctaagactagatcagttcagttaaacagctgtttccattatcaagagatggcactggagatgggctaggcatctttagttatagaggaggaaggcagtggcaatttgacatgtttttgtcatctgtattacaaagaataagcttcagcttgcagggcctcaggaaaaaggtagtagcaatttaattgagtccaagtcagaaaagtgggaaaaaaaaattgaaagcattagtttgggaattgtagcccacagagaattcaggatttagtccaaattgcaggaaataataaaaactcaagaacaaaggacaagactagaatctaacagcagggtgtatcatagttttttgaaacacttttttccctctcccatccttatttttattaaagacaaaccgtagtaggacaagtttacttgcaaaataagtcatagtcttattaagcttggcctgattatttgtataaagtaaagcaagaataattgtttgccagataggctgtttttaaaattggctttgctgaaactttgttccataagaaatctcaggttagacttttttaaagcctcgagcccagccatggatttatctactatacctgcaaagataaacctgtatgagttgggtgaaattttttcttctcatggtcctaagataatttggggctcctgggcctgtcaaaaagtgacggtctttatttaccacagttcaggaaccccgtacagggactgtgtagacaaggtatgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttccaaattctggagaaatcagagagaaggcaatatgctctaaattttgctcacagaagtatactttaactcaattgttaaagttgtaaatagctcaaaagaaaaatagttttctggactctgaaaaacaaaaggattaacaatgtttaacacatcagctctccatgaggatcctagaagttttttttcctccattccaatggcacaatttgtaaagttatcagagacctgcattcaagagtacccattagagtactatatctgattataaactgccttttgaaaaggataaaaccaagacagcaactgcctgtgggtaacaaaagtctcaggacagccgtagttaaagatgcagtcaacaaggaaatctggtcatctctgtgacacacagtttaacagaacagttataattattactcataacatatactgagacgtatcagaattataggagtcttacacaattttgtaacacatactaataacatagttatacgactataaacccaaagaaagttaaacacttttttatatttgacagtgcttcctacataattttaatacaccaaataagccaaatatgcctcttttggactttaggggactttttttttttaacttagaatttgatcttgggaagtttgttaaatatcaaaggtttgaaacactagatatcacaaagtagaatcccaggtcaccataagtaattcatttagccacaatgataactcaaacattttgtaacaggaaaaacctttactctgatagagagaagactcagctttctaaacaacaaaacccagtgaagatagcatgaggccaactgaatctttcttttattttttttaatagtttactccaaagccaaataaaaatctttcattgtctctctctgtcaatattacataaaaatattcttcaaaagagaaaaccaaattttatctcgcattagtgcatctttaatgctaaagctagttttgtttttgttgttgtttgaggtggagtctcgctctgttgcccaggctggagtacagtggcacgatctcagctcactgcaagctctatctcctgggttcatgccattctcctgcttcagcctcccgagtagctgggactacaggcgtgtgccaccacgcctggctaattttttgtattttttagtagagacggggtttcaccatgttagccaggatggtcttgatctcctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattctcctgcctcccaagtagctgggattacaggcacccaccaccactcctggctaatttttgtattttttagtagagactgggtttcgccatgttggccaggctggtcttgaactcctgaccccacgtgatcgcccacctcagcctcccaaagcgctgggattacagttgtgagccaccactcctagccaaagctagtttttaataaaattttacaaacaaatgtatccgattttagtttgactgtagggtaacattttcgtaaaccttttatataaccctttataattgtttgttaacaaatcagtgttcaaaaataaaacactatttttttttttttttttgagatggagtcttgctccattgcccaggctggagtgcagtggcacattctcagctcactgcaacctctgcctctcaggttcaagcaattcttctgcctcaacctcccgagtagctgggactacaggcgtgtgccaccacgcccggctaatttttgtatttttagtagagacaggatttcaccatatgggccaggctggtttcgaacttctgacctcgtgatctgcctgcgtcggccttccaaagtgctaggattacaggcatgtgccaccgcatctggcataaaaccctattattttgatatatgggcccagattctggccctgcatcagtatgcttttaatatttaatttatggaaaaaattaaataataccctttcgattttagccagcttgctcacacacagagttgttcacaaagttaatttttcacaaacctacaatttgcttaaactttcagttttattttgtctttcaaccaaaaataatctttaaactctctaaattagagaagattttctcttttaaaaaaacccatattcccatgtctttaagcagttttaattacataccaagtgcagagcctagaatacaggacagaactgcagataaagtctgactctctctggcctagctaggagtcatggctacctccatatgtccccaggccttatctggaatctaatggctctaaagtaggtaaattgaacaattacaaaagtcacagaagccacttatgaccttaaagcatccagcagaaacagtatctgatctgcctaattcagaccaaatgaagacagttttatttcatcaataatctttaaaactatctttatttaccaaagattactaacgtcatgtgaactaaaatgcattagagttgctatttctttgaaaaaatatttaagtgcttattttttaagccaattaattacagctcttaaacatcacacacacaacattataaatatatagaccgaagaagatgcattagttaagatttttcatttgctgattttttaggggttttttttccccattttacaaatcttgtcacgactcacagagaccatctatgccatgcttggactgtctgacttgtcctatgtgtccctctttcgtgaataatcagtcgttctattttaggacaagaatttaccatacaagatcttttctcatataaatttctttttttataatcatccttaccaaaaatacatctttatagcctcaacttttttcacatatctctctcccctactaaagtaattcctgatgccctcaaaagtgaaaaaggccaagtaatgtgattcaaaacagaacagagccttagattttgagaggggtctgtctgcttacacttcttggggttttatgaggaaaacagagtttctcccaaaacagggtctgtggagccttctctctttttcccaaggagtccccagctgtcagaaagtaccttaggtcctctcatgtgggcattcagagtggcaggaagacagactggggaaataattcagttgactgagaagaaagacaaacaaaaactcattcctcgaagaaaaaaaaaaaatccaggaagagaaaaagcacaaaggccttttttttatttttttatttttatttttatttttttttgaaatggagtcttgctctgtcacccaggctagatagagtgcaatggcatgatctaagctcactgcagcctctgcctcccgggttcaagtgattctcgtgcctcagcctcccgagtagctgggaccacaggcacacgccaccaggcctggctaatttttgtatttttagtagagacagggtttcactatgttggccaggctggtcttgaactcctgacctcaagtgatccccctgcctcagcctctcaaagtgctgggattacaggcatgagccactgcacccagcccacaaaggccttttaaatgtgtgcatatatatatatatatatatatatatatatatatatatatatgcacacatttatatatatatatttatatatatttatacatatttatatatttatataatatatattatatatattgtataatatataatatatatgttatatattatatatatgttatataatatatgatatatatgatatatattatatatattatgttttatatataatatatatttataaatatatatatttataaatttatatatatatataaaacttggatatccatttttaattaagcagattttaactgtagaactctttttttttttttttttttttacaaaatctttttaaatttcttattaccagactctagccaggatagacagccagtatttctggcttttgaactttaccacaggtaacctcctagcaaaattaataagtcttatctaagattatgacttaactacagaagtataagatgtctcaaagggatggtaagcagttttttgtttttttcttttacaagatttagaatctccccaaacgtagtttagagaaaagaaaatttaaggcagatttcaaggcaagctgtccatggtggggaaagaatcaataaatggcacacaaaaaaaacttacataaataacaaaccagagagcacccattccgtaagctgggaaccagacccaggctaccactgtgaaatagcaaagcttcagctactgagctaaagctgaaggctgttacactggtcttcctgggaatccaggactttactcaagataattcttaaggctagacatgacactgtcacatgtcctctcagaccagctaccgacatgaacccaaaaattcatgccctctggatgccggagaccaaaagagggtaccctgacatggtcccaaagtcaagtttttcaggacgtaaaacaagagaagagggaaaccttatctggtttttgttggagcaaagtttggaactgaccagtctgccaggctggattgaacagcgggcttagaggggtcctatgtccacatcctattctgtggtcctgctctccatgacagaggatgcagctgtgagtgggtttggtttgcgctgtatctccagctactaaagcaatgcttggcaggtagtaggtgttctagaaaggtgtgtcgtattaatgtgtgaatactgactccccctcctaagtcactgagtgaggagagaggatgtgtgattcatctgaggcatgtgagagctggttgtgcctttgtctttgtttttcttttttcttttgagatggagtctcactctattgcccaggctggagtgcagtggtgcgatcttagctcactgcagcctccacccaccgggttccagtgattttcctgcctcagcctccagagtagctggggatttgtattcacagcacagagtgcaccagattccctacagcctaagtctaggctcataagattttttctattaatcagacccttgcagaggagacaaacagtgatgttttccattcatacacggcgagaggggccagaagcctggctggtaagaaatgtttaccctttttgcctgcatgtcaggtttctgggttcccattctctgtagcttccagaagaacggagcagctcttgatgaccctgatcgctgcacgctagctgtgggcgccaagtcgcattgcaaaggaaaaccatccgtttctgttttatggaaccacaggcaaaagcctctcaatttttcaagatgctgcccaatgggctgcatggggaactgaattaacattttccatcctggccagagcagagtacacatgacaaaactagtcactatgctcagtgcccagcatcaacttggcaaggctcacacttgctcccgttggtctctgtcatctttgatccactccactcaaggtgggaagggacgccttccaccgggaattcaaaggatggtctctgagccagatggaagagcggatggtcaccctcgaggcagccctgtcaaacttccgagcttctgctgacaagtccttcagggttcagtgaatgtgaccaaccagacaaactaggagagcctgatggacttccttcagcaattcccttagacatctcctccacatatacaaacacatacagcaaaacaccttccagaaagagtttccagactaaatcacaaaccaagagtattcctccaaacaagtcccctattctctgtacaattagggcagataccccatgctggggctacaaacagataccacctaatagagctagagatgccccatgatggggctacaggcagacacccaatgatggggctacagacagataccctgtgatggggctacagttacaggacgtctccccaggactgtttattgcagttaaatccatacaccatgggttggcagcaccccattagtagagatggtgccagtgtcagcccccagtcgaagagaactaggtggccgcctgggctggcctctggatccatcaccagtgaggggggttggggaggctactgaatcgctggaagatagccacaagggagatcacagatgagcccccaaatttgtaaccccctccacaggttctccttgcccacagcctagacagccaatttatcaagacaggagaattgcaatagactaattcacacagagccagctgtgcaggagactggagttttattattactcaaatcagtctccaagaatttggggatttgagtttttaaggataacttggtgggtaggggctctggaggtgtggattgctgattggtcagcatggagatgaaatcatagggggtagaagtgagtttttcttgctgtcttctgtccttgggtgggatcaaagtgccggttgaatcatattacctgtctgggtggcgtcaactgctgcattggaaggcagggtctgcaaaatacctcaagcactgatcttaggatttacaagcgatgttattctcaggagcaatgtggggaggttcagactcttgcagccagaggctccgtggctccaaaaccataatttctaatcttgtaactaatttgttagtcctacaaaggcagactggtccccaggcaagaagggggtttatttcaggaaagagctgttatcctttgtttcaaagttgaactataggccgggcagggtggctcacgcctgtaatcccagcactttgagaggctgaggcaggccgatcacttgaggccgggagtttgacaccagcctggtcaacagggtgaaaccccgcctctactaaaagtacaaaaattagccaggtgtggtggtgcacacctgtaatcccagctactcgggaggctgaggcaggagaatcacttgaacctgggaggcagagattccagtgagccgagagtgtgccactgcactccaccttggtgacagagtgagactccgtctccaaaaacaaaaaaaacaaagttgaactataaactgaattcctcccaaggttagttcagcctgtgccctggaatgaacaaggacagcttggaggttagaagcaagatggagtcaggccagatctctttcactgttaacattttctcagttataatttttgcaaatgtggtttcagtccctgcatccataatacctagaaatttgataaatacttgttaaacaaccaaaataaacatccatagcaagaatcgactataaggcatggtggtgcacacctgtagtcccagctactcaggaggctgaggtgggaggatcgcttgagcccaggaggtggaggctgcagcaagacatggtcgcaccagtgcactccagcctgggcaagagtgggaccctgtctcaaaaataaataagagtcccgaccacgagctacagagagtccatctgtgctataggaggcatccacacagcacacacccactgctaccagcgaagcagttcacgcaggctgtgatagatcacactgttcctctctttggatgattggggttcactgctacactgcacaggtcagcaacagcatgtacagaaatgggctgcggtggggagactcatcagccccctggcatctgaacatggccaacactatgccttctgtttcatcctcagactttgggactattagggatttaaatattaatgcgcggatttcactgagccctggcctctctttggtgcctgtcaggtacactataatgagaaattggatcgttcattcttccctccccccttccctcccttctccagggaacagggtttttgttcttggagcttgggaggtggctgagttccccaactagaatcaagtaacctttagtgcatatgcaaatccagcatttgaaatttccggttctctagccttattattctagagggcagccagctttcctttcatttcatttggggtccgcttcacttgctttgcagctactctggtatgcaagctcgacacagccccaagaaggctgcaccccaggaaggagcccaccatgctctgagagtcacaaagaaagaagcagacccttggcgggagagaaaggaaggcctgaggcaggttgtgtttgtgatgcagatgctcctgcgagccgtgcggctctctgaaagcgggtggagctgagaagcaacccagagaggctcctgcagccagggtcgggaggatttcaccttcctggatgggaattgattctccagacctagctttattaagtgtcagcgagttacatgcacacagatcactcagattccacagacacctccccaccagcccccagcaggaccacgggaggagactcgtgccgttaggcctctgtccctgcatgtgacatctgcagggaagggcaggcctagcaactgtcaggggactagcataaaccctttttgcttcaggggtctcttcccaggtaatggcctctgtcctctttgcaccctggccggctgcaggagcctcctaactgctcccttcaattgcgtcctcaccccgcacccgttctccagaaagatcctgttgtaaagtaatctgatcatggcccgggcttgcaggcttcaggcggctacccgtgaaatcccaggtgcttaccacaatctgtgaggcccgctgtggcccggccccagcccctgcccatcctccctcttcagcgtcttctctgatggccacatggcctgtgccctcacgtccctcagatgccagggttccctcaccctccaggcctggcagcccttccctccctttgctcaacaaggcgcccaagagctgtctgttgatgactggtctccccagggcagctgtgatgtggttttggtttgcgccgtatccccagctgctaaagcaatgcctggcgggtagagggtttcgtgcgcgtccgtgtgaagagaccaccaaacgggctttgtgtgagcaacatggctgtttttttcacctgggtgcaggcgggctgagtcccaaaagagagtcagcaaagggtggtggattatcattagttcttatgggttttgggataggcggtgaagttaagagcaatgttttgcgggcaggagtggatctcacaaagtacattctcaagagtggggagaattacaaagaaccttcttaagggtgggggagattacaaagtacattgatcagtttgggtggggcagaagcaaatcacaatggtgggatgtcatcagttaaggctatttttacttttgcggatcttcagttacttcaggccatctggatgtatacgtgcaagtcacaggggatgcgatggcttggcttgggctcagaggcctgacattcctgccttcttatattaataagaaaaataaaatagtgttgaagtgttggggcggtgaaaatttttagggggtggtatggagagagaatggacgatgtttctcagggctgcttcaagcgggattaggggcggcgtgggaacctagagtgggagagattaagctgaagggaggtcttgtggtaaggggtgatattgtggggatgttagaagaaacatctgtcgtatagaatgattggtgatggcctggatacggttttggatgaattcagaaactaaatggaataagagaaggagaaaaacaggtataaaaggtctaagaattgggaggacctatgacatctgattagagagtgcctaaggagattcagcatagtcctgccagcaaagattatttatttacctcaagagtttagagtggcagtttggggatagcaccaggagatatcagctgtgatggcttggagaaacagtgtaaaccggcagtgtaaacaagagcagggcatgtatgagtagttgagaatggcgaataggaatatgactagacaggagatagtagggatgacaagttttggggggcacagtctaagttggtctggtgtctggaatgagactggggcctaataaaaaggagcgtctatacaggagcttacatgggctgtaccttgtagcattctgaggacaggcctgaattctgagaagggaaagtggtaaaagtattgtccagtcctttttaagttggaggctgagcttggtgaggtgtgtttttaaaagacctttagtccattctacctttcctgaagattgaggactgtaagggatatgaaggttccactgaatactaagagcctgagaaactgcttgggtgatttgactagtaaaggctggtccgttatcagactgtatagaggtgggaaggctaaactgaggaattatgtctgacagaagggaagaaatgactgcggtggccttctcagaccctgtaggaaaggcctctacttatctagtgaaagtgtctacttagagtaagaggtattttagttacctgactcggggcatgttgagtgaagctaatttgccagtcctgggtgggggcaaatcttcaagcttgatgtgtagggaagggagggggcctgaataatccctgaggagtagtagaatagcagatggaacactgagaagttatttccttgaggatagatttccacgatggaaaggaaatgagacgttctaagaggcgggctagtggcttgtactatagcatagcctgcctttgctgctatgtggcgattaggcctggtggaaccgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaggtccgggccaggaacaatggtaattgtgggacttaacaaagagtgagtacagctgaaggagccggggagcagaaagtatatgcatcaggtatgaggaagaaagtagattttggaagttacgagaaatgtagagagtgagttgagcatagtttgtgatttttacggcctctaaaagtattaaagcagcggcagccgctgcacgcagacatgagggctaggctaaaacagtaaggtcaagttgtttggacagaaaggctacagggtgtggtcctggctgttgtgtaagaattctgaccgcactaaccatgcctaggaaggaagggagttgttgttttgtaagggattgaggtttgggagattaatcagacacgatcaacagggagagcacgtgtgtttttatgagaattatgccgagataggtaacagatggggatgaaatttgggcttgactgaagtagtgggggctgtctgtgaagccttgtggccgtacagcccaggtaatttgctgagcctgatgggtgtcagggtcatctaactgaaagcaaagagacgctgggatgaagggtgcaaaggaatagtaaagaaagcatgtttgagatccagaacagaataatgggtagtagatggaggtattgaggacaggagagtatatgggtttggcaccacggggtggataggcaaaacaatttggttgataacgcgcagattctgaagtaacctgtaagccttgtctggttttaggacaggtaaaatgggggaattgtaaggagagtttataggttttaaaaggccatgctgtagcaggcgagtgataacaggctttaatccttttaaagcgtgccatgggatgggacattgagtggggtaagggtgattaggttttaatgagatggtaaggggtgcatgattggttgccaaggagggagtagaggtatcttatacttgtgggttaaggttgggggatacaagaggaggacacaaaggaggctttggattgggaagaagggcggcaatgagatgtagctgtagttcaggaatactcagggaagcagataatttaaagtgtctcggcctaataagggaactgggcaggtggggataactgaaaaggagtgcttaaaagagtaatgtctaaattggcaccagagttggggagttttaagaggtttagaagcctggccgtcaatacccacaacagttacggaggcaagggaaacaggcccttgaaaagaaggtaatgtggagtgggtagcctccgtattgattaagaaggggatggacttaccctccactgtgagagttacccgatgctcggcgtccgtgatggtttatggggcttccgaggggattgggcagtgtcagtcttcagctgctaagccgagatctgggaaggagtcagagagccttgggccagagttccaggggctctggggagtggctgccaggtgagttgaacagtctgattttcatggggtcccgcacagatgggacgcggcttaggaggaatcccgggctgtgggcattccttggcccagtggccagatttccagcacgtgtagcaagctcctgggggaggaggttctggaggaacgcctggctgctgcggttcaggcgtttggaagttcttgtgtgctggagatgtggctggggtttgtctcacagtggaggcaaggaattgccacttttttctattactgtccaccttgaaggtgaggttagttaagtcctgttatggggtttgagggccagattctaatttttggagttttatttaatgtcgggagcagattgggtaataaaatgtatattgagaataagacggccttttgaccttttagggtctagggctgtaaagcgtgtcagggttgctgccaaacgagccatgaactgggctggatttttatatttgatgaaaaagaacctaaacgctatctgatttgggataaagaaaaaggagcattaactttgactatgcctttagctccagccaccttttcaagagtaaattgctgggcaggtgggggagggccagtcacagaatgaactgtaagctggtccaggtgtgaggaggggaggtgataaaaggattatagggtggaggagcggaggctgaggaagaattggaacctagctcagcctggcgaggaggagaggtcagatgggtctgtagaaaaggaatattagaaagactcagcgacgcttggggttgcgactgaggggacaggtgggagggaaagaaggaagatttgggacgagttgcactgggcacagagactaggaagggactgatgtgtaaaagaatgcctggacatcaggcacctcagaccgtttgcccattttacgacaagaattatttagatcttgtaggatggaaaaactgaaagtgccgttttctggctatttggaactactgtcgagtttgtattggggtcaagtggaattgcagaagaaaataaggcatttatttaggttttaggtcaggtgtgagttgaagaggttttaagttcttaagaacacaggctaagggagaagaaaggaatggaaggtggaagcttgcccatagtgaaggaggtaagcccagagaaaagagtagagacacggagaaggggtggggggttcttgccctccagaaaagcagagaaggggttggggcacggaaataagggattggggcacagagatataagagattggggcgcagaaataagggatcggggcgcagagatacatggggttggggtacttacccctcccctagaaaagcagagaaggggtagagacacggagagaaggggttggtgtacttgcctctccgccagaaaagtgggacttgccgctaagggtgaaggaccaaggcaggcgtccctgcatggtctgacacctttgaaacgtgggtaaataatcaggcgtccctgcagtgattaaacaccaagggaaggctgccttcccagtctctgaccggcgccggagttttgagtccacagataaaatgtgtctcctttgtctctaccagaaaatgaaaggaattgaaattaagggagagattgaagtgtttcatgcgcgtccgtgtgaagagaccaccaaacaggctttgtgtgagcaacatggctgtttatttcacctgggtgcaggcgggctgagtccgaaaagagagtcagcaaagggtggtggattatcattagttcttatgggttttgggataggcggtgaagttaagagcaatgttttgtgggcaggagtggatctcacaaagtacattctcaagagtggggagaattacaaagaaccttcttaagggtgggggagattacaaagtacattgatcagttcgggtggggcagaaacaaatcacaatggtggaatgtcatcagctaaggctatttttacttcttttgtggatcttcatttacttcaggccatctggatgtatacgtgcaagtcataggggatgcgatggcttggcttgggctcagaggcctgacattcctgccttcttatgttaataagaaaaataaaatagtgttgaagtattggggcggtgaaaatttttggggggtggtatggagacagaatgggcgatgtttctcagggctgcttcaagcgggattaggggcggcgtgggaacctagagtgggagagattaagctgaagggaggtcttgtggtaaggggtgatattgtggggatgttagaagaaacatttgttgtatagaatgattggtgatggtctggatacagttttggatgaattgagaaactaaacagaagatccaaggtccaaataaaagaaggagaaaaatgggtattaaaggactaagaattgggaggacctaggacatccaattagagagtgcgtaagggggttcagcgtaattacttgcttggttggcaagtttttgggctctatgcttgagtttttttatgttgtcatacatcaggccagattgatttaggtaaaaacaacactcttcatttaagaatatgcagagtcctcttttttcaacagtgagtaagcaaggcctcggtggttttggaggacaactgcagctaaagagtcaacttgggcctggaggactgataaagtttgtgacatgtctgtgatgctagcagagaagtcattagacaggctacggaaggtcatgacagaggttgaaatgcctgctattccagtaccgagagcaatagtggaggcagaaagtcctaaaccgaccatcaagggaattagtggaatgactcttctttgttgtgtcggtgtcatgaggggaacagggagctcttcgttcctatttgcaaattgaattttgggagtaaggaagactagtgtgcatgtgcctgtccaattagcaggtagacacatgttaggtaaaggatccacagaggaagaagagaccttgtgcgaggcaaaactggagatgtaaagtaaaaagatgaggagtgctgcaaggggtgtcttgtacctagagtcctagggatccagctagggcggcagctgtcagaggttgtaatggggactgatggggtaactgcatagagggggaggttcgattttcatggtgtatgagaaaacgttgagtatctacaagcaacctttcactattattttcggggctgggtaaaagtaaacaagaggagggcctgggaggaagagtctgatgagcaaggggaaagtagccaaggatggagtgaaatacagggcaagtgtcttcctaagcaataattactgctaatgtttttaagtttgtcagtattgatagcgggcttgtctgtaatatggagctggaaggctcccattgtttgagtgatgtgtgtagttggactttggagatgaagagtaaaggaacatcgagaaggtgaaagattacctaggggaattccagtgggtctttgccgagagatacatataggagcggccacaggcatagtagtttgtgttgtgagaggtccgaatatggggggagaaaggagaaaggagaaaggttttttaaataagtgtgaaggagggcggcagcttgctgatgtgaaatgtctggggaagtcttgctggacctgtctagaaagtaaatgagttcttcaggagggtaaaggtgagggctgttacaggaagttcggaggtgtagggagatgggagatgttgcccagtctgtctgtaaggtggggacagctgtgtaggcactggaagaaagggaaatgcaaagccagcagttgttcactaaggagggattagaagcggctaggagagaatgggtaaggttgatagtgtggtggagatagctggggagaggtagagggtggcataagaatgggaatgagaataagagtgagtataaaagtaaagaatagaacttcatcagggtggaaatattggagggtgccttgccagcaaagatcatctatccactctaagagggagttaagagtggcagtttggggatagcaccaagagatatcagctgtgatggcttgaagaaacagtgtaaaccggccgtgtaaacaagagtagggcatttataagtagttgagaatggagaataggagtatgaccagacagaagatagtagggatgactagttttttggggctcggcctaagtggtgggggtgacttcgtaaagccctgttgcaaaaagtagggtaaggacgaaaaacctaatagaatgaagggatgtattaggctcataagggttatgactgttcttcgaaatacgactgagtttaagggaagtaggggagagtacttgcaacttccaggaggaagaggagggattaggctggctgtccgatggacacagctttattctggaacggtgagcctagtggggaggatcctgcaggcggacagcagtcggggtactatagatgactaagtagggtccggtccatcgaggttgtagagtttgaggagtcagattaacaagaactgatcgtccagctagggtgtcttcatatggctggggatctggagtaggcaagagaagcttagcagcctggcgaatttcctgtctagcctgctggaggactggaagacagtcgcctagagggctggtgtctgggatgaggttggggccaagcaagaaagtgcgtccatataaaagttcaaatggactgtacctaccctgtagcatctcgagaacaggctctaattctgagaagagcaagaagtaaaagtactgtccaatcctttttaagttggaggctgagcttggtgatgtgtacctttaaaagaccattagtccgttctacctttcctgaagattgaggactgtaagggatatgaaggttccactgaatactaagagcctgagaaactgcttgggtgatttgactagtaaaggctggtccgttatcagactgtatagaggtgggaaggctaaactgaggaattatgtctgacagaagggaagaaatgactgcggtggccttctcagaccctgtaggaaaggcctctacttatctagtgaaagtgtctacttagactaagaggtattttagttatctgactcggggcatgttgagtgaagctaatttgccagtcctgggtgggggcaaatcttcaagcttgatgtgtagggaagggaaggggcctgaataatccctgaggagtagtagaatagcagatggaacactgagaagttatttccttgaggatagatttccacgatggaaaggaaatgagaggttctaagaggcgggctagtggcttgtactatagcatagcctgcctttgctgctatgtggcgattaggcctggtggaaccgccatcaataaatcaagcgtgatcagggtgaggaacaggaaagaaggaaatatggggaaatggggtgaatgtcaggtggatcagagaaacacagtcatgggggtcaggtgtggtatcaggaataatgtgggaggccagattgaggtccgggccaggaacaatggtaattgtgggacttaacaaagagtgagtacagctgaaggagccggggagcagaaagtatatgcatcaggtatgaggaagaaaatggattttggaagttatgagaaatgtagagagtgagttgagcatagtttgtgatttttacggcctctaaaagtattaaagcagcggcagccgctgcacgcagacatgagggctaggctaaaacagtaaggtcaagttgtttggacagaaaggctacagggtgtggtcctggctgttgtgtaagaattctgaccgcactaaccatgcctaggaaggaagggagttgttgttttggaagggattgaggtttgggagattaatcagacaagatcaacaggcagagcacgtgtgtttttatgagaattatgccgagataggtaacagatgaggatgaaatttgagctttggagggggatacctgatatcctttggagagtaaatgctgaaggagcagaagtgtgtcttgttgagaagattcaaaggaggggctacaaagaagaaggtcatcaatatattaaataaggtgagaagcggaggggtggaaagaaagtagatcatgagaaagagcttggctgaagtaatgagggctgtccctgaaaccttgtggcagcacagcccaggtaagctgctgggactgatgggtgtcagggtcagtccaggtgaaagcaaagagaggctgggacaaggggtgcaggggaacgctgaaagaagcatctttaagatcaagtgtggaatagtgagttgtggaggaaggtattgaggatgaaagagtgtatgggttgggcaccacagggtggataggcaaaacaatttggttgataaggcgcagatcctgaactaatctgtaagacttgtccggtttctggacaggtaaaatggggggattataagaagagtttataggttttagaagcctatgctgtagcaggccagtgataacaggctttaatccttttaaagcgtgctgtgggatgggatattggcgttgagcggggtaagggtgattaggttttaatgggatggtaatgggcatgtgatcagttgtcagggaaggagtagaaatgtcccatatttgtgggttaaggtggggggatatgagaggaagacgcaaaggaggctttgggttggggagaagggcggcaatgagatgcggctgtagtccaggaatagtcagggaagcagataatttgcttaaaatatctcggcctaataagggaactgggcaggtggggataactaaaaatgagtgcttcaaagagtaatgtctaagttggcaccagagttggggagttttaagaggtttagaagcctggccgtccatacccacaacagttatggaggcaagggaaacaggcccttgaaaagaaggcaacatggagtgggtagtccccgtttcgattaaacagtgggtggacttaccctccactgtgagagttacccaaagcttggcgtccgtgatggtctgggggcttccaaggcgattgggcagcgtcaatcttcagccgctaagccaaggagtcagtcagagagccttgggccagagttctaggggctctgggagtggctgccaggtgagttgaacagtccgatttccagtggggtcccgcacagatgggacacggcttaggaggaatcctgggctgcaggcattccttggccctggtagtcagatttctggcacgtgtagcaagctcctgggggaggaggttctggaggaacgcctggccgctgcggttcaggcatttggaagttcttgtgtgctggagatgtggctggggtttgtctcacagtggaggcaaggaattgcaacttttttctattattgtacaccttgaaggtgaggttaattaagtcctgttgtggagtttgagggccagattctaatttttggagttttatttaatgtcgggagcagattgggtaataaaatgtatattgagaataagacggccttttgaccttttagggtctaggggctgaggaagaattggaacctagctcggcctggcgaggaggggagaggtcagatgggtctgtagaaaaggaagattagaaagactcagcaacgcttggggttgggactgaggggacaggcgggagggaaagaaggaagatttgggacgagttgcactgggcacagagactaggaagggactgatgtgtaaaagaatgcctggacatcaggcacctcagactgtttgcccattttacgacaagaattatttagatcttgcaggatggaaaaattgaaagtgccgttttctggctatttggaactactgtcgagtttgtattggggtcaagcggcattgcagaagaaaataaggcatttatttaggttttaggtcaggtatgagttgaagaggttttaagttcttgagaacacaggctaagggagaagaaggaggaatgtaggaaggttgcccatagtgaaggaggcaagcccagagaaaagagagcgtagagacatggagggaaggggtttgggggttcttaccctccagaaaagcgggaaaggggttggggcatggaaataagggattggggcacagagatacgagtttggggtacttgcctctcccccagaaaagcgggacttgccgctaagggtgaaggagaaggggttggggggttcttgcccctgccccagaaaatcagagaaggggtagagacacggaaagaaggggttggggtccttgccccttcctcagaaaagcgggacttgccgctaagggttatggaccaaggcaggtgtccctgcgtggtctgacacctctgaaacgtgggtgaatgatcagaggcgtccttgcaatgattaaacaccaagggaaggctgccttcccagtccgtgaccggcgccggttttttgggtccacagataaaacgtctcctttgtctctaccagaaaatgaaaggaattgaaattaagagaagggagagattgaagtgtggcgcctagattgaaaggagaaagacggtgagggatagggaggttggagaagagagtaaaaagaggctgcttattggatttgaaattggtgagatgtttcttgggctggtgggtctgaggacctgaggtcgtaggtggatctttctcatggagcaaagagcaggaggataggggattgatctcccaagggaggtctcccgatctgagtcacggcaccaaatttcatgcgcgtccatgtgaagagaccaccaaacaggctttgtgtgagcaacatggctgtttatttcacctgggtgcaggcgggctgagtccgaaaagagagtcggcaaagggtggtggattatcattagttcttatgggttttgggataggcggtgaagttaagagcaatgttttgcgggcaggggtggatctcacaaagtacatcctcaagagtggggagaatttcaaagaaccttcttaagggtgggggagattacaaagtacattgatcagttcgggtggggcagaaacaaatcacaatggtggaatgtcatcagttaaggctatttttacttcttttgtggatctttagttacttcaggccatctggatgtacacgtgtaagtcataggggatgcgatggcttggcttgggctcagaggcctgacagtaggtgttctagaaaggtgtgttgtgttaatgtgtgaatactgactcccctcctcagtcactgaggcggggagggtgtttggctcttttgaggcatgtgagagttggttgtgcctttggttttttgtttgtttttttttcttttgagtctcgctctgttgcccaggctgaagtacagtggtctgttcttggctcactgcaatctccgcctcccaggttcaagtgattctcctgccaagcagctgggattacaggtgcgcaccaccacacccagctaggttgtgcctttgttaggttctctgtgacttttacccactgtgccattcctgaaagaaatctttttttttttttttttaattagaagaattactggaactagcttggcactgttggacacagtctttgtctcagctactcgagaggctgaggcaggaggttcgctcgagcccagcctgggcaacatagcaagaccctatgtccgaaggaaaaaaaaggcaaaatcagaattaccagaactgatttcacatgtgtaggtagcagatggtggccatgcaattcaggtctgtctgaaggcccccaggcctggtacaaaactgtgtaaggccagtacaaggccctgacaggttcccaagtggctggactggaagagatgccaagttcatggcctcctaacctgactccacccagcactccctgggcccagcgacgttccctcctgaagcctgaaattcacctccacctgaggaggccatctgcctggggataggttcttgcaaaaatgaaaacactcatttccagaggcaattaattcttttaaaggatgtcagatttttggtacaaaatcatggtttccacgttggcttcatgctcggtgctttatgagaaaaatcccttttttctacggttgtgttcattgtattgtaaagcaatcgtagattattttaaggttttgagttagagtgattatccaattttatgagggaaataaaggaattccatgagaaaaacgggggctttcctgcagggctcggggttgcgggagcggcagataacctgattcattaacgtgagcccagtgggattggtgggggtgatggggacacagatgggagcactcaactcaggcacaggaccccagcagaacatgcccaggtcctcctagacatgggcccttgcagactttctgaggcctcggtttcgtcatcttaccaaggtgtgaccccaaccatcatctcctgaacttctggccacagagctgtgagcaagcttccatcatgaccccattttggagatggggagttggcgcagccacactgctgctcagtggtagaaccagcatctgacccaggccacctgttccagagaccctgcttttagccagcagctcagaccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaaaaaaaaaaaactgatggctgtgagaatactgtcactcgctgatgccttctgtgtagaaaaataagccttagacagatcttcgcaagaacatcgtgatggctctcataggcataattacgtgttccaagccaaattgcagttcaagagaaggttataaatctcttcttaataacaattgtactcacgttcctctcctggaaactaagaggaaggtagctgaagaaactctccctgcccagttaaatcttgttttttgggtacttttggactccagggtcacatcagcaatggcccgggacagacgagggggagccttcatctgtacttcgtgtctttccagggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgttt

SEQ ID NO: 36364 - DNA, 65813 bp, Homo sapiens
agaagcctgaggagccggagagggtgctggctgccgcgcggccgaggtgagtagggtgggaactcggaaaagcggttggctagcgggtgatgaagtcggctgcaggcctgacggcgatgggatgccctggaaacagtcagaacaggagctgaaggagctcggttcgggaacgcagggaggccggcgggatcctgggccggttgagtgtttgccccgcggccgggaggcagagactgcctcggctgagggcgcgtgggtcgggggctccggaggagctgagggaagtcggctgacttgccctgaaggctgagactcgcccacccgccaatctacccctacacctcctgccccctcccccgaccttcggtccatctttcggacccccggttcccgcgccggccgccaggcggcggtcctggggagaccgcccttcgcggcggctcccttgggtgctgcgcccttaacgggctcaggagccggactgcgcgggtgcaccgccagccggcctccgggaggagcagtgcgctggctgatccgccgggaagtttaaccagcttcctgtggttgctgtgtcgcttttcgcctcctagaacttcccagtgtatcttctgaccatgaccagggtttgcaggaaaccccaaagccggcctttgggcattaacaacagcagcattttattatggaaatcttcaaactgtggagaaattgaacgaaggatataaggaattcactgtactcattacccagtttcagtaattatcaatacgtgggcagtcttgctcccctaatccgggttattttgcgtttttgagacagggtctctgtcacccaggctggagtgcagtggcgggatctctacccactgcagcctccacctcctgggccccagcgatcctcacgcctcagcctccccactagctgggactacaggcaggcgccatcacgcccggctttcccccccccccccctttgtagagatggggtctccttatgttgctcaggctatctttgaactccttggcttaagcgatcctccctccttggcctcccaaagtgttgggattacaggcgggagtcatcgcacccggctatcctgggttattttgaagcaaatcccagacattatataatttcaattattttacatatttctatgcctctgtcatgatgaataatcatacatataataatttgctttctagaggggtcaagtaaaataagggacatattaaagtgtagacagtgctcatttagtttgtactaccagaatttaggtaactgctacagtgcagtttcattatcttgtgctcaggttttcaaaatcagagttaccagataatctagacagtagtgctcttgcttttgaatagtaataattgtattgataatttctatttgtcgagttcttagtatgtatgaaggactgtgaagttgtttccacctactcatttaatttttgcaataaccctatgaagtaggtattattatccccatgttagagttaggagaaagaaatttggagaggtcacaatttacctgaagtcacactgctgaaaggatgggggtgggggtagaattcagaatgctactcttggcctttgtcattgcaaagttcttgctcttttaactgtaacaatgtcctaggagttgtggaataaatggaactgctgtggaaaattatttctgttaagccacaaatcagtaatggaaaaaaaaaagcctgaaaatttacacaaatacaaacaatagtgagagaggtatgtttgttctttgaaaagttaaagattattacaactaaatttgatgtcctgagaaaacatagctcaacaaatacaagtgctaaaaattttattcttggccagatgcatggctcagccgagcactttgcaaaggccgaggcaagaggaccccttgagaccagcctgggcaatatagtgtgacactgtatttaaaaaataaaagtaaaataaacattttattctttaatatgtaaccagttagagagaaaaggaaaatatacatcaatgaatagcctctaccactcctttagcacatagcatatattggatattaatactaaatatttcatctatatccttcatcctcccaatcttaaactactaagacaacatcttcatccaaatagtgttagatgaataaggaatgagatagaaacagctgggcctcctctacttattcaaaggacagtagagaaggactattagcttggagtttaggaatcctactggataggagtaattcagaagtccagaagtcaggtcagaatcctttgtgaaggaacttgagtgccacttaaagagtttaaacttaatgagcaaagaagtgacatgatcaaagttatcttacaggaagatagatacaggaagatagctggtactgtcaaaggtggctttaccagtcatgtgaaaggattagcagttggttgacctgataaatataaaggaaatagacgtggggaactggcaaatttatggatatgaggaaaggaccagacagagaatacagcctgaaacagagaaaagagaatggtatatagtaggattttttttgtttttgtttctgttttttttgagatggagttttactcttgttgcccaggatgcagtgcagtggtgtgatctctgctcactgcaacctctgcctcctgggttcaagcgattctcctgcctcagcctcccatgtagctggattacaggcgtaggccaccacgcccagctaatttgtatttttagtagagacagagtttcaccatgttggccaggctggtcttgaactcctgacctcagttgatccaactgcctcagcctcctaaagtgctgggattataggtgtgagccaccatgtctggcctatagtacgttttgaagtgatgatagacttcattttccatgggtttgttttcttgggccatcctggtgatgagttggtgatgagtttttactgtatcactgttctttgaagtggtaattactgcccagctactgaactattcttttatatatttattagatactattgatagaaattacacaatttagataagcaacaaaaaaaaaaatgacactataatcctaccctttaaagataaccacttgatggggaaaaggtgataacagttttagttaacatttatttgattactgttggacatttttcacattttattttctgtttgtatttctacttgtaaaatgcctactgacgtactatgcctatttttccattgggcttttgatcatttgtttgtttgtttgtttgtttgtttgttttgagatggagtctcgctctgtcacccagactggagtgcagtggtgcgatcttggctcactgcaagctctgcctcccgggttcacgccattccattctcctgcctcagcctcctgagtagctgggactacaggcgcccgccactaagcccggctaattttttctattttttagtagagacggggtttcactgtgttagccagtatggtctcgatctcctgacctcgtgattcgcccacctcggcctcccaaagtgctgggattacaggcgtgagtcaccatgcctggcccatttgtttctttatttgcaagcactttatattcattagggatataaaccatttgttacattaagttgcaaataggtttctcaattacatggctcttctcaaaatcttcagagtggctagtaaaatgaaaaatatgtcagctgggagagcactcagggctgctgttttagggaccagaacattccacctctgaaacaattccttcatttatgatactgaagttattgtcaaccagtcaatctgcaagtcatttttaccaaataaattgttttgtgtaaatagttgatatcattaaaaaattttttttctgctccgactccaccgggagatatcatttaacgtataatttgtacaactggagttgactggtgtgagttggttgtggttaaaatgtaaacagtcagacaagttaaacaggaaagttaagtttccatgattgaaaaaacatacattgtaatgtacatataaatatatatataaagcagtataactaagatctttttaaacatttaagatttttttttagggacagagtctttctttgttgccaggttggagtgcagtgatgctatcatagctctaagatattttattaatttttttcacctccctcccttggttactttttgaaatggccgatttgatatatagtcggccttctggattcataggttctgtatccgcagatagaaaatatttgaaaaaacaatgataaaataacaatatgacaataagaaacaatacaaataaaacaatacagtagacaactgtttccattatattaggtattacaagtaatctacagatgacttcaagtatatgggaggatgtgtataggttatatggaaatactgtatcattttatatttctttttttttttgagatggagttttgctcttgtttcccaggctggagtgcaatggcacacacgatctcggctcactgcaacctccacctcccaggttcaagtgattctccagcttcagcctcccgagtagctgggattacaggaccccgccaccacgacctgctaattttttgtatttttaggagagacagcgtttcaccatgttggccaggctgtcttgaactcctgacctcaggtgatccaccgcctcagcctcccaaagtgctgggattacaggtgtgagccaccgcgcctggcccattttatctttatttttatttttgtgggtacataataggtatatgtatttatggggtacgtgagatattttaatacaggcatataatgtgtaataatcacatcagggtaaatggtaaatggggtatccacctcaagtatttatcctttctttgtgttacaaacaatccaattatacttttagttattttttaatgtacaataaattattgttggctatagtcatcctgtgatgctatcaaattctaggtcttattcattctaactgtatttttgtatgcattaaccatccctactccatctccccccacccccccacactgtcctttgcagcacctgataaccatccttttgggtttttttgttttgtttttgagatggagtctcgctctgtcaccaaggctgcagtgcagtggcgtgatctcggctcactgccacctctgcctcctgggttcaagcgattctcctgcctcagcctcccaagtagctggggttacaggcgcccaccaccacgcccggctgatttttgtatttttagtagagatggggtttcactacgttggccagactggtctcgaactcccgacctcaggtgatctgcctacctcagcctctcaaactgctgggattacagctgtgagccaccatgcccagcctaatttttgtatttttagtagagacagggctatgccatgttggccagactgctggtaaccatccttatactctttttttttttttttttttttgagacagagttttactctgcaacctccgcctcccaggttcaagcaattctctgcctcagcctcccgagtagctgggattacaggcgcccaccatcatgcccagctaattttttgtatttttagtagagacggggtttcaccattttggcccaggctgatgttgaactcctgaccttgtgatccaccttccttggcctcccaaagtgctgggattacaggtgtgagccaccgcgcctagccaaccatccttatactcttatctgcatgagttaagttgttttaatttttaggtcccgtaataagtgagaatatgtgaagtttgtctttttctgcctggcttatttcgcttaacataatatcctccagttccattcatgttattttcaaatgacaggatcccattctttttaatggctgaatagtactccgctatgtatatgtatcacattttctttatccatttgtctgttgatagacatttatttagttgcttccaaatcctggctgttgtgaatagctctgcaacaaacatggcacggcagatattgcttcaatatactgatttcctttcttttgggtctatacctaccagtgagattgacgagtcatatggtagctctatttctagttttttgaggaacctccaaaccgttctctatagtggttgagcaaatttacagtcccaccaacaggatatgaggatcccttttctccacatccttgccagcattcattcttggctgtcttttgaatataagccattttaactgggtgagatggtatgtcattgtagttttgatttgcatttctctgatgattggagcacttttttaatatacccgtttgccatttgtaagtcttcttttgagaaatgtccattcagatcttttgcccatttttgaattagattattcgatttctttcctattgaattgtttgagctacttatgtattctggttgttaatcccttgtcaggtgaatagtttgcaaattttttttccgttctgtgggttgtctcttcagtttattgattatttcatttgctatgcagaagctttttgacttgatgtgatctcatttgtcctttttttgctttgattgcctaataccccatgtggggtgctattcaagaaatcattgcccagaccaatgtcctggagagtttcccccagtgttttcttgcagtagtttcatagtttgaggtcttagatttaagtctttaatccattttgatttgatttttgtatatggcaagagatgggttgtagtttcattcttcggtatgtggatatccagttttcccagcaccatttattgaagagactgtcttttcccaatgtatgttcttggcacctttgttaaaaatgagtttactgtagacctatggattgatttctgggttctctactctgttccattggtctatgtgtctgtttttatgctacgaccatgttgtctcggttactatagccctgtagtataatttgaagtccagtttttttctttttgctcaggatagctttggctatcctgggtcttttgtggttccatataaattttaggattatgttttctatttctgtgaagaatgtcattgatattttgatagacattttgatagatatttcattgaatctgtagattgctttgggtggtatggaccttttaacaatattgacttttccagttcatgaacatggaatattttttccttgtgtgtgccccctttaatttttttttttttcagacaaggttttgctctatcatccaggccggagtgcagcggcatgatcacagctcatgggctcaggaggccctcctgcctcagcctcccatgtagttgggactacaggcacatgccaccatgcctggctaatttttttttgagacgaagtcccactctgtcgcccgggctggagtctggggtgcagtggtgctatctcagctcactccaacctctgcctcccaggttcaagcaactctcgtacctcaacctcccaagtagctgggattacaggtgtgcattaccacacccggcaaattttgtattttttagtacaaaaatataggctggtctcaaactcctggcctcaagtgatcctcctgcctctgcctccacctcccaaagtgctgggattacagctgtgagccatcatatctagcccttaattttttgtttttttgtagaggtgggtctccctatgttatccaggctggtctcaaactcctgagctcaagtgatcctcctgctttggcctcccaaggtgctgggattacaggcatgagccaccaccctgaccctcttaaattgcttttgagttttcattgtagatatctttcactttgatttcactttggttaattcctaggtatttaattttatttgtggctattgtaaatgggattaatttattgatttgtttttcagattgttcactgttggcatatagaaatgctactgagttttggatgttgactttgcatcatgtaactttactgaatttatcagttctaatagttttttggtagagtctttaggtttttccaaatacaagattacatcatctgtaaacaaggataatttgacttcttcctttcctatttggatgtcctttatttctttctcttgcctgattgctctagctaggactttttactatgccattttatataaggcacttgagcatctgtagattttggtgtccatgggattcctggaaccaatcccctgtggatactgaaggacaagtgtataatgtgtacaggcaggagggtaaactgctttcctaaagagatgattttaggtggaacaagaatcaactttgtatttattttagtcaagatatccttttctgtctgttttggctcagatagggagtacaatgtatagttaagtactttaaagtatatcctggaacaaactttgattgcatcagtattattgcttggcatgaggctaagtttatttaatttttaaaaaatgagtttatttaagatcgagcacagtggcacacgcctgtaatcccagcactttgggaggccgaggtgggtggatcacctcgatcaccaggcagttcgagaccagcctgaccagtgtggtgaaactccgtctctacaaaaaatacaaaaattagctgggcgtggtggtctgcacctgtaatcccagcttctcgggaggctgaggcccaagaatcgcttgaccccgggaggtggaggttgcagttagctgttatcgtgccactgcactccagcctgggcaacagagcaaggctctgtctcaaaaaataaaaataagaaagaaagaaaaaaacagttaatttaaattaaaacattaagagcatccagatatgacaaaactcataaaccaagtatgaaggtttgaagttgagaaatactagtatagcctgtaagggttcccaaagtttatatattgctaatgtttattatttacttagatggtccaaattagaataatttttatgtttttactttttagatttcagttatttaatttagaaaatgttactagtctttaaaaattacaaaagtaggctgggtatggtggctcatgcctgtaatcccagcaatttgggaggctaaggtgggagaatcacttgaagccaggagtttgagaccagcctgggcaacatagtgagaccccatctctacaaaaaagtataaagttagctggatgtgatgatatgcctatagtcctagctacttgggaggctgaagcaggaggatcacttgagcccgggagcttagggctgcagtgagctctgatggtgccattgcactccagcctgggtgacagagtgagactttgtctctcaaaaaaaaaaaaaaaaaaggaaaatcacaaaagtagtacatgtatcctattggggggaaagaaaacatacaaacaatacaggagtgcataagtgtataataaaagtggagggtctcaccaccaagccctcagatatagtaagtgttaagttttggtaagttttcagatctttcctctatttcaccactgtttctgttactttattgttttttagttatttttaatggaattaatatgtatttgtaacttttttcattcagcattttattatgaaaattgtttcatgtatggctctatcttttttgttttaatggctgtaaacttagaatgggcatatttaatttattgaattaattttaaccatttccctattgatggtcatttagattacctttggattttctctttcacagtaatgtttcagtgaatacccttgccagctttcaaaaactaaacatctttctccttggagaaaggtataatttactgagttcttccattaaagcaatttttttgtgtgttgtgttgtgtttgagacagtttcactctgttacccagagtggagtacagtggcgcactgatagctcattgtaacctcaaattcctgggctcaagcgatccttctgcctcagcctcctgagtagctaggactacaggtgcataccactgtgcctagctaatttttaaattttttgtagagatggggtcttgttatgttgcccagggtggtcttgaactactggctcaaatagttctcctgcctcagcctcccaaaatgctgagattccaggtgtgagccaccgtgcctggcctggcaattttttatacacataatatgcaggggacagtaactattacacaacttatcaacatcaactttatagtgatttttcatcacttccttgggcctaagggcaacatttttagtcattgttgactgccaagtactttatttgcttctactgatgtccagcccaggatcacttaagatatttgaatagtgttttcaaaagattattttaaaatttatgcctcagtacttaattcatctgcatgtggctgcttaaaatattctgtgtcaatcactgtggggttatatttcagagattctcacatgaaaatgtcagcctttagttcaaatatgaatatgatctctgtctctaacttcttttaaatcataaagataacatctaaaaatgtccttcagaagtttaattttatatctaaattgcattagcttgaaagaatttgcgccaagtttgattagcctgtgttcatggacctcttatcttactagtttttgtttttgttgagagatgtggtagtataggtcatgagatttattcccttgtggactgaaaaaatgacatatgtccgatcctgtgctggtactgggagtagcagtgtacttaattttgcatgagccatatggaatattaattcaaaattactaccagtaaattgtacccacagattgaatactatattttgttttatagtatggtaaagtgttttgacttaagtatcaactggactgatgtgaaggatagcagtggtccctggacttgaatttcaaagtttaattttcaaaaggtagtatagggtcaaggtgcagtggctaaaggctgtaatcccagcactttgggaggctgaggtaggtagataacctgaggtcaggagtttgagaccagcctggccaacattgtgaaaccctgtctttactaaaaatacaaaattagctgggcatggtggtgcgcacctgtaatcctggctacttgggaagctgaggcatgagaatcacttaaacccaggaggcagaagttgcagcgagctgagatcacgccattgcactgggtgacagagcaagactctgtcttaaaaaaaaaaatatatatatatatataccatatatatatatatggtagtgggttgatgtagggttgacaactaaacattgtgacaaggacatttaaaaaaaaattatagccaggcatggtggtgcatgcctgcaatcccagctactcaggaggctgaggcaggagaatcgcttgaacccaggaggcagaggttgcagtgagccgagatcacatcatttttctccagcccgggcaacaagagtgaaactctgtctcaaaaaaacaaaacaaaacaaaaacaaacaacattcatctactgtccctgtatcataaaaggaaagtagcgtttacaccataagcataggaaggacatagtctcaaaataaaggacattaactttattctttaatttttattttttatttttgttagagccagggtcttgctctgttgtccaggcttgtgtataatggtgcactcatagctcactgtaatctcaaactcctgagttcaagagatctttatgcctcagcctcctgagtcagtaggactacaggcatgtaccaccatgcctggctaatttttttttttttttttttgagatggagtctttctctgttgcccaggctggagtgcaatggcgcgatcttggctcactgcaacccccgcctaccagattcaagcgattctcacgcctcagcctcccaagtagctggaattacaggcacccaccatcatgcctggctaatttttgtatttttgtagagacgaggtttcaccatgttggccaggctggtctcaaactcctgacctcaggtgatccgcctgcctcagcctcccaaagttctgggattacaactataagccaccatgcccggctgcctggctaatttttaaaaaatttctgtggagaaggggtttcagtatgttgcccaggctgctcttgaactgcaggcctcaagtgattctcctgcctcagcttcccacagtgctgagattatagatgtgagccaccacacctgcaggacagtaactttcaactgaatacttttttgttcttttttttagttcataatcctcatttatttatttacttatttttttttttttcagacggagtctcactcttattgcccaggctggagtgcagtggagcaatctctgttcactgtaacatccgcctcctgagttcaagtgattctcctgcctcagcctcccaagtagctaggattacaggcatgcaccaccacacccagctaattttgtattttccgtagagatggagtttcaccatgttggccgggctggtctcgaattcctgaccccatgtgatccacccaccttggcctcccaaagtgctgggattacaggcataagcaactgcgcccagtctatttatttgttttaaacaagattttatttttagagcagtttttgtttttgttgttgttttggtgaggaaaaaccatattcacaccatagcagggttcaaactaaatcacttatatggtctgggcacagtggctcatgccaatgttttgggaggctgaggcaggagtattgcctgagctcaggagtttgaggctagcctgggcaatgtagtgagaccccgtctctaaaaaaaatttaaaaaaatagccaggcatggtagtgcatgcctgtagtcccagctactcaggtggctaaggcaggagaatcactcgagccccaggagtttgaggctgtggtgagcaatgatcatgccactgcactccagcctgggtgacagaagagtgagactgtctctaaaaaaaaaaaaaaagcactaattgggtaatgattgtcttcctctgagtggtagagagaacaataacttcacgttccttttttaatttaacacataataattgtacatatttatggatacattatgatgttgcaatacatataatgtgtagtactcagatcatagtagttagcatatccatcatctcaaacatttatcatttctttgtgttggcaacattcagtatcatagtccttatttttattttccatcatttggccttaaaatgtggactgtcatctgtgttgccttatctgttagcattctgagaatagtaaacattattccagtgattcataaggaacctagaaaacaaaatgccagccacataactaagaatattctattaatcttcttattttccccaactctaaaatgagtcattcccatctttcataatgaaaatatagttaaatggccatttccttgaatagttctcaaaaaccttctaaaaataagccccaccatgctgttataactttgtaaatttttggcatcttaaatgtagtgacaacattgtcattgttgctaacagagttattatgaaactactgctgataactttttattataactatctcaaaaacagatattacattagttgaagacagtattattttgtattattttcaatttgactgctataaattttagtcgagctacatactattatatattttcacagtgttggtagaagaaaaagaaagtctatttccaatatttatctgggtttctcttctaccagctgccaaccaaaattaatttgctatttcttatactctatgctagagtagagtagatagtctagaatataagcctataccatcttcataacacttgtaggaattgaatacacacacatgtgtgcatgcacatatacacacacacacattttcattgattcataaggaacctagaaaacaaaatgccacctgattcttagcaatttttttaaaaaccttatttattttgaagtgtaacacagaagaaagtacagacataaatacagctcaataaattgccacaaagcaaatatccatgtaatgaccacccaggttaagaaatagaatgttgtctgcactctggggtagttttgcttttgagcaagagcttctaaaagagcttagaaaaataggtgacaggaaacagcactgatgtaaagtgtaagagaataagcaagcagaaaccctttgagaaggcagtagctgtaggagaagcagtattctaaagggaagccaagtttcatcacggggagggaagtaagccaggggagttcagtagtgagtgaatctgttgaagataagatacagagttgggggatgtttatagacaaacaagtaccagagagcactgtgaagaagtttggaggaaggggtagcagcaggagtccaccgtctatgtcacctcccttctgtgtttaacaaggaccattacctttctcaaaattttcctttttggtgataataccactcttatttttctactactattttgatctttttttggttagtgtctgttggatataaaaatgctctaggaataaattctcggtgctacaaagtgaaaccagcactcaggcaaaagttttctcagcaaggcaatttactgctgcagaagggtgccacttgcatcaatcaagatcacaaaagatcacaatcaagatcactgaacaaaggagaggtttttttttttttttttcaatccctgacacgtagtctttgcctctgtgtcactcccccataggctggggtcggaccacgcaatctgagctgacctgattggctacttgcaaatatttttctaaatatggaagagaagggggacgtgaggtacagtggtgagatgtgcagtttcggggtaacaatattgcaggtaaccaagggaacagatgtgagttattgattagatctgacaggaagcgggtaggctgtttacagtaactaggggcaaggagacatgtagaaagagaaagttgagtttgagaacaaaggacaaggaagttaacaggctaaacctttgaagataaactgattcattgtatcttacagtgtcttttatttttttctgtttgttctaaaagtattaatatttcctgagctttctgtccagtcttcccttcttactctatatgatttaactcatttcatctgttttttctagccagtgctctgtattctttatctctagccgacacttaagaaacatcttttcctggcaaataaggatgatttttcaaataataatttaaaaaaaccatctgtgggccgggcatcgtggctcacgcctgtaatcccagcacttcgggaggctgaggctggtggatcacctgaggtcgggaattcaagaccagcctgaccaacatggccaaaccctgtctctactaaaaatacaaaaaattagccaggcatggtggtacatgcctgtaatcccagctacttgggaggctgaggcaggagcatctcttgaacctgggaggtggaggttgtggtgagccaagatcatgccattgtactccagcctgggcaacaggagtgaaactctgtctcaaaaaaaaaaaaaaaaaagacaaaaaaaaaacccatctgtggtggttaattttatatatcaactggactggtctgagggatgctcagatagctggtaaaacatcactactgctgtgtatttgtgagggtgtttctggaagagattagcatttgagtatatagactgaataaaggcatcacaaatcccttgagggcctgaataaaataaaagacaaagagagagcaaatttgtactcagcttgagcttggatatccctcaggccctccctcaggccttctcatcagactgagatttaacactattagctctgtcggcctccagcttgcacacggcagactgtgggactttctagcctccataattgcatgagccaatccctcataataaatctgtttctatgtatctatattttgttggttctctctggagaaccctgactaaatacactgtttaagaaaggagtaaaacttgcactgagatgtttagagcagctttattcatagtttatcaaaatgtggaagcaatcaaggtgttctccagtaggggaaggaataaataaactgtggtatctccgtaaaatggaatgttattccacactaaaaagaaatgagctatcaaccatgagaatacatggaggaaccttaaatgcatattactaggcaaagaagccattctgaaaaggctatatactgtgtgattccaacttcatgacattctggaaaaggcaaaactatggagacaataaaaggatcagagatgccaggggttgggaaggagggtaaattaataggtggaacacaggatttttagagcagtgaaactattctgtatgatataacaatggtggatacatatcattattcatttgccttaacccacacaatgtacagtaatgaaagtgtactgttaggtaaactgtggactttagatgatgatgtgtcactgtaggttcatccattggaataaatgcaccactcttgtgtgggatattgatagtgggaagactgcccaattaagaaatctgtactttctactcaattttgctgtacatttaaactgctctaaaaaataaactctgttttagcctgtaaccccagcactttgggaggctgagggggtgtatcacttaaggccaggagttcctgaccagactggccaacatggtgaaaccttgtctctactaaaaatacaaaaattagccgggtgctgtggtgcatgcctgtaataccagctatttaagaggcatgagaatcgcttgaacctgggacgggggttgcagtgagccaagatcctggcactgcacttcagcctgggtgacagagcgagactctgtctcaaaaataaatacataaatacataaataaactctgtttttaaaaatgagcaaaaggccaggcacggtggctcacacttgtaatcctagcactttgggaagccgaggcgggaggatcacttgaggtcaggagttcaagaccagcctggccaacatggcaaaaccccatctttactaaaaatatcaaaattagccaggcatggtggcatatgcctgcagtcccagctacttgggaggctgaggtgggagaatcgcttgaactcgagaggtggagaatgcaatgagctgagatcacaccactgtactccagcctgggcaacagagcaagagtccgtctcaaaacaaacaaacaaacaaaaagagcaaaagccctctccctctccctctctctctccctctctctctccctctctctccctctctctctccctctctctctccctctctttccacagtctccctctccctctctttccacagtctccctctccctctctttccacggtctccctctgatgccgagcggaagctggactgtactgctgccatctcggctcactgcaacctccctgcctgattctcctgcctcagcctgccgagtgcctgcgattgcaggcgcgcgccgccacgcctgattggttttcgtatttttttggtggagacgggatttcgctgtgttggccgggctggtctccagctcctaaccgcgagtgatccgccagcctcggcctcccgaggtgccgggatggcagacggagtcgcgttcactcagtgctcaatggtgcccaggctggagtgcagtggcgtgatctgggctcgatacaacctccacctcccagctgcctgccttggccccccaaagtgcggagattgcagcctctgcccggccgccaccccgtctgggaagtgaggagcgtctctgcctggccgcccatcgtctgggatgtgaggagcctctctgcctggctgcccagtctgggatgtgaggagcgtctctgcccggccgccccatctgagaagtgaggagaccctctgcctggcaaccgccccgtctgagaagtgaggagcccctccgcccggcagccacaccgtctgagaagtgaggagcccctccgcccggcagccaccccgtctgggaagtgaggagcgtctccgcccagcagccaccccgtccgggagggaggtgggggtcagccccccgcccggccatccacctcgtccggaagggaggtgggggggttaggccccagcccggccagccgccccgtcctggagggaggtgggggggtcagccccccgcctggccagccaccccgtccgggagatgaggggcgcctctgcccggccgcccctactgggaagggaggagcccctctgcccggccaccaccctgtctgggaggtgtactcaacagctcattgagaacgggccatgatgacaatggcggttttgtggaatagaaaggggggaaaggtggggaaaagattgagatatcggatggttgccgtgtctgtgtagaaagaggtagacatgggagacttttcattttgttctatactaagaaaaattcttctgccttgggatcctgttgatctgtgaccttacccccaaccctgtgctctctgaaacatatgctgtgtccactcagggttgaatggattaagggtggtgcaagatgtgctttgttaaacagatgcttgaaggcagcatgctcgttaagagtcatcaccactctctaatctcaagtacccagggacacaaacactgtggaaggccgcagggtcctctgcctaggaaaaccagagacctttgttcacttgtttatctgctgaccttccctccactattgtcctgtgaccctgccaaatccccctctgcgagaaacacccaagaatgatcaatttaaaaaaaaaaaaaaaaaagagcaaaagacttaaacagatacttcacaaaataagatctcaaaatacccccaaaatgtgaagaaaaccctagaattgctaaaataaaaaagtactaacaataccaattattactgacaaagatgtagagtacctggagctctcttaattacttgtgggagtgtaattggtccaattaccttgggaaatgttaggcagtttctttccccctccccttccccttcccctcccctcccttcccttctcttcttccttcttttttttaatttcttttcttttttttttttttttttttgagacggagcctcactctgtcacccaggctggagtgcagtggcgccacctcggctcactgcaacaacctccgcctcctgggctcagacgattctcctggaatagctgggattgcagacaggcaccaccacacctggttaatttttgtatttttagtagagacggggtttcgccatgttggccaggctggtctcgaactcctgacctgaagtgatcctcccacctcagctttccaaagtgtcaggattacaggcgtgagccattgcacccggccatgttaggcagtttctattaaaactatatatatcctatgatctaacagttttatacctgggtactcaagcgaatgctcaagagaaatgagcatttacgtgtaccttgctatctttgtgtaagaattatcttagcacttttatttgtaatagctaaaaacagacagatgagtacatgaattgtgttacaataatataatgaaatactttacagcaatgaaaaagaactgtaatttgtaaacaacatgaatgaatctcaccgtgttgaattatagaagtcagaaggcacaactaatatatggttgcaaatgttagaatagtggtggttagacaggcaaggcatggatattgactcagttcttaaactgttttctgtctagatctaggtggtggttacaaaggtatatacatatataaaaatttgctggacacttatgtgtatatttttctgtgtaggttatacctcaatttaaataaaaatgataggttttcctttgttttttttttttttttttctccatctcccaggctggagtacagtggcacaacctcagcccattgcaacttttgcctcccgcgttcaagctattctcctgcctcagcctcccaggtagctgggattacaggcacacactaccatacccggctattttttgtggagatgggattttgctatgttggccaggctagtcttgaactcctaaccttaggtgatctgcccaccttggcttccaaaagtgctgggattacaggcgtgagccaccgtgccccagccaaagaaatatttgacattttagtttttcatgcttttaaaaaaaaatttttttttttttttttttttagacagagtcttgctctgtcaccaggccagagtacagtggcatgatctcggctcactgcaacctctgcctcccgggttcaagccattctcctgcctcagcctcccaagtagctgggactacagacacgtgccaccatgcccagctaatttttgtatttttagtagagacggggtttcaccatgttagccagtttggtctcgatctcttgacctcataatccgcccacctcagcctcccaaagtgctgggattacaggtatgagccaccatgcctgggctttaatgataggttttcaaactccacataaaaccatcctttctccttgcctgtttttttgccagttatttccagctttgacatcatttttggttctttgctctttttattcaccattggctctcagaggattcatttataaaactgataatagatcctggtaacattaagatatatctgcctgattaaagatatagtcacagaccttttttagtaatcaataaatatatattcctgccagtgcttagcactctaccacatagtttcatctagatacacttctgtcatcttagactcaccttcattaaagagttttactctccagcatttccttatatgatagtcataatttctctcatctccaatcaaaaccttggagtaatttgatttttctcttcttccttatcgcgctagccagccactttatgtttgttgttgttgttttaaaaagagatggggtctcgctttgttgactcttaactcctgagctcaagggaccctcctccctcagcttcctgagtaactgggacttcaggcatgcaacgtcacacccagctttaccagctactttaccaactttggttaattcttttattggcatattgaatccatctattcttttccattcctgttagcattaacctacttttttaggattttttactaaaatggctttatgcattaatctctattaattcttacaactctgtgagtactgttcctatctagagataacttgttaatacttaccatttagtaggtagcacaacaagggtacaaactcaagtccagagccttcatacttcaatattttatgtcattagctttagaatataaacgtgttgaaagttgagtgtaatcacaatatgaaaatattaaaatagaaaacacccagctgggcacagtgcctcaggcctgtaatcccagcactttgggaggccaaggtgggtggatcacctgaggtcaggtgtttgagaccagcctggccaacatggtgaaaccccatctctactaaaaatacaataattagctgggtgtggtggcgcatgcctgtaatcccagctctcaggaggctgaggcacgagaatcacttgaacctgggatgcagaggttgcagtgagctgagatcgcgccactgcagtccagcctgggcgatggagtgagactttgtctcaaaacaaaaacaaaaacaaaacgctcaaaatttcgaataggtttttcaaactactccctttttgtttagttacatggtgtagtggataaaagcacagacttacagaaacatctagtttgagtcctaactttgccacttataaacatgtgacccttactcaagttatactaactatgctttagtttgcccctctacaaatagaagataatttgatatctaccttaataagatggtttgtgataattgagactttatatgtaatgacttaataagcataaaaatgttcctgataatcccgggtacataacaaatgttctgtgaagttagctcgttattaatataatttagtggtgtttggacattttagctaagggctcttgtttggaacaccaataaataaaggagactaaaagcattatttcactaattcaaatatatatcaaaagttcttttacactccctggcaccataatccctcccattcactctgtgccccacttcccatacccagatacacatactgtatatctgatagaattatacttataaaggtaagtgaaaaacatattagaaaattagaattttccggccagacgcggtggctcacaccttaatcccagcactttgggaggctgaggtggtggatcgcctgaggtgaggtcaggagattaaaaccagcctgaccaacatggtgaaaccctgtctctactaaaatacaaaattacccggacatggtggtgcatgcctgtactcccagccacttgggaagctgaggcaggagaagtgcttgaacccgtgaggcaaaggttgcagtgagccaagattgcaccattgtactccagcctgggtgacaagagtgaaactccgtctcaaaaaaaaaaaaggaaagttagaactttccatcatgttaaaattttctatagagccaaatgtgtatactgtttttttttttacagcttttcaaaggattaaaaaataatacttaatttaaactttggtgaattcagcaaactttcttcttttttcttttcttttttttgagatgtagttatgctcttgtcacccaggctggagttcagtggcgtgatctcagctcactgcaacctctgcattccgggttcaagcgattttcctgcctcagcctcccaagtagctgggattacaggtgtatgctaccatgcccagctaatttttgtatttttagtagagatggggtttcaccatgttggccaggctggtcttgaactcctgacttcaggcaatcttcctgccttggcctccagagtgttggaattacaggtgtgagccaccacacctggccaaattcagcaaactttctaaaacaactattctaccatattgagtcaaactcttctacctaggttcaaggtttgtctaataggatttatgtttctttttccctttttcccaatataagcttttagctcagattctcatatgaactcacaccctgttatacttcatcctgttttcccccactgctgttcatttttacccatgatgctcatcctcctttcattagcgcccagctcttttcagtttattttcacccagcacttggcatatttgtggcacctttactttttcttcctattctctgttgttatctataaagctcttctcacaacgtagaccacaaactgtttctggtcatgatgagataaagggcttacatcactatgtaaatcaactatggcatacagcatactgtttggtttagctgactttttgagcaagattttcttttttttttttttctttttttttttgagagggagtcttgctctgtcacccaggctagagtgtagtggcgtgatctcagctcactgcaacccccacctcccgggatcaagtgattttcctgcctcagcctcctgagtagctgggattacaggcgtgctccaccacacccagctaatttttttttttttttgtacttttaatagagatgggattttactatgttggccaggttggtctcaaactcctgacctcaagtgatccgcccgcctcagccccccaaaatgctgggattacagacatgagccaccgcacccagcctttaaggaagattttcttttttttgtttttcttttttctttttttttttttttttaagacggagtcactctgttgcccaggtttgagtgcagtggcgctatttgcatcctccgcctactggcttcaagcgattctcctgccccagcctcccaagtagctgggattacaggttcctgctaccacgcccagctaacttttgtatttttattagagttggagtttcatcatgttggccaggctggtctcaaactcctgacctcaagcaatccgcctcccttggcatcccaaagtgctgggattacagatgtgaaccaccacgcccggccttaagcaagtttttattgatgagagagcagtgtattgattcatgttctggtgcaaactcctttatcttgttagagaccaacacttccagtaaactcgtctataccatacaagttaacattgtaattctgtcagatatacagtagattgatggggagtggggcagagaatgaatggcaggggttatggtgctagtgaatattaaaagactttattcattggttttggcctttcagcatctgaatttctgttctgtatttctggaattcattcctttatgatttttggtgggaagcttaacctgcttgttacaatagccaggtacttgctttgtcagcctcccttttgctacgacacgtgagctgtggacttggtctagcaaatggaccagtacagacagcatctttggagttggggacatggaaaaggaggaactgcgtggaccctgtctgtggtggtagtagcaaatgcagtggtgttttcccagggccaagtctgctgcagttttgaacgtccttggttgtgtagcctataaattagtttctctgaagattattatccaccagatatcttttcataaatgtattttttacttaaattagccatactaggtttttgttgcttccagctaagaatactgactgaaaaaaatacaaaagaaaacaaaacaccttatactgttacagttactttaagcaagctgatcacaagcaaatcttgttttctcttaaattacacatgaaggtttttttttttttgagacagagtctcgctctgtcacccaggctggagtacaatggcgcgatcttggctcaccgcaacctccgcctcctgggttcaagcgattctcctgcctcggcctcctgagtagctgggattacaggcatgcaccgccacgcccggctaattttgtatttttagtagagatggggtttctccatgttggtcaggctgcacatgaagttttaaaaatgttttaggcttgctctgtgagacatgtagacagtacaaattctaaataataatgatttcattttagtatttgcattttaaattttcagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtgagtgctcaaaattcattttttaaatcccgacatttagatattttaagaattttttctgagaaaatgaaataaatctatatatgaccaacatcttgaattcaatatgtttatgtactgtttaatttgctttctatttaaatcatagaagtgaatcttttctcagcatctgaagtaaggaagtaactttctgggttacattgaaaacttaccagtattcatgtgaccattaagagcaatatatttgttattagtgaggaaaaggcttaaataagcagaaaaatcattgcataaaatatgcttggccaacacttgacagcgctcttaatgttgtagaatcattaacattgaatgctgttataatgtgtttaaacaacacagttgtttaaaaggtaagttatgtctcttaaaaataacaactattgataagaagaaaaaaaagttactataatgattgttctatgctagagatattagtttttaccttgacattttttataagtattttctactgatatataaagtttgtttagacctataaattattagagcaagtattgtgccaagtacattttgtagaatattttgttttacattttgaaattcattttttttcatggctatgacatagaattaaattttatttattgaagatacaggcaggttacataatttgaatgtgggtatacttttttttttttttgaacagggagtcttgctgtattgcccaggctggagtacagtggagcaatctcggctcactgcaacctctgcctcccaggttcaaacaattctcctgcctcagctccccgagtagctgggattacaggctcacaccaccacggccagctaatttttgtattttttagtagagatggggttccactatgttggccaggctggtcttgaacccctgactgcccaccctggcctcccagagtgctgggattatagacgtggaccactgtgcctggcagaatatgggtatactttttagtgcacttttacttttttgtttttgtgcctgaactttgaatctccccaacttccaaggttacatctgttttcttcggagattaaaaagtagagaaccaaataaaattatctttgtttatagctgcataattttgagattattagcttgaggataagcaataggaaaatgacttgtaaatttattggtattttcatatctttcagatatatgttgctatgttttaaatttcacttagtggccagtcgcagtgctcaggcctgtaatcccagcactttgggagacagaggcaggaggatggctggagcctaggaattcgagaccatcctgggcaatatagtgagaccctatctctacaaaaaatttaaaaaatttagctgggcatggtgacacgtacctctagtcccagctattcgggaggctgaggtgggaggattgcttgagcctgacaggcagaggttgcagtaagctgagattgtgccactgtactccagcctgagcaatagaatagagcaagaccctatctttaaaaaaaaaaaaaaaaaaaagaacttcacttagctcagttttatcatagtgtggattgacattttagtaatgacagcaaaagtttctttttctcttgcttgcacaaggaagggaagtttttgttatttatgatttccaaaaaccaaagctttataatttctatttattgtaattttagtaagaagtatagtttaatggtaagattgtgggtcctggatttaaacacacttgaatctgaaatttgtctctgtcagttattgccttcgtctgcaaagtagctgtaagaattgctactgctataagaattgttacctgtggattaaatgacagagtatgtaaagcatctagcacagtggcttgtacagtgtagatacattcaataatagtttcttagatttttgctgttaccagcctcccaccccaagacaggtcaatatgagtagtgctaattgaggccaaagtgcagaattctgtttcaggcacagatagcacgctttatttagcttgttcactttaagctggaaagtgggtgccgttcatcaaagaatggaccagctaaaggaggattaacttgctcaaaatattgtaattacaactgagagtccttcctactaatggtggattagcaagatctatttttaacttattgaagctagcatataatcgtaaactttaatcagttagctgaaaattcatataaaaccaaattttcttctaacataaagcaatgtgatcttttggggttaactaatttccagtattttttagcttgttgcctaagaataaaaatacaaaggaatctttcaagattttatatttgggcaccagaaaataaaagaagctttcttagctctacctttcagtgattaacatgtattttcccattgatctgatatatacaggcatagcttggagatactatgaatttcatttcagatcaccacaataaagtgatagtgaaatacagtgaatcactttttttttttctttgagacagtctcactctgttgcccaggctggagtacagtggcgcagtcttggctcattgtaacctctgccttctgggttcaggtgattctcctgcctcagcctcccaagtagctgagattacaggtgtgtgccatcacaccaggctaattttttaatatttttagtagagatggggtttcaccatgttagcacttgatgcttcttcatcttgcacttttatgttatagagatggcttttttccttatgcctcattaaccaacttctgctagcttcaacttttcttttgtagcttccttgcttctctcagccttcacagaattgaagagaattagaaccttgctctggattaggctttggcttaagggaatgttgtggctggtttgatatttattttctctatgtcagaaataaggccttcttgctttcttatcattcatgtgttcactgtagtagcactttaaatttccttcaagaacttttcctttgcattcacaacttggctaactatttgggccagagacctagttttcagcctgtctggactttgaacatgccttcttcactaagcttaatactttctaacttttgatttaaagtgagagacatgcagtgcttcttttcacttgaacacttggagatcattgtagcgttaaactggcctaattccagtgttgttttgactcagaatagggaggtctgagattgcggaatagctggtgggtggaacagtcaaaaaacacataacatttatcgattaagtttgccatcttacatgtgcttggttcatggcaccccaaaacaattaaagtagtaacaaataacgtcaaagatcaccactgatcatgatcaccataatagatataataagaatgcataagtcagggcctggcctgtagaggggtggggggcaagggaagggggagcattaggacaatgcatgcgttgtcctgatgcatgtggggcttaaaacctggatgacgggttgatgggtgcagcaaaccaccatggcacatgtatacctatttaacaaacctgcacgttctgcacatgtatcccagaacttaaagtataattaaaaaaaaaaaaaataggccaggcatcgtggctcacacctgtaatcccagcactttgggaggccgaggcgggtggatcacaaggtcaggagttcaagaccagcctggccaatatggtgaaaccccatctctactaaaaatacaaaaatcaaccaggcatgatggtgggtgcctgcctgtagtcccagctactcaggaggctgaggcaggagaatcgcttgaacccaggaggcggagtttgcagtgagccgagattgtgccactgcactccagcctgggcaacagagcaagaccccgtctcaaaaaaaaaatagtaatgcataagtttgaaatattgtgtgaatcatcaaaacatgacacagacatgaagtgagcacatgctgttggagaaatggcgtcagtagacttggcttgacacaaggttgccacaaaccttaaatttgtaaaaagaacaatatctctgaattgcaggaaagtgaaatgcattcccagctaattttgtatctttagtagggatggggtttcaccatgttggccaggctggtcttgaacgcctgacctcaggtgatccacccacgttggcctcccaaagttctgggattacaggcgtgagccactgcgtccgtccttttaaatgaatttgatactgtgctttaaagcattccaagagtgaaaactaccttcatcctttattttatcttttttttttttttttaaagaaaaaaaggctggcacggtggttcatgcctgtaatcccagcactttgggaggctaaggtgggaggatcactggagttcaggagtttgaagccagcctggataatacagtgagacacgatctctacaaaaattacaaaaattagccgggcatggtggtgtatgcctgtagtcccagctacttggtaggctgaggtgggaggatcacttgaccctgggaggcagagattgcagtcaactgagatcatgccactgcactccagcgtagactataagagtgagaccctgcttccaaaaaataaaaaataaaaagaagaaattgcaagcttttagattagattttgttttgtttcatttttcccattagaacagccagtggtgattggctcattgtctttgactctgcacactaatattactgtaatagccatccctgcttggcttactatgccagtgcttactgtggccagtgcttttacataaattgcctatattcaatagaacaatgcactttacagatgagaaacctgaggttcagagtgtttaactgccttgaacaaagttacctaagtagtagaactataatgtgaacccaattctgattccaaaatcctttctcttttcagtgtactttgctacccttagaagggaaagatgactgttaatgtttattaaaagcattatatatggcctggtgcagtagctcacacctgtaattccagcactttgggaggcttaggcaggcagatcacctaaggttagcagttcgagaccagcctgaccaacatagtgaaaccctgtctctactaaaagtataaaaattaattgggcatggtagcgcatgcccgtagtccccgctactcgggaggctgaggcaggagaatccggtttgaactcgggaggcacaggttgcagtgagccgagatcacgccactgcactccagcctgggcgacagagcaagactccgtctcaaaaacaaaacaaaacaaaaaggccgggcgcggtggcttacgcctgtaatcccagcactttgggaggccgaggcgggtggatcacgaggtcaggagatcgagaccatcctggctaacacggtgaaaccccatctctactaaaaataaatataaaaaattagctgggcgaggtggtgggcacctgtagtcccagctattcaggaggctgaggcaggagaatggcgtgaacctgggaggcagagcttgcagtgagccaagatcacgccactgcactccagcctgggcaacagcaagactccgtctcaaaaaaacaaacaaacaacaacaaaaccattataaataccttaactcatttaatgctcataggctcatgaagcagataatatctccattttataggtgagaaaacagaagcatagaggggtgaataatttggccagctttatacaggcagtaaattcgtagaggctaattttaaagccaggcctatatgctataatggcctgttttctctttactgtcttttattttccctcaacatttgtttgaatttaaaactacatgctcacatatctccaaactttttatgtccctaagcaaaaatgttttttaaattgcaggaagtgagaatagtgtgaagctaatgtgattctgattaatttcagtattttatattggaagaaaagttactatagcaagtatctataataatttgtattattgtactctggttttcttttggtgctttggaggaggaatgtgagtaaggaagaagagaactgagggaagtgttaatctttggttaaggatttaaaaattgttacagaatttcatcttcccattttcactccttcccccttcccaacacacacttttaattttcccttagctccctgagaattaagaatttacattttgttgggtcctaactttttaaagatctgattaacagtatggatgctcttcccagaaaagtaacacatacacaattttgtgtgtaattttagggatacatgaacctctgcattaatgcattaatatcacatagcttgtcttgaaaaatatattttatttatttttgtttgttctttgagacgaaatcttgttgtgtcccaggctggagtgcagtggcgcattcttggctcactgtagcctctgcctcccggattcaagtgattctcctgcctcagcctcctgagtagctgggattacaggtgcccgccatcacccctggctaatttttgtatttttagtaaagacagggtttcaccatgttggccaggctggtctcgaactcctgacctcaagtgatccaccctcttcagcctcccaaagtgctgggattacaggcgtgagccaccacacccagccagaaaaacatatttttcttagagttaaatttatagtttttcctgctaaaagttgccctcaaataataatgtatgtaaaactagtctataataaatgaattaccacatacagcttgagtgcagtcatcatggatgagacagatgacagcttcagattccagcctcacacgtcaacactttctacaatagcatttcacaatgttaaaaaagaacaaactactttcctgttgtcatcctcctccttgctgtcatcactttcaaacactgttgctaaatgttatggactgtcattactagacacagacatgcatgtgcgcgcacacacacacacagattcactgttagattatttaaaaaagcagttttcatagataaagcatggtttttctgtttagctatttctctctttttttttttttttttttttttgagacagagtctcgctctgtcacccaggatggagtgcagtggcgcgatcttgctcactgcaacctccacctcccggttcaagcaattctgcctcaagcctcctgagtagctgggactacaggcgtgtgccaccacgcctggctaagtttttatattttagtagagacggggtttcgccacattggccaggctggtctcgaactcctgacctcagatgatccacccgcctcggccttccaaagtgctgggattacaggcatgaaccactgcgcctggccctgtttagctgtttcttttttttttttttttttgagacggagtcttgctctgtcccaggcaggagtgcagtggcacgatgtcagctcacggcaacctctgcctcccaggtttaagctattctcctgccttagcctcctgagtagctgggattacaggcgtgcaccaccacacctggctaattttgtatttttagtagagacagggtttcaccgtgttacccaggctggtcttgaactcctgagctcgtgacccgcccacctcggtctcccaaaatgctgggattacaggcgtgagccaccacgcccagccagctatttcttaatggcattggattgtcttattttctaaatgaaattggattatcttgccaggcttggtggctcacgcctgtaatcccagcactttgggaggctgaggtgggtggatcatgaggtcaagagatcgagaccatcctggccaacatggtgaaaccccgtctctactaaaaatacaaaaataagccaggtgtggtggcacgtgcctgtagtcccaactactggagaggctgaggcaggagaattgcttgaacctgggaggcagaggttgcagtgagctgagatcatgccactgcactccagcctggcaacagagggagactctgtctcaaaaaaaaaaaaaaaaagaaattggattattttatgaccattttcttctccctgccttctctctttcatctaaagaaatattaatgacagtttgtctttagaggaagtctttccttctctaaactagcatactgacaagacatagttcagccacaagttacggtaggagatgcacttgggtcatacagcctcccaatgcacagatggtgacttttcagtaccatctgttcactgtttctgtacagccatttacaatttctccccctctatgagggctgaatagaaaaaaatagaaaagtagtcagacctagttttagagttcctggaaattagctattctttcccctcactttttcctaccatccaataaaggttatggctcttcattctaaatatttcagtcattagtttacacagacccttatttgatatttattggtgctaagtactatgtaattcacaagtaacagaagaacacattatgttagtctactgtgtatgcttgaaaaaataatcacataaagcaatctgttcttttccttcctttaactttgtagaagatacctaaataatctacttattccttataattaaaagctgaatcggctgggcgttgtggctcatgcctgtaatcccagcactttgggaggccgagacgattagatcacctgaggtcaggagttcgaaaccagcctggccaacatcgtgaaaccccgtctctactaaaaatacaaaaattagctgggcatggtggcacctgcctataattctagctagatagaattgctgtaacccaggagatggaagtttcagtgagccgagatcgcaccactgcactccagcctgggtgacagagcgagactccatctaaaaaaatttaaaaaaaaaagctgaatcattggccacttctcttgttgaaggcacctagtatttttctgatattaaacagatggaaacataatagttgacatttcaccctgcaacatgcgtagtgaagaatgctaaaagcaggcagaaacatagttcctgaccttggcaaatcctttctaaatttttctttgtgagctttttgtcctcttcatctccagacaagacctttgcttgctggaggggagaaagattcactttagactgtctaattgtcacgttgtaatgcacaaatagcattccacttgtactacatcataggagaattttgacttgtgactaaatagaagactcaagaagagaaatgactgaatggtatacttacttttgccctatggatttatttgtaaaagaacaggatctattaaaatgtataaggtagggccatgtgcggtggtgcacgcctgtaatcctaggagtttgggaggctaagacaggtggatcacttgaggtcaagagttcgggaccagcctggccaacatggtgaaaccccgtctctactaaaaatacaaaaaaattagccaggcatggtggcattcacttgtaatcccagctacagtaatctcagctactcaagaggctgaagcaggagaatcacttgaacctggagggggcagaggttgcagggagccgagattgctccacttcactccagcctgggcgaaagagtgaaactccatctcaaaaataaatacataatagtaataaggtaaaaagtttgcttaaatactgtcttagaattatttgcccatgtttgttctttttttggtgggtagtctgatgttgacattgtagaacttgcgaggcttcccatttttctctagtcagatgttttcctttcccttagtcctcacgttattaagactacttgtgtcataatcctgtatgattattgatgtgaatgatgttttcttctaagcttcagagtaactttgcttcttaacattctttgtatactattcatattttaatatttttatcttcctttctacttaccagttttctaatctttgccatcctttttatttacatttccgaagcaagagctatcatttttgttggttattggagtcagtataggttataagtactttttggaactcttctaggtaagattcagtgaaactttggaaaatgtgtgataaaaattatatgaaagctatggcaggtgccaggggtattatatatccttctatgatttccactttgttggtttttttctcaggggttggggggcggggggacatggtctcactctgttgcttaggctggagtgcagtggtgcaatcctaactcactgcagcctggaactcctgggctcaagggaccttcctgctttagactctcctgtagctaggatgacagcatgcatcaccacccctggctaagtttccaattttttgtagagatggcggtctcacaaaaagaccccaggctggtctcaaacttctggccacaaatgatcctcctacctcagcctcccaaagcactgagattacagatgttagctactgtgcccagccctgaaccccacactgactcatactgttatccttgaattggacttgattgctaaaatttaagaaatcagatagtttctgtgctcattttataagttgtatatgcttttatctaagggtctagtttgagttaggttttggagcctccactgtttacagtgaaccgttgtttggttatgctgtttgtttatattggggtaatttcattctttaaagtagaatgatcacggattgatcttaaaaaagtggtagtatccatttctccagaattcatactcagctgatttggttctttttagtctttagaatataattgttttttgagtttttattttgttttatttttgagacaaggtctcgctttgtcacccaggctggagtgcagtggtgccatcttggctcactgcaacctccgcttcctgggttcaagcagttctcttttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgggttcaagcagttctcatgcctcagcctcccaagtagctgggattacaggtgtgcaccaccatgcctggctaatttttgtatttttagtagagatggggttttgccatgttggccaggctggtcttgaactcctggcctcaggtgatccgcccattttggtgtcccaaagtgctgggattacaggcaggagccgccgcacctggccttacataactgaatgttaaagtttgatgaattaagtataatagtcatataattcttactcttttcttttaaaattgcttttaatagcatactacctttctttacttattctgtccaggctttcaagtgtagcactcaaaacagatgaatagtttttcctttaaagaggggtcatatacttggggagaagtttcaaggtacaatttataatgatttacctaacattcaacacatgtgctttttgttgtttttgttttttttttttttttgctttgagggtttgtttttgtctttaagcatagcataatgtcctgttttattatgatttcatctgagaaattctgctcagatgaaatttcttacctttcctttggggagcaggcctcccaagagcaatatgcctggatttcagcctttgctcacccttggccaagcattcttgtgcagcaaacaacatggagcaccctgcatggtacacattcagattctgaactttgtactaatttgggattgttttgaaaagtgtgtaacagcaaaagtaacatacatttaataaaaactatgtatatcaaaattctaaaactaaaaatatagcagaagagataaaatagtgtttctgttgcagaatagtatgaaaacctgatgaaaataaaatttttactgtaagtatagtatttaaaaattactggctagtttatatttttatataatactttacattaaactttattgaattaataatatctatctctctatctatctatatattctttatttttggattgagaaacattagcttatttgccataacatttagagcattctgatcctgtaattaatgtgttagtatgtcatacaaataattgtctaatgctttgtcttaacagttctgtacatcttgtaattaagctttcggtttttcctacttcctcaggtactttggtctaggaagccatatggttcgtctcgaagtatcgtaaggaaaattggtactaatttgtctctgattcagtgtccaagagttcagtttcaggtattatattttatatattttaagtattttattaatatgtacattagaaatataaataggcaagatggttttaaaagcattttgtttttgagacttttcaccaattgatgccactatcaatacaatagaagaggattaaaaaccacagtaaagcctttctaattttagtttctctgtgacgtgattgagatttttaagatatttatccttcttaaggatgcatatgtgaagatttaggagcatataataagctaagcagttgttaattcctaggtgacctcaaacataggctttatattattccaggtgcttcatgtaccaccattatttttcttctgtaattataccttcctctttggatagccactctgttcccctgctttatttttagatctctgtggatgccatataagttgctttccgtcattggtttcaagatcagcattaattataggatccattgccttggcaatgacagtgtcaagacaaaaaggtaattgtggttttcgcagtgaggtgatagtcaaaccgtgaatcaggagaacttttgaaagtcttagtcttagaacttttgaaggtcttagtacagtattctcttttagcaccaaatctggagcaactctactctttgcttggagatattgctattttccttgatttgtacttttgtttctttctttctttttttttttttttttttgagatggaatcttgcctgttgccaggctggagtgcagtggcaggatctcagctcactgcaatctctgcctcctaggttcaagcacttctcctgcctcagccttccaagtagctgggactacaggtgcacaccaccacggccagctaatttttgtgtttttagtagagatggggtttcaccatgttggccaggatggtcttgatctcttgaccttgtgatctgcctgtttcggccttccaaagtgctgggattacaggtgtgagccactgtgcctggccttgttttcttattgttattatagtattagacatttatcacataactttgttcttttttttagcaattctttacaaccataatgtaagaacatttcagttcaacattgaataatataaaattcaacagatatctctgccacttttaaataatagattaacatgtggagatgtggaagatgtatttaactcatcatttagaaattcagaagtgcccatgtgtacccgtttgataacatgtcatgttcttaaatcactcctcctggtaaatggaggtgaaatctgtttctttttcttttttttttggagacagagtcttgccctgtgatctcaggtgatctgcgcatctctgcctccctaagtgctgggattacaggcgtgagccactgcacccggctgcctttttttctttttaataatcaaaatgaagaaatctgtggtagtaagtctctcaagtactttccaagaattcaattcatttagacatgaactgctcttatttgccagtttccttcaaatagctattatgttaactaagttttataaacttttttctgattgttcaattccatcaatgtctttctggttaactatcttacctccctcctagttccaggaaaatgtgcttcagcgtttgcattcatatagctagagacgtagagatatctaacgttttctgattgcaacccccaggtctgccttgacagtcaatggactgaagtactagagtcaagtacatttacttgggagaattctttttctcgatgttatcagtcttttaaaagggtatgagcagaaaaagagtattagatttaactaattttaactgcatttgaaaaaaatggattaacataaggagaagagtaaggtacgagaaacattgatgacctacttgagaatgtagtgagagacggaagccatttgtttatagttatagatttgtatttccagttatattgagtctttttttttttttgagactgagtttcgctcttgttgcctaggctggagtgcaatggcacaatctcggctcactgcaacctctgcctcccagcttcaagcagttctcctgcctcagcctcccgagtagctgggattacaggcatgtgccaccaagcctggctaattttgtatttttaatagagatggggtttctccgtgttggccaggttggtctcgaactcccaaccacaggtgatccatccgcctcaggctcccaaagtgctgggattacaggcgtgagccaccgcacctggcccatactgagtcttttaaaattcaacatcggtgttaaagtgttttgtcttgtggccaacacctacaatcccagcactttgggaggctgaggtgggtggatcacctgaggttgggagttcgagaccagcccggccaacatggagaaaccccatgtctactaaaaatacaaaattagctgggcatggtggcaggcgcctgtaatcccagctactcaggaggctgaggcaggagaatggcttgaacctgggagttggaggttgctgtgagccgagatcgtgccaatgcactccagcctgggcaataagagtgaaactctgtctcaaaaaaataaaaagcattttgtctgctacttaaatgttttacatatgctatcatccttctgtatctccactgcttctttgtttatcagaaatataaaagatgtagtcttcaaaatgtatacaggaggcagttttgagtaagaaaattgaaaatgcatttttttcccctatttttgtagctcatttaggggctaactgatgtggaatatatccaggctatctggagtccaatgtgggtaaatattattattgaaagtctgagactgagagtctagtatggggcacagggcaagtggacatcattatactgagaccatatccaaggtgaagtggattaaactgagaacaggacagtcatacagtcaattcagaataacctgggttgggaacttggctgtgtggttatagtagtttgaataccaactctattgggtaatttcacatttttctctctggtaaacctaacccaagctattttcttggactgcaaggagtggtttttggaattggtggtggaaaaggactgtttagtaaccaaaaaagtaatgaatgagattccaattaaagctcacacatggtgattaaatctggaagtaaaatggccatttgttatggcacatctttatatagcaagtaaacctgaaattcatattttatgctaggtgttggtattgagtggtgaatgaaacagcatgtatgtctgcccttattggttatatgattcagtgggagagatatttaaaaagtcaatatgctaataaaggtataattatcatttgtaataaatgccatatagtatgaagtagtatagcatgggggagaagatcaggagttctcagggaaggtctctctaaaggaatgacaattaaggattacaaagagcctgctctacagggttgaggagacaagtagaggttgagggagtcattgtgtgcagacagaatagcatgtgtagagatcctaaggccagatagaaattgaggaaccaagagaaggttccagtcagtcaggaactattaaagtgggagacgtagtagtatggtatagtgatctttgaacatctgagctgtctgaagatgcatacctggattaatatgtaaaataactgttaaatttaaccgtgtgtttcaataactactagataatttggaatatgctagcatgtgatgtcatactgtatatgatgttcattttttatttttagctataattttatagtcagttggcccttaaagattactgaatccagcaacaaatagtatgttttataaattttgacactgtggagcccagcacagtggctcgcacctgtaatcccagcactttgggaggccaatgcgggtggatcacctgaggtcaggagttcaagaccagcctggccaatgtggtgaaaccccgtctctactaaaaatacaaaaattagccaggcatgatagcaagtgcctgtaatcccagctactcaggaagctgaggcaggagaatcagcttgattcttgaacctgggaggcggaggttgcagtgagccgagttcatgctactgcactccagcctgggcgaaagagcgagactccgtctcaaaaaaaaaaaaaaaaaaaaaggcactgtgaaatagtagttttgagactaactgagtatggctgggcacggggtggctcacacctataatctcagcactttgggaggctgaggcgggcggatcacctgaggtcaggaatttgcgaccagctcggccactgtggtgaaaccccatctctactaaaaatacaaaaattagccgggcgtggtggcaagttcttgtcatcccagctacttaggaggctgaggcaggaagaattgcctgaacccgggaactggaggttgtaatgagccaagatcacaccactgcactccagcctggacgacagagcaagactccatctccaaaaaaaaaaaaaagtaaccaacaaatgtttgtggccattttattcatctcaggcagttgatctcttaaaagtcttgtatttccacaaggatactgctgcttacccttaaagattattttcagaaatagacacattttcctccctctggtggctttgttctcttgccttctactattctaagtgtgttacgtatagaaacttttaataaatgttcacttaaaatagtgaccatgcaagagatacatttacaacatggtgactatagttaacagcaatgtattgtatattgaaaatcactgagagagtagattttaagtgttttcaccagaaaaaattgaattggaggtaatccaattcagttgaaccactgcacatatttcaaacataataaatatatacagctttgtaatcttaaagaatactttttttttttttttttgagatggagtctcacttgtcacccaggctggagtgcagtggcacgatcttggctcattgcaagctctgcctcccaggttcacgccattctcctgcctcagccttccaagtagctggggctacaggcactcgccaccacgcccggctaattttttgtatttttagtagagacggggtttcaccatgttagccaggatggtttcgatctcctgacctcgtgatccgcccgcctcggcctcccaaagtgctgggattacaggcatgagccaccgcacccagccagaatacatttttaaaaagtaatcacattcagaaatagtagtgactgagtctgggctagaatattgaatttagtgttctgtctttcagactgttgttctttacacaggtatatcacctgggaagttgatggtgtcactgtatgtcactatactgtattaaaatacagcaattcggctaggcgcggtggcccacacctaaaatcccagcactttgggaggccaaggcaggtgaatcacctgaggttgggagttcaagaccagcatggccaacatggtgaaactctgtctctattaaaaatacaaaaattacctgggtgtgatggcacgtgcctgtaatcccagctactcgggagactgaggcaggagaatcgcttgaacctgggagacagaggttgcagtgagctgatactgtgccgttgcactccagcctgggcgacagggcaagactccgtctaaaaaaaaaaaaaaaaaacaggccgggcatggtggctcacacctataatcccagcactttggaaggctgaggcaggtggattacttgaagtcaggagtttgagaccagctgcccaacatggtgaaacctcaactctattaaaaatacaaaaattagctgggtgtgatggcaggtacctataatcccagctacttgggaggctgatgcaggagaactgcttgaacccaggaggctgaggttgcagtgagccgagatcacaccactgcactccagcctgggtgacagagtgagatttcatcttaaacaagcaaacaaaaaaaaccccagaaattctgctttcagtttttcttttctttttttttttttttgagacggagtcttgctctgtcgcccaggctggagtgcagtggcgcaatctcggctcactgcaagctccgcctcccaggttcacgccattctcctgcctcagcctcctgagtagctgggactacaggcgcccgccaccacgcccagctaattgtatttttagtagagacggggtttcaccatgttagccaggatggtctcgatctcctgacctcgtgatccgcccgccttcaggctcccaaagtactgggattacaggcgtaagccaccgcgcccagcctgcttttagtttttcttagcatggaagcaactggtaaaagagaaataattaaatctatgtaggtaaaaagctagagattatcattttactatgttgctattaagaatatgtatatgtgggctgggtgtggtggctcacacctgtaatcccagcactttgggaggctgaggcgggtggatcacttgaggtcaggagttcaagaccaccctggtcaacatggtgaaaccccatctctactaaaaacacaaaaattagccaggcatggtggtgggtgcctgtaatctcagctactcaggaggctgaggcaggagaattgcttgaacctgggaggtggaggttacagtgaactgagattgcgccactgcactccggcctgggcaacagaacaagacttggtctcaaaaacaaacaaacaaagaatccgtgtatgttatgcatttggctataaacaaatggtagtaaactagaatgagtgtatttactattatgccctttgcagagaatcctagttcccagcactgttgtgtttattttatgaagtcacaagaggatgaagttagtacttctaacatttttattctaagcttttctactattgtacaacatttgtattttactaatatgcactttattaaatgaactgatttttttggtatattatcagaatattttaaattaaagttgcttcagtaagatttctaaaataaaattgaattttgggtaatttagtgttattattgaatttttgctctgaatgaaatgtgattttgaaaaaaaatttctatctcttcactttttttttctttttccactaataatagctgtagtaggacaggaccttgctgggaaccttcagtaagttgtccttttctttctcaaacttcccatgcatgtcgtggtgtctaaatcgtatttccaagaatttcttaatgtcagtccttgccagggctgacttcaccttgacttgtactttactaagtgcattgtcctggaaattgtcctttgcatcccatgcctgtgtcactcaatgaatgcttccctcaccaacacctgaaacggccttttataaagaagattttcttctagttttattttgtcttttgaatgagtttgacttaaatgccaaaactattttgttttgtgggacaggatttcaagtacaaatgacatacatcttatcagttttggaattggttcttgagagcatcattaacattttcatcttattgagcacatattatggacttggtatcatttgcctaattaaggcttaagtaagatccaaattaagtccgtggaatagtttgttgtatcttgttgttttgtttttttaaagtttgtgcaaaagctggcattttatgtttaacatattaattttatggaggcattatttaattttatagatgtaaaattgagaaatgtgtttaatccttaattactatttatgatatcctgaaaatgagttaacttatatttctttgaatatgtattcttagaaaagtagtactggctgggcgtggtggtgcatacctataatcccagcactttgggaggctgaggcaggtggaacccccgagcccaggaatttgagaccagcctgggcaacatggcgataccccccatctctaccaaaaatacaaaaaatgagccaggtgtcgtggtgtgtgccagtaattctggaggcttacgcaggtgaattgcttgaacttgggaggcgggaggttgcagtgagccgagatggtaccactgcactccaacctgagtgacagagtgagacctggtctcaacaacaacaaaaaagaaaagtagtactttgtttttttgtttttctttttttcttccctcctccccacactttgtttccttttatagatgttttagaagaaaacagctatttttgtaacttctgtaggaaagtaagaagtctttgtcttaaatatgcctaactttctaccaactagtcattatattggaacagaatttttatttctaaacaaagggtcatgatcagattgatcatctcatgaaatagcaccttaggaaggcaccattcagattttagtcttaggatttgtctaacacttatacaaaacagcccattaaataccatctctgctaggagcctcacagggcttggggaacattcctgctgaaggatagccacataacccatttagaatctccttattacagtgttatgggaatatcaggataccattctgttttcagtaatgggtaggaacagaacattacctgatttctcaactcttgagatcaaatatgatacccagttgtgttatttaagttgtatgagatacccatttgctgaatatctgtttggataagtttctgaactacaaagggaagtacaaaaatcttccctttgatcttataccttgagaatttacttactgaagttcatgcttttttcctcatctgactacaaattacttccactacatgcaaattggtattttgaaagcctttttatcataatttcattattaggtttatttgtttttgtttttgtggaaggcaagattttaaaatttctattttttgagacagagtctcactctgttgcccgggctggagtgtggtggtgcgatcatgcctcactgcagcctctgcctcctgggttcaaatgattctcccacctcagcctcccaagtagctgtgactacaggtgcatgccaccatgcctagctaattattttgtatttttagtagagacaggtgttttgccatgttgcccaggctcgtctcaagctcctggggcctcaagccatccgccatcttgtcctcccaaagtgccaggattacaggcgtgagccaccgcacctggctgaatttaaggtgctttagatactcgatgttcttagtactttattgttaacatgtttttggattttggtttttttttgtgaccgagtcttgctctgtcgcccaggctggattgcagtagcgcaatctcagctcactgcaacctctacctcccatgttgaagtgattctcatgcctcagccaccctagtggctcgggttacaggcgcctgccaccacgcccagcccttaaaatgttatttttaatgctactttattaagttgattagataattataccaggagagtacacataccaacaactgatatgtttaaagttttattcataatattacattaaagatattttaaactttcaacaatgttagtattatgtgtcacatgatatattttgtgtttaaggaagaggcattatttaagtatatcttccaaaagtttgacttggcaatgatggcattgaggaggtttgaacaatgcatgagtcccaagggtaacctttttgataaacatattaatgactgaatctctttggccttttcattttttccttaattaaaaagtgtggattgattatttttcttttttatttaaacctcactcatacttttagtaagtattaatctgataactttatttaaaaattattattcgttgactttttgactcaggcattattatatgtataacaaaatctaaatttaactcagttatcttttttgtttttcaagataaatttcaagatatcctgcttgtcttttctttttctttttgagactgtctcaccctgtcacccaggctggagtgcagtggtgcaatcttggctcactgcaactgccgcctcccgggttcaagtaatcctcccacctcagcctcctgagtagctaggattacaggtgtgtgctaccacgcctggctaatttttttgtattttcagtagagatggggtttcaccatgttggccaagctggtttcgaactcctgacctcaagtgatccgcctgccttggcctcccaaagtactgggactgtaggcaggaaccactgcacctggctgtctttttttttttgtatttatttcaaaatattctgtttgcatccatgttaagtttaggtagagaattctgttctgctgtttgttcttttgttctttaatgcttttacttaaaatttaggggatttaaggagttttaaaaaacattttcaacattataatatatacatatataaaaacattgaacaaaacagctatataatagccatttaaaaatattcctggatttagctcaagttggtcttttgcttgttctttttttttttttttacccccgagacagagtcttgctctgtcacccaggctggagtatagtggcacgatctcggctcaccgcaacctccacttcccggtttgcttgttcttataccccccgcctacacataccttttaaaatctctttagaaaaaagtggtttctcatgcttagattcaaaaatttttcttaattttctaggatagttttttaaaaaatcaacttataggctgggcacagtggctcacgtctgtaatcccagcactttgggaggctgaggcaggccgatcacaaggtcaggcgttcgagacccgcctggtcaacatggtgaaacctcatctctactaaaaacacaaaaattagctgggcatggtggcgtgtgcctgtagtcccagctactcaggaggctgaggcagaagaatcgcttgaacccgggaggcggaggttgcagtgagccaaagatagagccactgcactccagcctgggcgacagagctagactttgtctcaaaaaaaaaaaaatcaacttataaaatgaaaactgaataaagttatagttctgagattgtcatatactattaggcaacaatatgattatgactattaatcatggagaccttcagtggaagagttagaaaccactcatgtgtttttaacaccagagctgacgattttcctttaggtgagtaaaaaaaatttaacattttggtgccatctttggtgaagaactttccctatttataacttacagattaacagccatgcaacagaatggagtcccagccacccaggagaggatgcagtggcgtcttttgctgatgttggatgggtagccaaagaagaaggagagtgttcagcaagactaaggttagtttggaaggctatcagaactgagatgcaatatctatttttttaaagaatgatattatttgcagtacttatttttaatagcctaattttatctctagtaatgcaccctcttctttttcttgaacagtcttcttttctgtttattttcctttttttctgagattgggtcttgttctgtttttcaggctggagtgcagtggtgtgatcttgcttcactgcagccttgacctcccaggctcatgtgattctcccacctcagcctcccaagtagctgggatcacaggcatgcaccaccaaccctggctaattctttttttttttttttttttttagatagagtcttgttctgtcacccacgctccagtgcagtggcgtgatctcggctcattgcaacctccacctcacaggttcaagcgattctcctgcctcagcttcctgagtagctggggctacaggcacgcaccaccacacccagctaatttttgtatttttagtagagatggggtttcgccatgttagccaggctggtcttgatctcctgacctcagatgatccacccgccttgccctcctaaagtgctgggattacagacgtgagccaccacgcccagcctattttttactttttttgtagagatgagttttcaccatgttgcctaggctagtctgttcgttttcaagacttgactagtatttataaagtttttagagacatataattatgtcctaagtcctcattgacagaattctttgtccttcagcagtttacattctaatgtaagagaccagaaacaatgatcattaatttttagataagtacagtaattataatggtctcattggggcaaagggatcaatctggatcatagtagagaatttgtgtaattggagaatgtttcctaaaaattttgagtcaaaaggagattaagaaggaaatcagttgatactgtaaagtctacaaagtaattacagatggtcactgcaggatgagagatgttcagcaagacttctcaggaggaaatgctagagctccatcatgagggctgagtgggagccaagtaaatggaaggctggtattcctggaagagtaaagaacttgtttaaaggtaaaaccaggagacattgtggcatgtttgggaactgccagatggctcaatgagactagagagcagaaaagaaggataagctgtgggagatgaggacgagaagtaggtagaggtttgaaggtcttacacgtgactctaagaaacatagaaaagttcacgtttgtggaaagcaatatagaacctgaaagcagtgtggaaccatggaagaaatttgagcactagtaaaatcaacatgtaaacagtatgaagaatagaaaagagccagaccaagaaatagaccaactaggagatgatcagaatttaactgaattaagaaactggcagaagaggttcaaagccaagtgagattcataagaattaaaatgacatagaaacttattagatatggagattaacgaaggaagagcctacgtagtcagagtctagttatcctaaattctcaggtttccatgtaggataattataaggatggtgaaacaatttttttttttgttttgtttttgagatggagcctcacttggttgcccgagtgaggctggagtgcagtggtgcgatctgggctcactgcaacccccacctcccgggttctatcaattctcctgcctcagccttccgagtagctgggattccaggtggctgccatgatgcccagctgatttttgtatttttagtagagacggggtttcaccacgttggccaggctggtcttgaactcctgaccccaggtgatccacctgccttgacttctcagagtgctgggattataggcgtgagccaccgcacctagctataatgtataggaatataggaaaacagattgttttggctgggggtaataagagagggtagtctagtctggaatatattatgtttgagttttctgtgagatattcaccttgatctagaaacagtttatgtgaatggatattggtaaggaaggcctatactctataacatttagatagaacggctgaatatgagagtgcccaagaagcatgtatagaacgtgaagagcatttgtaccctgagtgaagccagcattttgaagttaaaggaaagaaaaagcctcctcccccatcaccctccccaaccccaacccatcacccaaagagctaagcggcaggagaagacctggtagagggtattgttatggaagcagaggaggtagagtttttattgaagaggagtagtgatcagtgtcaaatacttagaggctgggtaaatagaaaaactagcaagtttcaattttgtttttcagttggaagattatcattgacttcagcaagagtaatttcatttgagtagtattagctggataaaataagaataaaataagagcaaacaaggaatttgatttgaatgacaaatagaaataaggacatagcagtagataaacacagggattgcaggattagcaggtaaagagcctttcttttttaagatgtttattttatttaaactttttattttgagataattgtagattcttcacatgcatatttataagaaacaatacagagaaattccccatgcttttcactcagtctccttcaatggtaacatcctgcaaaactatagtacaatatcacagcagggtattgatgttgataagtcaagatgcaggacatttccatgctacagagatcctccagttgccctgttatagccacacatacttctcttccatccccaacctcaactccttcttaatggctagcaactactaatctgttcattttaactattttatcatttaaagaatgttacatacattgaatcatgtaatatgtaacttttttttttatttttttgagacagagtctcactctgtcacccaggctggagtgcggggatgcagtcttggcttactgcaacctccgcctcctgggtttaagcaattctcctgcctcagcctcccaagtagctggggttacaggtatgtgccaccatacctgcctaatttttgtatttttagtggatacgggatttcaccatgttggccaggctggtcttgaactcctgacctcaagtaattcatctgcctcggcttcccaaagtgctgggattacaagtgtgagccaccgtgcctggccaatatgtaaccttttgggactggcttttttttttttttttttgagacagagactcactctgtcacccaggctggagtgcagtagtgcgatctcagctcactgcaacctctacctcctaggttcaagtgattcccctgcctcagcctcccaagtagctgggattacaggcgcctgcctccatgcctagctaatttttgtatttttagtagagacggagtttcaccatgttggccaggctagtctcgaactcctgacctcaggttatctgcctgcctcagcctccctaagtgttgggattacaggcgtgagccaccgcgcctggccaaacaaaggtgtctctccaagtcggaatcaaaccagcacctaagaatggccacgggcgtgcacctacagtcctccgctctaccagctgagctattgaagagggcaggactggctttttaaactcagcattattctctggctattcatctaaattgttgtgtgcatcaagagcttgatcctttttaattgctcagtagtagtcattggtatggatgtattacagtttgtttaatcatgcagtagttgatggacatctaggttgattccagtttttggctgttaaagaaagttagtatataaacatttgtgtataggtttttgagtgactgactataagttttcatttttctgggataaatgtctatgagtgcagttgctgggtcaaatagtagttacttagtttttcaagaaactgacaagctgttttctagagcctatttcatatccctctggcagtatatggctaattcagtttctctgcgttatttccttaatagctaatgatgttaaacatctttttatgccatatgtgtattctttcaggtaaaacgtatcgtgtcttttgcttattttctaactggatatttttaagatttctttgtatattctagatatgaatccttgtcacatatatggtttataaatattttctcctactctgtggcttgtcttttcatacatttaatggggtctttcatggagcaaaagtttttcgttttgatgaagtctaatttatgtatttttttattgatcgtgcttttggtgtcaaatctaagagctctttgcctagccctagatcctgagacttctttttccctaagaggtttatagttttatattttacatttgagtccatgatttttttttttctttttttttttttcagaaggatctggctctgtcacccgggctggagtgcagtggcatgatcatagctcactgtaacctctgcctcctgggctcaagcgatcctctcaccttaacctcctaagtagctggggttacaggtgtatgccaccatgcctggctgttttttgtaaagatgggttttcgccatgttgcccaggctggtctcaaactcctgagcttaagcgatccgcccaccttagcctcccaaagtgctgggattacaggtatgagccactgtgcccagccttaaattcgtgattcttttcaagttaattttttcatacaggttgagcaaccctaatttgaaaatccaaaatcagaagtgttccaaactccaaattttttaaaaatggaattaaaaaaaaacttttaggttcgggggtacatgtgctggttagttacatgggtaaattgcatgttatggatgtttggtgtacagattatttcatcactcaggtaataagcataggactcaataggtagttttttgatcctcaccttctactctcaagtaggccctggagtgtgttgttcccttctttttttttttttgagacagagtttcactcttgttgcccaggctggagtgcaatggcacgatctcggctcactgcaacctccacctcctgggttcaagcgattttcatgcctcagcctcccaagcagctgggattacaggcgtgcacgaccacgcccacctaatttttgaatttttagtagagacagggtttcaccatgttggtcaggctggtctcgaactcctgacatcaggtggtcacctgccttggcctcccaaagtgctgggattataggtgtgagctactgcgcccagccgttcccttctttttgtccatgtgcactcagtgtttagctctcatttacaagtgagaacatgtggtatttggttttctgttcctgtgtgagtttgcttaggataatggcttccagctccatccatgttgctgcaaaggaatgatctccttgttttctgtgactgtgtagtattccatggtgtctatctaccacattttctttatccagtctaccactgatggacatttaggttggttccgtgtctatgctgttgtgaacagtgctgtgatgaacacgtgtgcttgtgtccttttggttagaatgatttattttcctttaggtatatacccaatagagggattgctgggtcaaacaatagttctcttttaagttctttgagaaatcttcatattcctttccacagtggctgagctaatttacattcccaccagcagggtataagtattccccttctttgcaaccgcaccagcatctcaggcagtgggcagggccataaagctcccaagcaattatgtcctttgtctctggagttcctcagctttcccacagagcctgtagctgcaatccacctccttcaaagtgtctgtggattctctggctttcctggtatgttcctgcagtagttcttggagcaaaagttcaccatgtggatctctacacgctgctctgtttgtccaagtgggagccgcaagttagtcctgcctgctctctgccatcttccccgaatggaatctacccttctgtgtttataacttacagtttaagtccctatagaaacaaattctatttaagactgttcatatgttgcagtttgtttttctgcctctcatatttatatttgtatgaaagctgaagctcttcaatatatttcttccttgaaatttatgttgatgacatttctataacaattatttataatgtcatactattatgtctccaggaaaacaggatacatatgagtctttcataattggttattatagaaatgatttttttcaaatgcaccgaacttgagatttttatttataaactagaagtacaggccgagtgtagtggctcatgcttataatcccagcactttgggaggtcgaggtgggtgggttgcttgaccccaggagttcaagacgagcctgggcaacatggcaaaaccccatctctacaaaaaataccaaaattcgctgggtgtggtggtacacacctgttgtccttgctacctgagaggctgaggtggtaggattgcttgagcctgggaggtcaaggctgcagtgaaccatgaatgcaccactgcattccaacctcagcaatggatcgagacctatcttaaaaaaaaaaaaaaaaagaaaaaagaaaacaaaaaaaagggcagcatatttctgtggaatagaagtattctactttgagaagagaattttcaataacatgagaaaactgttagtacagtggcatgcacaaagtaaggcctcattgttttttctcttttctgtacacattttcatttcctttttaactaacagaagcattgacatcctgataactgataatctcatctaagataatgtgttctctttcatagtagtattctaaggagaacgtatagtctgtgaaaggaaaataaaccttgggactcccaaatcactaagccaaagggaaaagtcaagctgggaactgcatcaggcaaacctgcctcccaaagctttgcatcagagcaaagctgcctctgtagctatgtaagatagctacattataaaaaagctacatacctctcttacaatttgcctgctaggaaattccttgtgggccccaagatccttaccctaaaacagttctgctaaatttgactctgacaatgtgaactgatagcttttcttcacaggtattggaaaaggacggaactcaaaagttacccctctgctcacctgagacaaatgcatatctgattgcttcctctgccctatgtttattttatgtaaaaatgcagatttactgaactagaggaatgcctacgtgactattcctctactgcccctcacatgtgaacagctgatcagagacttaaaagaatgtaaacttttgtctcttatctacccccaccttttaaaaatttcttcctctttctctaatatctgccctttctcctttaaatattgaagccctcaaaatcatctttggagaaaggcactgatctgtctcccaggtgcacatctttaaccttggtaaaataaacttctaaattgtttgagacctgtctcagatactttttggtttataagtctttggataaatatacagtataacatttgtactgtatgatgaaattaaagactgtaatctctgaagcctttagttgacatcatagacattgtcatcaagcgtttgattggttccaaagtagaagagcagctaaggagttttgaaatatttcaagtttaatttgttcattctatattaatatattaatttctagttgtatccagttcttctgtagagtgtcacaatatcaagctcacttactaaatacaaatttataggttcatagggcttaaaaatgtttcggatagctgttttccttatcctaggatgcttgcaatctaatgaggaagatgaacatacttataaaagtctgtaatataaggatagtgaataaagtgagactgaggtgatgatatccagcttaatttttcaagtgtcagcatgaagtataagatggaatgtgctgttttttaaggagtgtcagggaagatccccaacctcttagagggtgacagagtagcaagagtccataggaaatacttaacaagcaagcaggctggctccacagtgccagaggtgcaagagtaggccaggagactcggtggatcagagcaaggtttcctactcacagcacatcaatctgcagatgttactggtttctattttattcttcattacttgacagtagacatgaactgataaacatatgttattaaaatagtatattcaagggagaaagattatttttgttaaataccacttttaggaagattgaacttctgaaatataaaacaacagaagggttgtgttgaacagagcctaaaacagctaatgagggaatcccactagttttctaggtctgtagcctacaacactcctgcctgttcccactgtagatttctcatggattgcttcctctgtcaaaatgatttcccattctggttgtctttatccagccacttgcccactttgaaaagactgttagttttcttttctttgtttcttttctttctttctttcttttttttttttttttttttgagacagagtcttgctgtgttgcccaggctggaatgcagtggcatgatcttggctcactgcaacctccacttcccgggttcaagcgattctcttgcctcagcctcccaagtagctggtattacaggcacccgccaacacacccagctaatctttgtacttttagtagagatggggtttcaccatgttggccaggctggtcttgaactcctgacctcaagtgatccgcctgcctcagattattcgttttctaccaactttatatttcaggaaactaaattaccagttttttttccctggattctaggacaatagagtatgtttttttacctttcaaggttgttctgtaaactaaaaagatgagggagggtcagtagaaatcattttgggaatagggcacatctaatttaaaactgtgtcagattttgagtttcccttacctgtgagatgaggggacaggaccccagaggtgtattatatttaacttagggttctttgatatgggtgaggagctaaaaaggcctttgcatttatgtaaattgtgctacaaaagtggcttcccttgacagtaacaaggaaaaaagagagctagataattcagtgtagtgttattctaagtaagaacctgtgtgccttagggaattttggacccaatataaacaaaatataaccaaaacaaatgaatgaaaccagtagaaatctcactagcagaaattggtatccagaaaatggttttaagaaacatcagttaactgttaaacgtttaaggtaatggaaaaaaaaaaaaaggaaaggaagaaatatcaggcctgcataatatataatcccaacactttgggaggcttgaggccaggagttcatgaccagcctgggcaacattgtgagaccctgtctcttaaaaaaaagagaaaagaaaaaaattagccaggcatgggtggcacgcacctatagtcctagctactcaggaagctgaggcaggaggatcacttgagcctaggagttggcagtgtgggtaacagagcgagatcctgtctcaaaaagagaaacatcaccctttggctgtttatcttctgtttttggtacatccatgcttgatgtctctggttttttttttttttttttttttttttttttttgagatggagtcttgcattgtcatccaagctggagtgcagtggcgtgatctcggctcactgcaactgccgcctcccaggttcaagtgattcttgtacctcagcctcccaagtagctgggattacaggtgcctgccaccatactcagctaattcttgtatttttagtagagacagggttgcaccctgttggcccaggctggtctttaactcctgacctcaggtgatccacccaccttgggctcccaaagtgctggtattacaggtgtgagccaccccacctggcctctttgttatttttgtttttgtatttgtttttatttcttaaaatttctatgaattacaaaaattcttgcaagagtctatccttattttggatttattctgtctttgtaatctagttcttaatagccctctgttcttaaggatagcaaaacagattggttttaagaatgaatggtttgttgactgtcttaaaaaataacgcagggctcggtggctcatgcttgtaattcgagtactttgggaggccaaagctagaggatcctttgagccacggagttataccagcctgggcaacatagggaaaccctatctgggctcttaaaccttcataggtcctataattactatgtttgagcccataaatattaaagtatttcacataaggaaatgctgaattatataattaaagacagaaaagtagtataaagtacagttcttcactgttaattaaattgttttgtcaaaggtcctaaacttttttgctcttaccctggcacaatagtgttcaagattaaagagtaatttgtcctttattttcagtaaaaaaagcaaaaagataaaaattcatcatgcaaggtatggggagatatagaaagttaatccttttcagacataaccactttgaagggcataaaaagcttcttcttagttcaaatcaaaagaaaacgtcaattagcaaaaactttgctaaaatctgtgatgcctcttgatggagttggtttgtgcatattatgtagagattgactaagaaaaatgatggcagcaagaaccccagctgtggtatgtaactacataaggttgacaaatgctttgctgtttttgtccttacacgaagggacttatgtaagatcagcctgaaaagaggttcttgggtgttaatgcggatacactgtcaggtgaggatggtgtttcacgttctcttacaaagcctgtgacagcccaccttatgtcttccttgcaggacagaggtcagatcaaggccaccccttcaggatgaccttcttttctttgagaaggccccaagcagacagatttccttaccagacttgtctcaagaagagcctcagctgaagaccccagcgctggcaaatgaggaagcactgcagaagatttgcgctctcgaaaatgaacttgctgctctcagagctcagattgccaaaattgtgacccagcaggagcagcaaaatctcactgcaggtctgtaagtcctacatttgttagttttaacttgcaaactagaagttaggagaatgctacttactttaaaatcaattagtaacagctattggggttcttagaaaaccaggtgtcatccaggtacggtggcgcatgcctgtaatcccagcactttgggaggctgaggcaggcagatcacgaggtcaggagaccgagaccatcctggccaacatggtgaaaccccatctctactaaaaatataaaaattagctgggcgtggtggcatgtgcctgtagtcccagcttcttgggagcctgaggcaggagaatctcttgaacctggggggtggagaaccaagtgagccaagatcatgccactgcactccggcctggcgacagagcaaggcttcttctcaaaactaaacaaaaaacaaacaaaaaaaccaggtgtcagtcctttttgcatagtccaacaacaaccaggtcaggtttagatggtgttcattttgaacaatcttggtgctgtcagagaagatgactaggaagtatcttttggaaaacactggaattcatacagttgaattgctatatagtggatgctttcctttctaatgggaaacttagttgtctaggataatggcaccaaccatatcagacatgaggtaatgccatgggttgctatctacttggtgaaaggagcctgggtttctgtgtggtacgtgttggactgagtggtgtttactacctgcatgtcttgatgcaagcacttgacatctcacctgcctttactgctctaaaatggggataatagtacctatgttactgagttattgtgagaataaatatggaaagtatataaaatgcctttaacacaaagcagctatttaatagttattcttcttccttttgcacagagtagaacctgaattcaagtcttctggtctaacaccattgggtttattagtgtgacattctcacattggggaggaaactatagccttgaaattctagcccactaacctattggcaagtagtggttattttcctattgttgtttccaaggcctggcaagactcagtattaaccagctctgttggataaggacaattaattaccctgcctctgagccacttggcttatacttctggagtttaacgtaatccagcatggaaacctcatttgacctgggcatggcagaggtgggtgggggtggaggcactctgggcgctgatgctggactgtgcttatgcctgtaacttgctaaaattctccactcctacctttttcttgtcttaaattgatttttccttttgctttacctccctcttctggctgactgggaaagtgctaccataaatagataattttgaagctctatttataagctgaaacttttgagtaaaaatcttttacatcaacacctccccaatcaaactagttcacccaataaacaactttctaacctccagttatgcagaaagaggatttttaggtccttacttcatttccataactcttagttacttcttgttttagagacagggtttcactgtgttgctcaggctggtcttgaactcctgagctcaaactacctgccttggcctcctaaagtgctgggattacaggtgtgagccactgagcccagcccagtgcaggcttttaatgcttagtaagtcttatatgaaaatatacttaaaatgagtcacaaatttgttagttttctcaaatcattaaaataatactaaattgtcaaattgtatgtaatgtagacttgtttttgcagtactttgttttatatttctgttaaaagtgattacaaactgtgctgtagtcaaacttgaacatttgatatcacaaaaacacctctgttaagttaaatagaaattttccatctggatagttttggattgaatgatacagtggctgagattcaggcatttctcatgaagtaactgaaactgtcttgcttcttacataactgaaacgttaagaatattgtttttaggggtacaaaaatctttaacatcattttgcttttaaaaactgatattttctttgcttaataccagtgggattaagtttgttttcctttgtttctgtaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtgaggatacattcaccttctttcttccccatttgtttgtcttataaaaccaaagtaccaggcttcttgaggaattttgtttataacatgactgccatgaatagtttttagtttaaaaaaaagatgagccccagtggcttctatacacagtagctaagagattagcaaaataagctaacatttcccaggtgatgtttttagttttcccattttatttaaatatcagccttttcatgtaaagtcttcactgcagttgctcagtgagcattcactaattcaataaaggcgtgctgtgtaccactagcatagtcactagacatgcatggaacagggaactctatttgccctgaaggagagtagagtccatgttctgcagacatattacatggccctttattggacttctgtgtgcttttgttgagcattagctctaggcttccatctcaatgctagcagtatttatcaggtctctatggagtagctatgatgctggagaggtgctgtcaggcaaaaggttgacaaagtacttccctgagggtggccagtgtattgatctgtccccttggtttgtgttcacttctctaaggtcagagcaagatgtgaagcccaagccagtggatgctactgaccctgctgccctcatagcagaggctctgaaaaagaaatttgcttatcggtatcgaagtgatagccaagatgaagttgaaaaaggaattccaaagtctgaatcagaggccacctcagagagagtgttggtgagttatttgcccagatttctttcctgttatgtagaaatccatcccattgccaagcacttgcattttgcaagtgattcacctgtgtcatctgtaagttccaaagggaggtgatacaggatttggtccctgccttacaagtagatcacggctggttgggaaaaggatgacatctttgcttagcatttacacttttacttttctaactatgaaaataatagttgttcatttggaaatttgaaacttgtagaagagcagaaagaagaaagccaaagttaacccctgagctcactactaagtaatctccaatgttacattttctatgcagggttatatttttatttaagcatagtgaagtgaaattcagtatagtaacaatgtatattttgtgacatagaaattcaaagtacagtgagatcattttctctcagggcaccctgtgaaagtcttctgaagagggtgacatttgatgtgggccttggaggatgtgtaccatgtcaaaggtggagactgggtacatttcatggaagctcccacataataattgatacattccctttattaacattactgtcctggggcgtgtgtgtgctaatctattccagagaggcaggcatctcagaaattccagcacctttgaaacttcttaagacattggaaaggaaactttgtactttctctctttactcagagaagtaaaatttaacaaaagcagggtattgccaagatggttgtagttttcatttagaggaagcagtttggctacttctttacctttcattctgttgatatgttctgtgttcataacaacccatcaatttgtaaaggttttaatattcccagtagttgcttggtttttcatgcagaacatacccagccctctaatccatgattgggaggtgggggcgtatcgttactgttacttgaaccaatatctttatttatactttttgtttgtttctagtttgggccacacatgttgaagccaacaggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgtttta

SEQ ID NO: 36365 - DNA, 65813 bp, Homo sapiens; identical to SEQ ID NO: 36364

SEQ ID NO: 36366 - DNA, 166963 bp, Homo sapiens
aggaagccagcctcagcccggccgctgtcgccgccctgtcctggtgcccgtccgcgtcgtcgccctcttcactggccctcatcacttctcaccgcgccctccagcttcacccgtacaggtagccccgccgccgcgcacctgccttcgctcccgcaccggtgagtgtcccagagacccactgcggggcgtcggcgccggggtctcgcgttccctggcccggccttgctcccgggcctcctcgagcagctccggggccgacgcttctgttcactgcccgaggacgcgggtgggagaagcaggtgatggatgggtgggccctgggcagcagtggggccggcggtggttctcgtttccaccgaaagacaatcagtctcctttcatgggttctcatcaccaaggtccctttgtgtttcttccctggctcccaggtagaagcagagcactcaggtgcctaactcggacttggacactccgtgatagttttattttctcttttgtaaacacgcttaaaattcagtgcagggggagcgcagtttgctctgagatgtgaagatcaaatgataccattaatagtctaatcatgtaggagaccagatcgagactttctaaagccttattcttagtctccaggtggtccagtaccttgagtatgttaatttacggatatgctactgaacaagaactttttttgttaatttccaaaaactccctaaaacgattaaaatgcttaaactctgggattttaattttaagtaggacacaatttgatggggttattgctagaacatccgtgtttaaaagtatttccatacagtttaaaaaattcattaccttttttttttttttttgagacggagccttggtctgtcgcccaggctggagtgcggtggtgcgatttcctctcactgcaccctccccctcgcgggttcaagcaattctctgccacagcctcccgagtagctgggattacaagcgcccaccaccacgcctggctaatttttttgtatttttagtagagacggggtttcaccatcttggccaggcaggtcttgaaatcctgacctcttgatccatccgcctcggtctcccaaagtgctgggattacaggcgtgagccactgcgcctggccaaatattctttacatcttacctggcataaagtgatgtggtggagggatgcttaaatcctgatttacaagtattagtgagaaatgaggagcactgccctaacttaatagacttaactgtacgggctaaataagcctcattttttttttttttttaatgctctggtggtatagatgcagtctatctaaataaagtcagaacttgagagttttaaaaattaacttttttttttttgagacagagcctcgctctgtcagctcactgcaacctccacctcccaggttcgaacgattgacctccctcagccgcccgagtggctgggactacagtaagggcgcgccactgcccagctaatttttgtatttttagcagagacggggattcgccatgttggccaggctggtctcgaactcctgacctcaggtgatccactcgcctcggcctcccaaagtgctaggattacaggcttgagcccccgcgcctggcctgaaaattaacattcttaagatttagctgaaacttatcttcacaccataaaacgtgaatcttgaacttggactggtagtggtcatggtacaaaggttggcggcaaaacagcatttctgtacaaattaactgaacttcctagatgtcttgggttgtggttttcaaactggagaatgtttagtgaaaaaattacctttgtgccttttttccttaattgtagaaaccgccacaaatgttacaaagtgggctatagccagagcttgaaaccatgctgccgttcaaaatagctcacagacttttatatatacagctcattttgagtattttacgttacgcaggaattgcatccactttggtaaacagaagtcattttagtcttatgtacatttgcccattatttttgtattttttgtgtgacatgctgtttatcattctctcatctttgtaagttacatttttgttttcagaaaccattgtaaatgtaacagaagtatgaatgacatttaaggaaagatcatgattaaaaactgtataatatataaaactatatatgatatacatatatattcttggttagtgcctagaaacatgagcaagaaaaatgttatgaacaattacaatatttaatgtaaattaatgcaattaaatattgcattaaaaacaaaagatcgtaaatcataaccagtagggattatctgaaatggatttttccctgtttatgtttacgtggtcaagttttaaaataacagtggccaggaaatctgagagaggctgaaggctctgttctcatcctgttgtgactttgcctggagtctgtggtgtatcatgtagcccattgtttagacaactgggctgtatctgggttccaaaatgtagctttctttagaaagttttaaagactttgaccatgtgaggcttgaacaaatgcaaacatccaaacattgaaaaaaacccattttaactttctgttgatagttgagactccatttttgacatgtaaaataccagttttaagaagagtttactaacctctgtgtagtttcatttttatatattaaaatatctaaaaatattgggaagtgttataacttaaataaatctcagagtttatttattcttttttttttttttctctgagatggagtcttgccctgtcatccaggctgtgcagtggcacgatcttgggtcactgcaacctccgtctcctgggttcaagtgattctcctgcctcagcctcctgagtagctgagattacaggtgcccgccaccacacctggccaattttttattattattagagatggggtttcaccatgttggccaggctggtctcaaactcctgagctcaagtgatttgcctgccttggcctcccaaagtgctgggattgcagtttcatagagtttaattatgatacccataatgagatatttcataataatttgtgaactggccctttactagtataagattgttgcacatttattaggcatcttccataattggacagatcacagattgaggggcttgatctacaaaataattttctaggctaatggtcttgtccttttacagatgagggagtctagtctcaaagaattaaatgcttgctccagaagggcaaagtctggattcacacctgagtcatttgaccacgaagcccctgttttttccaccagaacagtttgccttggtttcagttcacttggtggactgtttaaaccggcaaaactggtattatgtcaaagaatgtaattcaaggtttgacaaaagcatccaggagtagatatgataggccgtgaatgtagttctggaacaaatttagaatcctgtgtttgtgtcttcattctcaagttgacagccttgaacactgatgctgctgctttctcatttctcgtatagttctaggacattatatgtattgtgcatgtatgtatgctgttaaacatatgtatgtgtttaactttgataggtttgtgagaactagaattagattgtaatgttcctggttgggatagaactttaaaattttcctctaatgaaaaagataattatttatgcagtagctatcctttaaatattacataattaattctctaatcttgagaggggggactcgtttttagattatgattaaattgtcacttagaaactattagtacaaatcttttctatggtctgtggaatatcccttgagccgcaatagacataaatgacaacagtgagcaaataagcccattttttctggtaacaaactaggaatcatgcatttcagcagtaggatgtagttgggtaaatgagcagaagcaaggtaggaaggctgagttgggtggctaccattacggatttttttcattatttgctttgaactattaggaattgtgcatctcaaggatattcatattcaactgtaaatacaaaaccaccacctaatataaattagtaatattactaatataaattggtaatagatctgtgacacacacatcaagaagtagagttaaataagcttaagttctcttttggaggcattatatctatatgcatgtatctatgatctatatatgtgtgtgtgtgtgtatatatatatatatatatatatatgttttttggagacagagtctcattcatgccacatgcagtggcatgatctcggcttactgcaacctccatctcccaggctcaagtgacactcccacctcagtctccggagtagctgggaccacaggtgtatgtcaccatgcctggctaacttttttgtgtttctggtggagaggggttttgccatgttgcccaggctggtcttgaactcctgagctcagatagtgtgctgcctcgggctcccaaagtactgggattacaggcatgagctaccgtgccttgccggcattatataatgttcagaggaaccaggatcttttcatttaaaatggttctgattttatttgacaaatttgagtggactagaatctttaaatattttgcaacgtctttctagttactgttttcaaaaattagcttatttttcttattgattagtgtaagaatgacataatggtttgagaaatgaccataagtccaccaaaagttttccctgtgagtactgaagcataaaaagtaaaacctaaagaagaaatctggcatctttagaaatcttgctggtgctaaagagagaggaaataattttttatacagaaggcatgtctcaagtgaaaccaaaacaccaaagcacattccttcagtgtatattcacatggggtaaatatgatgctgagtaatgtgcacaaaggaaactcttgacaaaaacacagtcatcttttgagtatgttaggtcatttgttatttcatttgaaaataacctggctggggcgtggtggctcacacctgtaatcacagcattttgggaggccaaggtgggtggatcacctgaggtcaggagttcagaccagcctgggcaatgtggtgaaaccccatctctactaaaaatacaaaaattagctgggtgtggtggtgggtgcctgtaatcccagctacttgggaggccaaggcatgagaatcacttgaacctggcaggtggaagttgcagtgcactgagattgggccactgcagtccagcctggacgattgagtgagactccgtctcaaaaaaaaaaaaaaaaaaaaaaaaaaagtaagccgctgactaacctttacaaggtaatatattttctgtggcagaattttttgatttctgatctatgtggatgaacatctttttcaacagatatttactgagggcccactgtgttttagatatgacaagtgtgaactgattcctccctgtgctggcatatctttggatccaggaaataggaagagttgcagagatatgaaaaaataaatagaaaccatccatttgaaatccaaagacatatacgtcaaaagctaataacttatatttggatggcattttattgctttaaaatatttttgtatgcatttggtccttaaaacaacttgatgaagtagatttagtaaatttattccttttctacaggtaaggaaatggagactcaaaaaattaaaaatactggctgcatgtggtggctcatgccggtaatcccagcactttgggaggctgaggttgggaggatcactttagcccaggagtttgagaacagcctgggcaacatggtgaaaccctttcacaaaaaatattatacaaaaattagctgggtgtggtggtgcacgcctatagtgctagctgtgtaggaggctgaggttggaggatctcctgagcccaagaggtcaaggctgcagtgagctgtgattgcaccactgcactccagtctgggtgacagagcaagatcccgtctctaaataaataaatacattacttaaaattaagtaacttgttcaaggtcaatgtggctacttagaagcatcatctctgtgtagtcccaaagtagtaagtcctccactttccccctattgcttatgtatttaacctcacattatggcttcaagtcaggtggttcaggaagttctgaaaaattagggtcactaaaatggtgattattaaattgttacaggttattttttaatggaagatagaagatgagcatgatgcatcattatggaactactttaacattttaaatagattgctagactgaaattggtaattagcttttctagttggagaatttttaaagaacaattagttaaaaaaaggaaggagaaaaatgttctgggggaattttgaaaataacttttattactttgtgcattggtagtgatccgatagttacaactgtctttgtaaagactcactaaagaactgtgtgtgcgtctgtgttggttcctttatgtcttcatttatttaaaacgtactgtagtgtctaccacggaccaggcactattctaagttctagggatacagtgattaaattaagaccaagcccctgtactgacattttattgttgttttgaattaagttaattatagactcttcatactaggatgtaatcaacagggctgaccctaaagttgggaaataggcagttgtcaaaattgtgcaatttaaaggctactgcatgacttacttgctctggaatatttctgacctatctgtcgaagactcccagactattgggttatggcgctgttaccaacctgctttgataaatataagtatgttccatcatttatcacacttttagcaaagaaaactgagagaaaataaatgggaactagaattggacacggtgatgcttacctgtagtcctagctactcaggcggctgaggcaggaggaatgcttgagcccaggtgtttgaggccagcctaggcaacatagccagattctgtctcaaaaaaaaaaaacaacaagcaagcaaaaaacaaatgggactaggactgatatgttggtgttgtaagagaagaggttagcaaagtataattttaatagcagctattgttttttctttttttttgagacggagtctcgctctgtcacccaggctggagtgcagtggtgcaatcttggctcactgcaacttccgcctctcgggttcaagcgattcccctgcctcagcctcctgagtagccgggattacaggtgctcacgaccatgcctggctaatttttgtatttgtagtagaggtggggtttcaccatgttggccaggctggtctcgaacttctgacttcaggtgatctgcccgccttcgcctcccaaactgctgagattacaggcatgagccactgtgcctggccaatagcagctattgtttattgagcttttactaccatgtcagatattatgccaagtgagtatttttgtatacattagctcaatcactgtgtcacctcagtggtgctggtgttatgaccttcattttacagattaggaaactgaggggcagagatgttaaatttgctcaagcttatttggtggtgctggaatttgggtctctgctagtactaagcaggtagtagatactaatgtggaaagagtacttatgtgtgttgtgtgtgtatatatatatatatatacacatatatatacacaccatatatagtgtgtatatatgtgtatatatgtatacacacatatatagtgtgtatatatgtatacacacatatatagtgtgtatatatgtatacacacatatatagtgtgtatatatgtgtatatatgtatacacacatatatagtgtgtatatatatgtatacgcaatatgtattgtgtatatatgtgtatatatgtatatacaagagtacttatgtgtgttgtgtgtgtgtatgtatatacacacatatatacacacatatattgtgtatatatgtatatagacatatatacatatacatatatagacatacatacatatgtgtgtgtatatatgtatatagacatatacacaatatatgtgtgtgtatgtatacacacacatatacatatagaacatatatacatatacatatagaacatcagaagtctgtgtgtgtgtgtgtatatatatgtatacacatatatatacacacacacacatagagacagacttctgatgttctgctaggatgtgtgacacatcacagaggtgggcgaccttggtgtgggagtgatgggtgtggggagtcaggatagcttgttgggtgaggggtgggaattggggttggaaggagatgggagggtattacttgcctaactacttggtcgtcaggcttaatcctctctctgacagccctggggttccagagttgcgtttaagcacagtgctttcttgtccagctcctgggtaagaggataggcagacctgaggcaatcctggttttgtcactcattaacttggtcaaattatttcatttctctaggcttcagttttctcatctataaaatggaagtaacaatattacctacctggtgtggttcttatgaggattgaattagataataatacatgtaaaacacagatcacactggctagcacatagtgtacattcattattattgttgttactgtgtttttttttgtcatgtttaatgtggaattttcatcgaaaagcaagaagagcaatatattagtgatttggttggaatcttgaagttggctttttttttttttttttttttttgagatggagtctcgttctgttgcccaggctggagtgcagtagcgcgatcttggctcaccacaccttctgcctcccaggttcaagcaattctcctgcctcagcttcccgagtagctgggactacaggcacgtgccaccatgcccagccaatttttgtatttttagtagacacggggtttcactatgttggcaagcttcccttttgatttatgtgcaaactggaattagagaactactagcttaaactttttctttatcttttggttagggagggcttcaacaagattaacgacaatttgcttgggttaaccaggcagtatgtggtagagggaagtgaaatatgttaccagaatctcttcattgacttttttttaaagcttatttggggcttatagcattgtatggagaagacaatgcagtgttaaatttcgcacctaaattagattgtaatgactgtttcagctttttgtttgtttgtttgtttgagatggagtctcgctctgtcacccaggctggagtgcagtgttgccatctcagctcactgcaagctccgcctcctgggttcacgccattctcctgcctcagcctcccaagtagctgggactacaggctcccgccaccacgcccagctaatttttcttatttagtagagatggggtttcactgtgttagccaggatggtcttgctctcctgacctcgtgatctgcccgactcggcctcccagagtgttgggattacaggcgtgagccaccgcgcctggcctgtttcagctttttaactagcttcattcggaggtgattagttaatattagttaaaattgttaatttttaacgattatacaaatagtaaaaatgtataaatacatgtttgtatagatctttttttttttttgagatgtagtctcaccctgttgcccacgctggagtgcagtggcatgatctcagctcactgcaatctccccctcccaggttcaagcgattctaatgtctcagcctcctgagtagctgggatcacaggcatgtgccaccatgcccggctaatttttatatttttagtggagacggggtttcaccatgttggccaggctggtctcgaactcctgacctcagctgagccacccgcctcagtctcccaaagtgctgggattacaggagtgagccacagcgcccggccgtttctatagatccggtcatttctatagatcttaaaaactttcaaaaacttagatttctttagataatgtgctgttgaataatcagacttggcattgttagtcatatcaggcaaagccccaaaaggaaggagattttacccctggtggttcacatgaagaggctatttgcagaggttagagaacaaacaagtgtggtaaagcgctcagggattagaaacagtaagaaattcttagttctccagaaattaccagagcagaaagctggcattgtagaggagggctagagggagctgcggttttgaagcaggaggggcgtgaagggaggttccctgatctctcttccctcttcctccgagtctccaccggtgacttactttactagaacccagctggggagcccaggtgattttttttttttttaaagctcattctcccagtgcaagagcagagaaagaattgaggatgtgaaggagcaaatggagattaactaggacattatttagaacctttggggatttgtagcatttccttggtacattttaaaaaaaacttgtagcattgtgatacatctgcaaaatacttgggactaattgttttatacatgctttcagaaatagtttaatcactttctcatttaactgaacaattattttaggaaattttgatgatccgtataacccaacaagaaacataatctaggtctgttaacacaaagcacttttgttaatatactgttatactttgctgaggttttctgaaattttcttcactaggcagtcctggtttaatggaatacatgtttctttcattaaaaatctttagtgactaaattaaaaatattttggcaataagtctttcgcttttctggaatttatacttgtattcacctggaattttttttgacagcaagagcactagaacatagtgttgatatggtaatagttcatagaagcaagactattgggaaatagttgttcgtccttcccaagtccttttgaggacacattaaatttctgtataaatctgttgcagtttgctgttatcttgcagttgctgatattttgctaatgccaattttacctagttaatcttagttctggcaaaaagtttgtgctctttattttggatagattccttaggggttactaaagaaaaggatttctcttcttaaagagatggtatgaaggattctagggatataagtaatactccccccaaaacaattagattatgacttatattttctttcttctcttgaggattccagggaaaaagaagtacaagatcttactcagattaagaagcagctagagagggccttgttcatgacctccagaaaaggaaaagccgtattgtgcagggttgagcagatgaataaacatctggctgagagaatttagcatacaaataaagtatacctctggatataaatgttataactgagttaaaaaaaaaacaaatatgtttcccagcttgtcttttttagagagtatggtgaaaatgagaaacaggtttggaatcaactgaataacacctgtggttggaaaccaaccatttagacattttctctgtaagtaggcttttttttttttaaaggagtgattttcaaacttttgtgggatcttctaaaaacatattgtttatttggatttgacactgatggaatcagtatcccgcaggagatatttgaggctcttagtttttccatgttgtattctttgaatttccttgatttgaggattgagttattccagagagaacttttctcttcttccttgttattttttttctaaaattagatgaaccagctgtgttttggtttgtgggcatgatttgctgtctgttatccttttggtcttagtatctgggggaagaacaaagaacctgtgtgtgttttgaagaagaatgtattagtttctctgctcttcttgttcatcttggttgatctttaagatgagaagaacgaagaaaatactttatgtacttattattcttgtgtttgatatttcaaacaaaactgtggcttgtattggccactgagatgatggagaaaacaggtgaatgtaaagtgaaaaactagtcatcatgtattcaaatggctaattgaagaggtttatgttaaaggttttctttcaggtatgggaggagggaaaagaaggatggaaattgaatgagtttgaccatatgaccagctgtcacgacagatgttttagcaaccaggaaatatttatttcaatcagaatttaattttatattttatagggatgcattctactaataagccttttttttggaaggaaagtgaggataagttaggaatttataaaccaatttggtgattttagtaagtcattagtaaaaatggagatagcctggtggctgcatatactgatgctagtatgttagaaaatgggctgttagaacacacacacacacacacacacacacacacacacagacacattttttttttcctttttgccagatgtgcaactgtatacagagggctattatttattaaaggtgtgtttctggaactggcccagaatgtcatggactttagtcctgttttctaggattctgctatttggtatataacactgatataggttagtattttcagaacatgtggacaacagagtaggtcagcatgattgaacagtgaaaggtttatgtcagatgggttcggggtggcagtatattgtaatgatggattgaatgagtgatctaaaatcatcctagcacagtataattgtaacagttctttttttttttttttaagacagagtctcactctgtcgcccaggctggagtgcagtggcgtgatctcggctcactacaagccccgcctgccaggttcacgccattctcctgcctcagcctcctgagtagctggaactacaggcgtcagccaccacgcccagctaattttgtgtttgtatttttagtagagacagagtgtcaccatgttagccaggatggtctcgatatcctgacctcatgatccgcctgcctcggcctcccatagtgctgggattacaggcatgagccactgtgcccccggccataattataacaattcttgagggccaattatatgccgtcactttgagtgttttgcagttattttctcatttaattctcacgttgaccctatgaggtgactattcttattattctattttatagctgagagagctgaggtctaagtaacttgagaaggtgatagatgtagtaaggagtagagtcaaaagatgcttccaggtggtctggctctagagtctttgctccacttagaattctaagcttgctttttctgtgtgctcttttaaacactcagagctttgaaaatcaaagagttaatcttttctgtttttatctccctacacaaacagtagtaaaatggtgacattcgtgcatctatgccccactctcaagtccagggaagacagttctgtgatacccacttcccttctgagccagactcaccctcagatttctgctctgcacagggctccagcctccgctgccagtggatgagagaggggaggcctcctagacccaaatctaagccattgtctgcagctcttgtcttttaaacctcttaacaactacctgttttagttatatacctgttataattacatacttaatgtatgtgccttaagcaaatgtattcctgtaaagttttatgtaaataatgaatttaagtgtaatttaattttttttttgtagagataggggtcttactgtgttgcccaggctggtattgaactcctggtctcaagtgatcctcctgccttggcctcccaaaatgctgagattataggcatgagccactgcatctgacctgtaattttttttttttttttttgagacggagtctcactctgttgcccaggctggagtgcagtggcatgatctcggctcactgcaacctccaccgtccgagatcaagcgattctcctgccttagcctcctgagtagctgggattacaggcacctgccacgcctggttaattcttgtattttcttagtagagacggggtttcaccatcttggccaggctggtcttgaactcctgacctcatgatccacccaccttggcctcccaaagtgctgggattacaggcgtgagccactgtgcccggcataatttttttattattctgggaaagcttcctatttaaagggtcccagtgataatttcttttgtaaagagaagaatctttgtataaaacaaatgattgtttcctagattatattaataaaatacggatttttcacacattacttttgcataaacatagttctagctaaatacatatttgatataaacatgccaaaatgaaatttgatcttatattgtgcttcatattactaataaaaaaggattgaataatagttttttccttgaataaatgtcatttgttggatttgcactaaaatgtgcttttgtaggcttatctacagtaagaataatattcttttaggcagtaggttgaggttcaatatgtaacacaatagtatattattttgttataaaattcattaggtaaatgctagagttctacttaagtgccaaaatcagtattttatgattctgaaataaattatctgaaaataacaaagtttagagagataacttaaaaacttacagttgaaagacaaactagtctttgaaaaaaatatttttctgtaacaccaggtaaaatacttatttcctgtagttaatataatgctaatgaggtcttgatcccagattcattgtaatttgtgctgtgtccctaaacactcaacagtgactactctgtaactaattaatagatccagtggcctcatttagagcattattcttttccaacctcttcatctatttctttttttgttttttagagatagagtctcactctcatcctggctggactgcattcgtaccattatagatcatggcagcctcaaactcctgggctcaagtgatcctccacctcagcttcccaaagtgctgggattatggatgcgggccaccatgcctggtctctaaattcttactgtgtgattcaaaatcctttttgacctatcttgccccactttttcactatagcactcatcacacctgtgccattctccttcgctctagccccgttggcctcttccccaaacgtgtccccattctcctttctccttagtcttgttcaaacaaaccctttgtctggagtgcacttttctttagtcattcttacccatctttcactacctgcttgaattaaatctttgaaagtagccaccccaaatttactatttggaattacactggtattataatgtacatcaaaggttctgtgatgtatgtgtatcttctttcattcttgtctactctacctagattgtgaattactggagggtataaactgcctagcgaggggctttgtaaggttttttttgatcagtggatctcaggtctcaggactcttttacacacttaaaaattactgaagactgcgtattttgtttatgtggattatatctattgatattcactgtattagaaatttaaaaatgatttgatccaggccaggcactttgagaggctgaggcaggcagatcacttgaggccaggagttcaagacccgcctagccaacatggtaaaaccccgtctctactaaaaatacaaaaaattagccgggcgtggtggcaggcacctgtagtcccagctactcgggaggctgaggcaggagaatggcgtgaatccaggaggtggagcttgcagtgagccgagatcatgccactgcgctccagcctgggcgacagagctagactccgtctcaaacaaaaaaaaaaaagagagagagacttgaaggtcagatagctaaccactggcagaactgaaagttaattcataagtctcttagtttggagttcatttttcctgtcaatattgtgcagttaaaaaatttagaggtaatttcacatataaggctatgactaaaaaaaaaagcttttttttttttttttttttttttgagacagagtcttgctctgtcacccaggctggagtgcagtggtgcaatctcagctcactgcaacctccaccccctgggtccaagcgattctcgagcctcagcctcccaagtagctgggactacaggtgcacactaccacgcctggctaatttttgtatttttagtagagatggggtttcaccatgttgaccagactggtcttgaattcctgacctcaagtgatctgcctgcctcagcctcccaaagtgttgggattacaggcatgagccactgcatctggccaaaaataaacatttctttttgtgctataatataataaaattctgtagggaagaaatttctgaactcttacccagtgctctagaatcaagtttcatctatttgtttcacctcttaaaaaaaaaattaccagaagtgatggtatgtgcatctagtcccacctactcaggaggctgaggtgggaggattgcttgaactcaggagtttgaggctgcagtgaactatgatcatgccactgcactgatacagcaagaacttcaaaaaaaagaaaaggctaggctcagtgatttatgccagtaatgcaacactttgggaggttgaggtgggaggatcatttgagcccaggagtttaagaccagtctggacaacatagcaaaacctctctactaagaataaaaaaaaggttagctgggcgtggtaggtgtgtgcctgtagttccagctattttggaggctgaagtgggaggattgcttgagcctgggagtttgagatggcagtgtgatataattgcaccactgaacttcagcctgggcaacagagtgagactccgtctcaaagaaaaaagcaggctgggcatggtggctcacacctgtaatcccagcacttttgaaggccgaggcgggcagatcacttgaggccaggagttcgagactatcctggccaacatggcgaaaccccgtctctactaagaatacaaaagttagctgggcggggtggcgggtgcctgtaatcccagctacgtgggaggctgaggcaggagaatcgcttgaacccaggaggtggaggttgcagtgagcagagaccacaccattgtgctccagcgtgggtaaaagaactagactctgtctcaaaaaaaagaaaaaaagaaaaaaactagtagacagtgtaacctacacatatgtgtgtgtgtgtatattttatatatatacatatacagatatatacacttaaaaattaatacagtattctaacataaaggaaagttattaaattattaattatagtaattacattaatatattgtttatttcagtttgtgaaggtgcaggcagtcctttactacaaggcagaataaagtagtcagatgctactaacatctacatgtagaataatcatgaatgcagcagctgtaaattagactaatatgcaagtattgtaattggtgactcaaatatctttattagcattgctctataatgtgatttttccagcatgatgaacaccttttggtaaagttccaaataaaggacagtcttctttcaatttatgtgttattgtatgctttttagtcagtgtgtgttaaagcaatgcaaaaatattttaaatatatgtacacatatattggattagattctgggcttacctatgttctcctctgaatttgctgttcattttaccttctatacatcattagtggcatcacaataatttgaaaatttgaaataaaaagttcttggcccatacccacaggagctggatcagtttgtagcatcctcacagacatttgtgctggctgcagtatttttatttttttgtgtcatcttcctcaattcattctttttttttttttgagatggagtcttgctctgtcgcccaggctggagtgcagtggcacaatcttggctcactgccacctctgcctcccaggttcaagtgattctcatgcctcagccacctgagtagatgagattacaggcgtgcaccaccacgcccagctaatattttgtatttttagtagagacgagttttaccatgttgactaggctggtctcgaactcctggcctcaagtgatctgcccatcttggcctcccagagtgttgggattacagccgtgagccactatgcctggccctcaatttattcttgagtgttgcattcctgtctttaagtgagacactgaagcttttacattctgaataataatacatataaataaataataagaatgaatataaaattaatgtttcatttaaagtgatgtaaatgagaaactataatagttataaatagtatatggttcataaatacacatgatttacaaattcctttttttttttttttttttgaggcagagtctcactgttgctcaggctggagtgtggtggcatgatctcagctcattgcagtctctgtcttccgggcttaagcgatcctcccaccccagcctctgagtaactgagactacaggtgcgcaccaccacacccggctaatttttgtatttttgtagtcaggcttttgccatgttgctcaggctggtctcttaacttctgagctcaagccatctgcttgccttggcctcccaaagtgctgggacttcaggtgtgagccattgcccctggccacaaattctattcttaagcaattaaattggtggaaatttcttgcatttaaaaaaaatgaatttactacagaaattatattttgcctcccaaaacactttcaccatttttaaaaataatgaaataaggtttgttgcccaggttggtcttaactccgggtatcaagtgattctcctgcctcagcctcctaagtagctgggattacatgttggaagagctgcccagtgtgtctgcaataataaaaaagaaactgaaacattttaccagtttgcatttgcccaggagctatggtgatcttctttgagtccttccaattttagtatatgtgctgccaaagtgagcacctctcagtgtttttatgggtgtatctattgcagaatgcataaataacttttttacctgtagttttagaatatttggatgttaataatctgatctattttgcacctgaatttaaatacaagattttaaaaaatttcacaaaagagttttcctccaagtgtaaataattcattttattttattttattttattttattttattttattttattttattttattttattttattttattttatgagatggagtcttgctctatcacccaggctggagtgcagtggtgtgatctcggctcactgcaacctccgcttcctgggctcatgtgattctcctgcctcagcctcccgagtagctgggactacaggcgcctgccactatggctggctaattttttgtatttttagtagagatggggtttcaccatgttggccaggttggtctcaaactcctgaccttaagtgatccaccagcctctgactcccaaagtgctgggattaccggtatgagccactgtgcctggccaataattcattttaataccttcaagggatagtgagtttgggaataagcaaagggagtagcaaattattgctgtaaaatatatgaactatatatgaactattttgccatagagaatgtattagtctggtttttgtgttgctgtaaaggaatgcctgagactgagtaatttataaagaaaagaggtttaattggcacagggttctgtaggatgtagaagcatggtaccagcatctgcttctggtgagggcctcaggaagcttactgtcatagtgaaaggcaaagggagagaggttgttgtcacatggtgagagtggcagcaagagaaaaaggagggaagtgccacactcttttaaacaaccagatttcttgtgaactcagagcgagcactcactcatttgtgggggtggcaccaagccattcatgagggatctgcctgcatgcctgaaacacctcccatcaggtcccatctctaacatcggaggccacatttcagcatgagatttggagggagcaaatgtccaaaccatatctttccaccaaatctcatgttcttttcacatcgtaaaatacaatcatcccttcccaaaagtccctcaaagtcttaactcattccagcaagaccaaagtcctaagtctcatctgagactcatctccttccacccatgagcctgtaaaatcaaaacaagttatttacttccaagatacagtgagggtacaggctttgggtaagcattcccattccagaagggaggaattggctaaaagaaaggggttacaggtccctgaaacccaacagggcagtcattaaatcttaaagctttaaaataatcccctttgactctgtgttccacatccagggcacactggtgcaagtcgtgggctcccaaggtctcgggcagctccactccctctgctgctctcaagaatagaattgagtaggctgggcgtggtggctcatgcctgtaatcccagcactttgggaggccgaggtgggtggatcacgaggtcaggagatcgagaccatcctggctaacacggtgaaacccgtctctactaaaaatacgaaaaattagctgggcatggtggcacatgcctgtaatcccagctacttgggaggctgaggcaggagaattgcttgaacctgggaggcagaggtttcagtgagctgagatcgtgccattgcactctggcctgggctacacggtgagactctgtctcaaaggaaaaaaaaaaagaatagagttgagtgcctgtggcttttccaggttcaggatgcaaactgctagtggttctgtcattctcacttctggagggcagtggcccccttctcacagctccagtaggtggtgccctggtggggactctgtgggggctcagaccccacatttcccttcctcactaccctagtagatttctctgttagggcttctcttgcttcgtcttcttgcttctgctctcaccatgtaacaccacccactctccctttgcgttgcactatgattgtaagcttcatgaggccctttccagaagcagatgctgcagccctgcttatacagcctgcaggactgtgaagcaattgaaactcttttcttaaaagttatcctgtgtcaggtattccttcatagcaaggtaaaaacagaccaacacagagagattgttataaagatacaaagagaaattccgtaatgagatacctagttgaaaacagccagaagtaatgttctcatgttgtttattatatatagtatttgttgctctgtatgtggtattcaaacttctaaactaacctcctttaggtttgtttgtttgttttgagacagagtctcactctgttgcccaggctggagtgcagtggcatgatcttggcttattgcaacctccgcctcccgggttgaagcgattcttttgcctcagcctcctgagtagccgggattacaagcttgcaccaccatgcctggctaattttcgtatttttagtagacatggggcttcgccatgttaaatagtctggtcttgaactcccgacctcaggtgatccaccagccatggcctcccaaagtgctgggattacaggtgtgagccagtgcccttggcctcatttagttttataggcattttccaatgaccattgtttgtgtaattgaaagccagatgtcttttaactgatttatctttcctgattatttgatgtcacattggcaatttagttgaatcttgatggataacagtataaatattttgatgttgttgacgaggatagtattgatagcttaccccaagacacatgtgtaagctataagataacagcacttttttttttctttttttttttttcccccctgagatggtctcactttgttgcttaggctggagtgcagtgatgcaaacacagttcattgcagcctcgacctcctgggctcaagtgatcctcccgcctcagcccccaagtagctgggactagaggctcatgccaccgcgcctggctaatttttgtattttttgtagagacagggtttcatcatgttgtccaggcttgtctcaaactcctaagctcaagtgatctggccgccttggcctcccaaagtgctggaactacaggcgccagccactgcatccagcccagaaattttcttaataaaaaggattcttcaaagggttttttttagtggcctccactaaattgtgtgtatagctcccaggagtttaattaataaacaaaaggaaaagagtgaatatgtattttaactcaaggtacatttatctgtagttgttcctcatcaaaactgcagtaactgtatttagatattagatgctaaatgtatttctctctaaatagagtttagagagaaaaaatcagctacacaaagatagatcctaaacaattaagaatcctcccaaattttaaaagacagtatgatgaaatctttcccttactcctgtttgcagtataaatgagattgaggttgactttctgaataattatttacaggaaaacaatagaattcacatttgatactgtgagaagtcaaataatagaattctagggttgagatacctgtgctacagcttaaaccattaagtcccatatcttggagggtggcatttgtcagtactttttcaaagatccccaggtagttccaatctgcagttcaattacttatcttttttaaaaattaaatctttgtaagtaaaactttcttgtcaggtgttgaggaaactcttggtaaccagaatgttttaaaaatttagtttttgtgtactaatttttaaaatgtatggtatcttgtggaggagttaaaaaagtagaacactctctgggatagagacttaagaattatttaaaattattaaaatggtacacttgatacaaaatttgaaagtagaaattaattctgttgaaactaatactgttgagtctacttttctgtttctggcctaccgtatctaaaccactctaaacaggtcactcacttgttttatccttattttaatgagcttctgagatgaagtttctgtaacctctttttgtctcctgtttgtcacaaagattcttcatgtcttacctaaattgctttgtttacattctatgttcggagatgtaggtaggccatttgatcattgatgtgagtatacacactcatacactatcccccacccccgtcgcacagtttaaagccttctcattcgcatagataattttgtaagtctgaatagcctaatttagataaactttcttcgtagttcaattagaaaactctccattttgagtgcttggttaggttttaatataaaggaaacattttacattaggaatcattgttttactaaccttactgacaaaaagaaatagtgatgaggaaatgactaaaaccagttcagacagtattgagcatccagatactacaagggttgagaacagacgggactaagaacacatgtggagaagtcagctctgaaaagagttttggatcaccttcaggtataggtggatgaagttaccgatgtgttttcagttggagaggcagagtgttgaggaattttatacctattgtgttgtatttttctgtcaggtaggcattaagtcatcttgattttctgtaggatggagataatattggacccttcaatgaagtgctaaagttttgagatagtatttgaactgtgttggtgatctttataattttagtaaatatacttattattaaagcatattgttcaattatcttgttcaaataattggatttttaagtgtatttacttgactttttaggaaatgtttaaattgattctgtgaggtaggaaagtgactataggtttatctatatgtgtttctgatagtcaaaaaaagatgaagtaattgtcataattgtgacatagaatccattagaagtgaaataatatagttggtgcaaatactatgctagtgataaacatgagtggtgagaatgaaacagattcttcccaatttgaactttcatattctggtaggcaggctgtttacatgtgaggatatttttaacacttgattgaatttctccaaattttatataaaataatgagtatccaattatgatcagtagtaaataaaaagtggaatgtttgacttaacactcaactctgcagctgaaccattgtggagaaactaaggttcggaatgacagccacacaagttagagaagattttaggaaactggaattgattaccttgaaagaaataagactaatgaggtgattcagacatgtttcaaatgcagaaggtagtgatcatgtatcaatcagtattttttggtgaaaacagtagaaggcttgatcttcagctgcattcagagggattttagactagtttgttagtttattcattgagagttgtttgcctgctatgtagaggcacaatgccaggattgagagatggatttgtgagcagtacagacacagtcccaccatcatcaagcttatgttgcagtagggagatggacattaaacaaccttttatcatatggttatgcttcagtggagaagttctgtgggtgctatgaaaccatattagagaggaaagatgtgagaaagagcagtgtaagatggtggcaaaacattaggatgggtgacggaatacctctgtgaactaatcaggcctctttaaaaattcacccttcccaaactacaaaatcaacttatttgttcattgtggaaaatccacaaaaccaaaatgaagtgaataagaatctttgatatttctattacatagagataatcactagttttttagaaggccttaaaaattaaatgcattttcatctttataaggtgactgggaaatttcatttctagacctggaatttatggttgttgtttctctgactaatgctgctgtatcaagaagagtaattatcataatgatactactgtaacaccttgctatagccccacttaataattgcttgatgaattatgtaaatgaatgttcattcatagtccaaagcaaatagttttttgagatgttaaatataacaggtaatataaatgcttttttacataataaaatgtaatgaacttatttttacataataaaatggtatatatttttctaggtgaatgtaatttaacagcatgatagttaacatttttgtaccaaataggattaatgatttttattaattatagccctgtataaatttaaataattgatagacccataatccagtagtttgaataaagttatctttacttttgacatgttcttttcatgcatttctgtctttctaccactaaattgctgatattcatttactttccattggatcttttttgctaccattagagaatgaatgcaatttaatgttttatgtgaccatttagacctttaaatattgaaatacattaaagcaacatgggtgtttttacttttcatgtaacaattgtcttcttacctttaaaaaagtagcttcttaaataatagttaaaattttatggtatatttgttagagattttccttaaagaggaaaatcaaggaattgaagtcttccccttagctttaattttaatcccttccccccacttttatgaagtggtgcttaaaactgggggagtttattgagaaattattattattattattactatttttttttttgacggagtctcactctgtcacccaggctggagtgcaatggcacgatcttggctcactgcaacctcttgtctcccaggttcaagcgattctcctgcctcagcctcccgagtagctgggattgcaggcacatgccaccacacctggctaatttttgtatgtttagtagagatggggtttcaccatgttggctagggtggtgttgaactcctgacctcaggtgatctgcccgcctcagcctcccaaagtgttgggatttcaggtgtgagccaccacgtccggtgagaaattattttatgtatacaagattatcctttgatattatcatttatacattgtaaagaaggtgccgtttttgcagtgccagtagtcccaatagtacagtgagttctctccattaagtataatcctcccgggatttgggatttgtggttgccatgttgccactggtaaggttagagtcttcataatagccgagctgagcaaattcttccatagcaggcacagaagaaattgtgcaggtcacctctgggtcaagaacttatacagaagataatgctgccttggcttctggcactggggggttgggctggcccttgtctctggatgcttcaaatgagatgcattggcaactgtccaaattggaaataaacttctcaggttccaggcctcccttggctctgaggcctgtgtacgggagacagcagcatctggggtggatgcctgctttaccaaagatcagtctccaaccttgagggctgtgctgcttatctgttgacagttggggagcagattgccaaatacaggtcaggaggtgtatatgacctataaaagggtcttctccttttccagttaggctgctcagggcttcagctttattcagttgttcaattttattttgttattgtttaacaattctgatgtctagttaaagtttagtaatgcattggtttgagggaatatggtctgagtcacaaatccatagagctactattatgcagggatggaaagtggctttttaatggagttgaccaatctgttcctaatatgagtaattagtgatatttacaaggtagcttgaatcctgataggcagagcacactggtgtttttcgttttgttttcatggaatgtgtagcgtatcatttctttaagattttatcctactcatcttttaatactccattcaaaatggagttcctgtgtcctggtccttgtccttcactgctcccccgagcaccatttctaggactactttatgtcagtactataaatattgctgtacattgtggtgtacttgtctttctccttttgtaagttgtaaacgcttgattttattcttgtgtcttcagggcctagtacttttccctgttagaatagatgctccataaatgtctattcaataaataattttatcctgtgcactgtgaatatattgtcactttttaaatattgttttctccaaatataaattctaggccatcctatcaacataaaatttctcagaggtggtaagattgggctagtcaaggacttaatgagcaagggaacttataatactattttttaaaaaagaatattagcagcaatggttagaaagggttaaagccccataaatctttttgaataacatctgtttacattgtgttcattttaagttaatcagctaaaaagtgaatgcatccttttgccaaccagaaatcaaaataatacagcggttggcattcccctaggccaccacctggttgctcttccctatttagaaactaagcactactatcattttggtgtgtatatgtctgtcttttactattacttacatttttagtcttgtagaaacgtgcagtgtgtgtgtgtgtgtgtgtgtgtgtgtgtatgtgttttggtagagatggggtagtgctgtgtttcccaggctggtctcaaattcctggcctcaagcaatgctcccactttggcctcccaaagtgctgaaactataggtctgagccactgtgcctggccttgtatgtgttttttgtttatttgtttgtttttttaacatgaaagatcttgtactccataaaatgttttacaattctatttttttatgtaacaatagctcatgttggaagataaagattcaccttactttaaaaaattattgcatgactctctgtccagatacagcatagtttacgaaaccatttttttaatcgataggtattcagatggtttgtggtttttcctctcttaacagtgctttagcagatatccttggtgtgtactaagaaatactggttcagaggatttaccagtttatagtctcaaagtgagaacaactcaatgtggcaggtttttaattttcataactgtgatggatgagaaaagtatctcattgttaaatgtattaatatctttcttaagggtacatatcagaatttacgcttgtgtcttcagggcctagtactcccaagctcaagtgataaagatggatcactttatcaagtgataaaaatatggtttcctggcataattatttacacaaatgtggctggctgtttgaaacacagactttgggtttaaaagatttttttaaaaagttgagtttgtgatttctttctctttttttctttttcttttctttcttttttttttgaaacagggtctcactgtgtcacctgggctacagtgcagtggcgcaatttcagttcactgcaactttgacttcctgggctcagatgatcctggcacctcagtctccccagtagctgggactacaggtatgcgccaccacacccagctaatttatatatatatatttttttttgtggagacaaggtttcgctgtgttgcccaggctggtctcaaacttttgggctcaatctgtctgccccctgtggcctcccaaagtgctagaattacaggcataaaccactgcacccagccaagtttgtgattttatatgaagaaacacttattccctgcccccaattcattttagtttagcttataatacaaagaaaaaagtattctttgttcttcagtttccagaatgaaattatttgaaggccaagaccgtgggagacagtttcaaacttgaaaaaacagtttaatacagcatagaatcaagacaccatattatattctgatttagagaaatggatattttgattgttaattacttataatggccaaggtataagacaccttacaaatattgtacaatatggtatttttttttaatttaaaaattgaaacagagtcttgctgtattgcccaagctgatcttaaactcctgggcttgagtgatcatcctgttacaccctcctgagtagctggattacagacgtacatcatcacacccaatgaatatagtatattgtcttctatattttatggtttcttaagaattttgcagtaagtcaacagttttgtttaattgctttatggtattttgtttatatatatgtcttgtattggcttagtgaatataagtaaaataaatagttctaaaaaatttctggccgggcacagtggctcacgcctgtaatcccagcactttgggaggccgaggcaggcggatcatgaggtcaggagattgagaccatcctggctaacatggtgaaaccccgtctctactaaaaaatacaaaaaaaattagccgggcgtgatggcgggcgcctgtagtcccagctactcaggcggctgaggcgggagaatggcttgaacccgggaggcggagcttgcattgagcccagttagtgccgctgcactccagcctgggtgacagagcgagactccgtctcaaaaaaaaaaaaaaattttttttctgcctttttctaatttcccgaagagaaaaaaaggcattgaaagtgaaccagaatataagctaattattctcctaattacttctgttgccatttgagtttgtttgctaatgaaattcttttttttctttttttaaatacttaaaaaaaaaatggaggccagctgcagtggctcacgcctgtaatcccagtattttgagaggctgagacaggaggatcctttgagcccaggagttcagaccagtctgggcaacataaatcctatctctacaaaaaaacaaataaaaaaatcagctgggtatggtggtgcatgcctgtagtcctagctgcttgggaggccgaaatgggaagattgcttaagcccaggaggttgaggctgcagtgaaccgtgatcccgccagtgcattctaggctggatgacagagtgagactttgtctcaaaaaaaaaaaaaaaaaaaaaaaaaagagatagggtttggctacattgttcagtctggtctccagctcatgacctcaagtgatccttccatcttggcctcccaaagtgctgggattacaggcacatgccactgtgcctggtgtaaattcttaataaaaaacgaggccgggtgcagtgtctcacacctataatcctagcactttgggacgccgaggtggtcagattacctgaggtcaggagtttgagaacagcctggccaacatggtgaaacccagtctccattaaaaatgcaaaaattagccaggcgtggtggcaagtgcctgtggtcccaactacttgggcggctgaggcaggagaattgcttgaacccaggaggtggaagttgtagtgagccaagattgtgccactgcactccagcctgggtgacagagtgagattccatctgaaaaaaaaaaaattcttaataaaaactgttgttttaaaaaaatgcattttgagacagcatatctgttttaattgactgagttgtctttcatttttgatactttattgtaatatgtcattttcactttaggaactatatattgtgttcattaaccttagtgttttctttttttaaattctttttctatggctgtttaaaaagaaaagtagaaagaaaaaggttttatgctttagtcatttcatgtggtaattattacagatctctcatttctcccttgcctgctattcgtttagtttacagtgctaaatgacttacctttttcttaaccagtttgttgctgtagcttgttacacttttcattcttgctgttatcccatctctagattcaagtttcctttttcttctttcccttttaagcctgtttttatgtgtccttattttcttgccctatatcttactgctgtatgtactgtctcttaagctgaaaacaaattctctctgtctggccaaggattctggattctgactgtcttcatggacctctttgaaatctacttgttgcaaaataattgggtaatgggggctggaggtctaggaaaaaaaattgggtagtggcaaagatcattgttaaatcagcacactttaaatatgtgatgtggccaggcgcagtggctcatgcctgtaatcccagcattttgggaggctgaggggggcggatcatctgaggtcaggagttcaagaccggcctcgccaacatggcaaaaccctgtctctactaaaaaatacaaaaattagctgggtgtggtggtgcacacctgtaatcccagctacttgggaggctgaggcagaagaatcactgtaacccaggaggcggagattgcagtgagtcgagattgtgccacagcactccagcctgggtgacagagcgagactctatctcaaaaataaataaaataaaataaataaatatgtgatgtgaaaatgttacttgatattaatttttttgttctttatagagacaacataaggtatatgctggatttgaagttttgtgaagataaactaatactgatatacatctgttcctccagaaactttaatcttctctgaaactttgttacaggttttaactgaacatagagctatgtttagccatttgggttgaagagggcatttactactcatcccttcaatcaacaaatatttaataattccctctatatgatatactatgttagatactggctgcttatgaataagcagtatgtaatcctggaccttaaactctaaggagagattaaactttttttttttctttttttttgagatagagtcttgctctgtcacccaggctagagtgcagtggcttgatctcggctcactgcaacctccgcctcccaggttcaagtgattctcctgccccagcctcccgagtagagtagctgggactataggtgcacaccaccacacctggctaatttttgtatttttagtagacacagggtttcaccatgttggccaggtcggtctcaaactcctgacctcaagtgatccgcccacctcagcctcccaaagtgctgggattacaggcataagccaccgtgcccagccgagattaaaatttaataacaaaattgggccttgggcatctaaaaggtcagtaaaattgattattttgagaataaagtagaaaacaaagcagagagagactaacactatgtaaagttaaaagtaggttcatagaaaggggtacctaatcctgagaagggttagagtgaatgacttcggggaggaggagagatttgcttaatttttgaagcagagagtagaaatgcaatacaggaagaataggggagaggtctttctggcaggagtacaaattgtgtgcatggaatggtgactcttcagtggcctttgtgcacagcagatatgctacgtatagaggatacccttggagaatttgacccattctgtaacagtgagagggatattttttgagttcctccatctccagcatggagttgacacgttgatctctgctggggataactcagctttccaggttttcaaggttgcatgtgtttcctccagtgtcatttggagaaactgtttctgttcaagataagataagacaaagggggctccgtgggtggctcatgcctgtaatcccagcacattgggaggctgaggcaggtggatcacgaggtcaggagttcagagaccagcctggctaatatggtgaaaccctgtctctactaaaaatagaaaaattagccgggtgtggtaggtacctgtagtcccagttattcgggcggctgaggcaggagaatcacttgaacctgggaggtggagcttgcagtgagccgagatcgcgccactgtactccagcctgagcgactgagcaagactccatctcaaaaaaaaaaaaaaaaaaaaaaaaaagataaaggaatggggggagtggcgtgtcacctaaaccacgtgtggacagatgaggactggtgctggagttcagagtgaaactaattattctgagtaaccttactctaaatattatagtgaggtgagtcatataaagtatgggcaggaaattgagatgactttgggatgggttgctcagttctctggcttaatgaaaatttcaaaaaacatattttcctttgcattttgaatctgactttgtgctggggattttgtttgaatttaatgatagaccaaaatgcaattactgtacacattaccttaatgtgtgtcagtttaaaatagttttatattgtcatagattttgtggatttatcttggtttcttataccaagataaattcttaccttacactgtcttttactgtctcttacccttattatattcaagattcttattgctgctgcttccacataattttttaattctttttttttggaaggggcaggacagcatgaaagtattttttttgtcattctttatagctggttaaaaggaaaaatggaaagaaaaaggtttatacttgagtcatttcatatggtgattattacggatctctaatttcttccttgcctgctattcatttagttttcagtgctgaatgtcttaccattctcttaaccagtttgttgctctgcttgttacacttttcattcttgctctgttatcccatctctagattcaagtttcctttctcttctttctcttttccctttttagcctgtgtttatgtgtccttgttttcttgccctttatctattattgctgtgcatactatctcttaagctgaaaacaaattctctctgtctggccaaggattctgagtgtctttgtggatggacctctctgaaatttacttgttgcaaatttagtttttcacaaaagaacaagtgatagtccttgataatcctcagttagctagttagcttttttttttttttttttttgagaagacagggtcttgctttgtcacccaggctggagtgcagtggcatgatcgcagctcactgcagccttgatctcctaggctcaagtgatcctaccacctcagtctctggagtagctgggattacaggcatgcgccaccatgcccagctaatttttaatttttttttgtagagatggggtcttgctatgttgcccaagctggtcttgaactcctgggctcaagcgatcctcttcccttgccctcccaaaattctgggattacaggtattagccactgagcctggcctcccagatagatttttagtctttcctcagagtgcctctagttttctcctaaagttttagtttttctatcctttgggaaatagcctataggcacaaggtcttgttttgattttgaatgggaaatattgcctgggtcacatggttgggttcactgaaccggtaacccaacttgtggaaattaggacgtcgaagtagacttgttaagtggtgctttcagcatttctccctttttctcttccggtattttgatgatggctcacagggtagaggtctttattttaataatgacatattttccagaagggatagtttccatctctgagatgacatttgatatcttcttttttttttttttttgccatttaaaatatcccacttacctcagtaatgttgacacataccataattagtaagggcctcgggctgtgtctaaaaggtcaataacattgattattttgacaataaagtcaaggttcctttattaatgcctaggatccacctatcattttgatgatcatttagtgtttgcaggcattatgaaagagttggaaatttatcatctagaccacaacataattacatgacctttatttgtgaattttttaaggtgaggggagcaaaaaggctgtgtattaggaagaggtcagatttctgccttatggttgatgggatgaggaaagaagtttgagtatagttcttgtttatcagagtttgtcttaagtgggatcatggtggagggacttttttatttttatttattatttatttatttatgagacagagtcttgctctgttgcccaggctggagtgcggtggcgccatctccgctccctacaacctgtgcttcccgggttcaagttattctcctgcctcagcctcccgagtagctgggatcacaggcgcatgccaccatgcccggctaattttttgtatttttagtagagacggggtttcaccgtgttagccaggatggtctccatctcctgacatcgtgatccgcccgacttgggctcccaaagtgctgggattacaggtgtgagccaccgtgcccagccatgactttttatatgagtagccagagagatcctgaatgggggagactttatttgagggacttggaattgggagggaagtttgaaaaaaaaaataggattggacacagagaatggaagtgaagttgaaagccagaattaggagtgtaatagaatcaggctggggaaagccagctttccataggatatggcagtatggagaagagcaaagtgaaagggaagtttgcccggcgcggtggctcatgcctgtaatcccagcactttgggaggccgaggtgggcagatcactaggtcaggagatcgagaccatcctggctaacatggtgaaaccccgtctctactaaaaatacaaaaacaaaattagctgggtgtggtggcgggcgcctgtagtcccagttacttgggaggctgaggcaggagaatggcgtgaacccgggaggcggagcttgcagcgagccgaggtcgcaccactgcactccagcctgggcaacagagtgagactccgtctcaaaaaaaaaaaaaaaaaaaaaaaaaaagagggtggagctgaggaataaagtatcagctgaagattgcggggtgtagctttagtttgaaactttgttatagagaaactaaaagtgatttgtggtttaatttgttaatccttggaattggtggggggcagtgtaataatgtaaggagttactttataattccttatgcttttagtattcagtgcacactttcatttgttctccaaatatggatttatatagtgtttttaattaagtaaatgtaaattatcattttttcatctagtcatttattcaagggatattttattgagcatcaactgtatgccaggctcttacaactcaggaaaagggagagagagggatgtatattaattgctgtctgttctattgctgggcaaacagaggaatgaatttagtataatgtacaagttacattggttttatatgtagcttttcccaggctaatctttggaagcacagagtagcaagctttctcctatttaaaaagaaagtcataagaatagctggaaattatcctgaaatgtattcttttggaggaagtagtatagtgtagtaattaagaacacaagttcttaatttgtcaaatttatacatcttttcctttgtgattaatgttgttttggatcctagttttttgttttgttttgttttttggtcttttcttttcttttttttttttttttgagactgggtattactgtgttgtccacaccagactgcagtggctattcacaggcgtgactgcagcctcgaaatcctgggctcaagcgatcgtcccgtggagctaggaatataggcacgtgctaccactgcctggcttttgcgttctgttaatttttttttttcctattgtaagatcatgaaggtaatcttctatacaaacttatagaagctttattgtttgcttttcacatatagatgtatgacccacctatgtataatttttgtatatgatgtgcagtaggactcaaattttattttttacccccaagtggatatccagttgtccccgtggcatttattgaaaagttcatctttccccattatctgcattgcttacttctgttgtaaattaaatcaagtaaatatttatatatttatttttaaaattaaaacaatttttttttgagatggagtcttgctctgttgcccaggctggagtgcagtggtgcgatcctggctcactgcaacctctgcctcccaggttcaagtgattctcctgcctcagcctcctgagtagctgggattacaggcacctgccaccacgcccagctaaattttttttgtgtgtgtgttttttagtagagacagggtttcaccatgttggccaggctggtctcaaactcctgacttaggtgatctgcccgccttggcttcccaaagtgctgggattacaagtgtgaactactgtgcccagcctatatatttatatatatataaatctttgctctttttccttggtctgtctgttcatgcactattaccacactgttttattgtggctttatagtaaatcttttcttcctgtctaggtcttcttgaagaatgtcttggctattcttggcctttgcatttctgcatacgttttagaataagcttgtcaagttcctggaagaaaatctgttgaaattttaattgggattgcattcaacctagagatcatgttggagagaactgacattttcagtagcattgagtcttctcacctaaggtcatagtgtgttgcttactttatttaggtctttgttaatttaataatgttttatagtttctttgtagtattcctatatattttttcttttcatttttattttgctcttaatttcatatttccagaagggctgcaagggctgtactgtacagtgaattcctgcataccctttacccagatttctcagatgaacaccttaccacattttctttatcattttctctttctctgtacatatacatacatatacacacgtcttgcacaactttttttctgaactttttgactgtaagttgacatgctgtccctttacccctaaacacttcagtgtgtatttcttgatagcagaatcattatctcatctgaccataggtaacagttatcactactatactttaaaatctgcagactgttttcggagttcacatgtctgaagcatgtcattcatagcaaagataagtcccagattctgcgctgcattcacttgttagtgctttagtctcacgtcatctggaatagttatttacctttctttgtgtttcacgaccttaaaatttttgaggagttcaggccatttattttgtaaagatgcctatgcaatgacatagcactacacacccactagaaaggctaaaattttttacacttatactactaaatgctagcaaggatgtcgaacaatgggaactctcatatgttgcttaccatactgctgggaatcctactcccaggtatttatccaagagcaatgtctacacaaagactcacatgtgaatatttgtagcagctttattaatagttaccccaaattggaaacaattccagtatccatcagcaaatcaacagataagcaaataaccccatgcagtgaaaaactactcagcagtaaatagaacccaactactgacagccacaacaacatgcatgaatctcacaagcattatgctaagtgaaagacaccagaactcaggaatacatgattccatatatatgaaattctagaacaggcaaaagtaatctccataataacagaaatcagataagtggtggccaggagctaagaaaggcaaatgaaattgactacaaagggggcatgagggaactttttgggggaatggaactattccatatatatatatatatgggggaatggaactattctctctctctctctctctctctctctctctctctctctctctctctctctctctatatatatatatatatatatatatatatatgtatttttttttttttttgagacagtcttgctctgttgcccaggctggagtgcagtggcacaatcatggctcactgcagccttaacctcctgggatcaagtgatcctcccacttcagcttcccaagtagctgggactacaggtatgcaccaccatacccagctaatttttatgtcttttgtagagataggagtctcactatgttgcccaggattgtattgaactcctgggctcaagtaattctcctaccttggcctcccaaacttgtgggattacagtttgagccaccatgcccggcctattctgtatcttgaactgtactcctaagaagttgaattttactatatgtaaattatacctcaacaaatgtgactttaaaaaaatcattagaatttggcacattaacagtgcaaaagtttccagcctgggcaacatggtgaaaaaacacaaaagattagctaggtgtggtggtgggtgcttgtggtcccagctacttggaaggctgaggcataagaatcacttgaacctgggaggcggaagttgcagtgagccaagatcgtgccactgcactccagcctgggcaactgagcaagactcatctcaaaataaacaaaaagtcattccagaaccacgttctagcatcatctttccctgagcttcttctgcctcagcccaatctcctcccaccagtctttctcacctttattcccactgtgtcccccacacactcttccagcagatcctgaaaaaaacgatattgcttgtatttacttatgttctccccactaaactgaagcaccctgatggtggggatatccgattcatgtaatgtaataccagctaatttttgtatttttggtagagaaggtgtttcaccatgttggccaggctggtcttgaactctggacctcaagtggtcctcctgccttggactcccaaaatgttaagattacaggcatgaaccactgcctccggtccagaatgattttgtcagaagaagccatttgagctaaagcgtagagatgggataaacctggaatacttggaggaacttggagcagttgagaaggctggagagtgtggacctgaggaaggaggtgggagaagggaattaaggaattaaggtggaattaaggaattgaggaaagaaataagcgtttgtcatgctattaaacaaattttttgaaaagcaaaggcaacatgatattccttcatatgcaatgtaacttcttcacaaaacccaaaaatgaacattattcagtatgctgcaagtaggttttactgatgaaatgaaggaagatgctgagaggtctctagactcacttgctatttagatgtctagtttcaggttaccaacctcaaagtactttctgcctttcaaatttagatcttcaattcattacagtaccaggtttcattgaatctaaaatatcatgaattctaaggtacacaattaatattttatatactgctaagaaagaaaaaagtcactgccaattaagtaatgacacatcatcaaatgctaaatacatctcaattttaaacgtgttaatgtgtgaaaaagtgcctattggagatacatggtctttcatttaatcctcataacaggtttcatgtacatattattcactgtatgtcatagcttttcatggtaattcgtattgagtaatcaaacctgtggttgttcactcttcgaatgctgaattataccgtattataatttagttaattaccttttattgttaaatatttatttccaagtttttttctttgttttgtttttcacctgcccctccctctccacctctttttttttgttaactgccgcttcggagaatataagcttttttaaaattaatttttatttataattgacacataattgtacatatttatggggtacaatgtgatgtttcagtgcttgtatatgtagtataatgatcaaagtatatttactgctttaaacgtgtcatttctttgtggtaacaacattcaaagtctcttttagctatcttgaaataaacactacattactatttgctgtattcaccctactgtgtaacaacaccagaatttattcttcctaactataactttgtacccattgaacaacctctcctggtcctccccctgtcctccaccctctttcattggtaagcactattctactctctacttttatgaaatcaatttttttagattccgtgtatgagtgagttcttacagtgtttgtctttctgtgcctggcttattttacttaatatattatcttctaggtccatctgtgttcctgcaaatgacaggatttcattcttttttgtggcggaatactatttacctgtagatgggcatttaggttgattctgagtcttgtataaataaacttttgattgttttcttaaggatagatgcctggaagtgaaaatactgggtcaaaaagtctaaactttcttatgactcttgatgtatatgcatatagtcatgttgcttttcaaaactactataccaatttaaattgtttacaatacttaaatgtgtaaattccatcttcattagcagagtatcacaataaatttgttttctaattctgtaggcagaaatagtatctctctcctttttttttttttttctttttgagatggagtcttgctctgtcacccaggctggagtgcagtggcacgatctcggctcactcactgcaacctccgcctcgtgggttcaagcaattctcttgcctctgcctcctgagtagctaggattacaggtgtgtgccatcacccctggcttatttttaaatttttagtagagatgtttcaccatgttggccaggctggttttgaactcctgacctcgagtgatccgcctgcctcggcctcccaatgtgtttggattacaggcgtaagccacttgcgcctggccagaaatagtatctcatttttcggaccatgtcaaaagaatgataacatctcattttagtatatattttttggattactgattagattgaacatttgatcacattaatttttgtaggagataattggtgtataagtttctggcattttcttgtgataataagtaaattataaatgaagaacagatgtaattatgcagatgtcatgacatttttaattgtgagatttattttttccctcatagtaatataatagctgtatatagagatattttttgagatggaatcttgctgtgtggcccagactggagtgcagtgggtcaatgtcggctcactgcaagctccgcctcccgagttcatgccattctcctgcctcaacctcccgagtagctggactacaggcgcctgccaccacgcctggctagttttttgtatttttagtagagatgggggtttcaccgtgttagccaggatggtcttgatctcctgacctcgtgatccacccaccttggcctcccaaagtgctgggattaaaggtgtgagccaccgtgcccggcctaatagctgtatttttaattgtaaagaataattgatgcagttagaaagttttggaatcctgtgaatttctaattttgatctgttgctcagttgttgatttttaaggtgagatttaatgttttaaagaattatgacttcaatatgtataatgtttgttgtctttttaatgctgggataaaattttaatgatttctaaccagtgtaaggctgtgaaacttgattatctgaaaattattaaaattataatagtatatcctaaaaatgtaataatatgtgctattccaagtggttaaaaaaatcgagacttaaatgataaaacaaagattctgctatattccttttgtcttaagtttattccattagtaaaaagtactcgatcaaggagactttgacttttttcaactgatgttaagaatgaaaaaagatatcttgattttatgtcataaggatgtgtttgaatacttgtgaagcagaagcatttggcatgaacagtttaaaattgttactatttatttgtgaacgttttaaaattgtttaacttgaacaatttaaaattggttacttctgagctacactaatcctagctattttaaactggctttcagcaatatatattacagtgcatacttgaatcatttttttggaacagaaaattggatgttaagtaatatttattaaaacgcagaatttttctgtggcaaaatatttctacagtgggctctgatagaaacagattttttaaagaaagtagaggggttggcacagttcagttgacagccagttgatggacaaagaggagccttgtcctagtgctctgttatgtggctatggatgagtcacttaaatttcctgcctgtttttgtttttggaaatgaaaacaataacactggttatggattgttcatattataaaaacagttaaattctgatgttctgccgaaaaattggttcatcagtcggttataattactgttgctacttggttctaagtttttaagttttagattaagatggatttcatggcttgatccagtccagcacattttaaatgatttcactttatagatattaattagttaccctggatgatgagaaggggttatcagtatcttgttaacaaaagaagctgttaaattattctcaagaatataaggtggactgtatacttattttttacaaagggaaaaaaggggaatttgtgccatggaaactaaagatcccatttatttttgtcattatgccaaaaaataacaacagtgttttctctctggcttatttagagtggtagagcttctttgacgtttcctatttctacctctgcttgtatcgagctgtagaactcttcatttagaatataacattttcaaatattgaaaaattacttttttttttgtgggattgccactaggtggtgggtataatatgtgaggaatgatcagcagtaataatagttctgatagtttcgggtacctatatttttacattgttgtgctttttcattattgtgtatatttgaacatttctgtgaaacttagtttcttttcataattattttgtttattttctttagagacaggatctcgctctgttgcccaggccaatgtgtggtggtgtgatcatagctcactgcagccttgaactcctgggctcaggtgattcacctgtcttagcctctcaaatggttgggattacaggtatacaccaccatacccagctaaattttttttttttaatttttttgtagagacaagatctcgtcatgttgaccaggcttgtcttgaactcctggccccaagtgatcctcccacctcagtctcccaaagtgttgggattatatgcacgagtcactgtgcataatgattttaaaatttcagagatctcaaaagatgttactgtaccctgggattagtcctgtttccccttagggaaaatatttccaattttataatgaaagttagaatacaagtcagtgacaacataatccacttacctgaaatgcattttacagcaaacttttaaagattaagttacaattcttatataagacaattatattactaaggattgaggcttaaaaaatgattaaaatgggctgagtgtggtggctcacgcttgtaatcccagcactttaggaggccaaggcgggtggatcacctgaggtcaggagttgagatcagcctggccaacatggtgaaaccttgtttctactaaaaatacaaaaattagccagacatggtggcgggcgcctgtaatcccagctacttgggaggctgaggcaggagaattgcttgaatccgggaggcagaggttgctgtgagccaagatcgtaccactaccctccagcctgggcgacagacactttctcaaaaaaaaagaaaaaaaaattaaaatgagaaatgtaaaattgtcagattaataaactttattaaacattcccaaggcaatgatgaaaataattaacagtgaattattctataaagatgtgtttccttgttaaacattggacttcttgataaacatggagaatgtctacgtacatttatatcttctttctcttctgaaacatcattagaatgatagtataggaattaaaaaaaattacatagttgggaacatccctaccaaaaagttagatgtgcccagttactctagaatgaagtcataggtctccatgtacttacatcgagctgctggttagctacttagtgactttctaaatatgaatggaaaacaagttgagaaaagcctttccatgagaaagaaaaaagcaatagaaggagaaaagcagccagaagtaatcagagacaatggagggaaagtaaaaatgtgactgtagaaataaaattttctgtggaagggttagaaagtcaagtggaggacattcccaagacggtggaataaagggataaatatataggtaatagaagagaaaagaggcaagagtaagagtggcaatcttatagaaggagaacattaaattatagacctcagaaggcaagaactgaataggaagacatctaaaaaatagaaagaatatcagaacattcctcattgtatgatttgtgcttccagactaaacatgttcttaatgtatgtagcacaatgaattcaagcaacacagagccatattatcatggaagtttagggcacccaggattaaggcaagatccttcaagctttcaagtaataggggtgaaataaaaaggggtacgaataatcaggaacctaaaaggcatagcagttctggatgctaaaatatatgttctcaaaatcttgaagaaaaatgactttcaacccagaactcaattatatgtgtgtgttcaatcagtaatttaagtatgaaggtagaacaaagaccctattgagcatgaaaggactcaaatacgtacctaggagcgagcagtgaagggaagccccagaataatagctggcagtagtttcagagagcagccaaacaagggaaggaggggtgggaggcactgttgttggttatataagcaaaaaaaataaaaaaaataaaaaaaaaaataaaatgtgctcttttatcacctaataagaaaattaatataaaatgcgtctttgtgaatcactgttaatattgaatggaccttgtgagaagattgtaattaatactacttcattgtgaacaactaaactgaagaaaaaaaggcttaagccttcaatgcaaagaaattcatccttcatgaagaattctcagtagttctaatggattctattccaggatggtaattcttgtgaagtgagaccaaattgtagctgagttgaattttaattgttgaataatcactgtgtaattaattccagagaatgactgagattatgaaatagtaactgagtacttgaactactctgaaactttagatttatctgaccttaatgcctacggacttaaagttgttagtgtaaagactcgagaatgaattttggtgtaggcggaaggcagcagctttaaaagaaatcatcctatgttggtggttaggagtcaaggcaaaatgcctgcagcaccgtagaggagagggtttttattgtgagatctactttaaaaaaaaccaaaagtttgcttacttttaactccggggaaactgaagctttttaacccataaataacattcctttgagatattgccatgctttatgagctgggaaggtgtatggagctttggatcatataatcagtatgatcgattatttttgtttatgaaaagttaactgtttgagtaactttttaagtgccttgacaaaaccattatggttttatcaggttttatagaggatctcagtaatgcataaattgtgtctgtctcaagtctttgtctgaaaattaaaaaatccaggcatactattccactgggagacattcccattataatgtttgatttattggctacttagcagaattttatagaaatctactttaaaagaaacctgactcccacctaaactttgccaactgtttggataaactttgtatttttatccatgttttgagaatctgttatattactgtatttctttaattttactaatccggcacatttgtgcaaaatgttaaattggagggcaagtgatgaatagatctgatttgagggtatttacattccaacagattggaacagtcagaaaaatctagttgctgagtaatagcattattaaaagatgattgctctactgaatttgctttttaatgggtttatgacacaaagtcccataagatctatggatactcaacaatctgtatacataaagaattaaatctctcataggtatgaagttttcttttaattttatttgaaatacccagtcagttattaaattacttaattccttgtttatgaattcactaattatttgctattatctggtgccctgcttttggtgcttttttcccacatcatattagattattgcctaccattctgttctaccagagacctttctaatatggtcagtgacctttctaatatgcatatctaattaggtgaccctcagttgtctgtagaatagagttaaggctgtttacaccttggcatagatctgcctttatctgtcaggctttgtcttccaccatacttttttcccccttcttcctctcagtacaccctccagtcttactaagtaacatttatgtccagtatttcagcttttaatttcacatctttgagtttttttttgaaaattataatttcaccttttattttagatacaggggtacatgtacaggtttgttacatgggtatactgtgtgctactgaggtttagggtatagatgatttcatcactcaggtggtgaggacagtacccaataggtagttttttagccctttccccctccttctctgccccctctagtagtccccaatgtctatgactcccatcttttttttttttttttttaattgagacgaagtctcactatattgcccatgctggtcttgaactcctgaactcaagcagtcctcttgccttggcctctcagagtgctggaattacaggcatgagccaccacacctggcattggctcccatctttatgtccatgtgtactcagtgtttagttcccacttgtaagtgtgaacatattgtatttggttttctgttcctgtgttaatttcacttgggataatggcctccagctgcctccatgttgctgcaaagggcattatttcattctttttaatggctgcatagtattccatggtgtatgtgtactatattttctttatccagtccattgtttatggacaccgaggttgattccatgtctgttgtgaatagtgctgtgatgaacatacaagggcatgtgtcttttctttttctgtgtgtgtatttatttatttatttaattttatttttttgagacagagtcttgctctgtcacccaggctggagagcggtggcacaatgtcggctcacttcaacctccacttcctggggtcaagcgcttctcctgcgtcagcctcctgagtagccgggattacaggcatgcaccaccatgcttggctaatttcatttgtatttttagtagagacggggtttcttcatgttggtcaggctgatctcgaactcccgacctcaagtgatccacccgccttggcctcccagagtgctgggattacaggcgtgagccactgcgtccagtgtgtgtatttatttttaagcaggcatattatgttcaaagaatgcatgtgtctttttggtagaacgatttattttcctttgggtatatacccagtcatgtaattgctgggtcagatggtagctctgttatatgtatttttttttagtttttatttttttttgagactaagtctcactctgttgcccaggttggagtgcagtggcatgatcttggctcagtgcaacctccaccttctgggctcaagccattctcctgccttagatacccgagtagctgggattacaggtgcctgccaccacgcctgtctaatttttggatttttagtagggacgaggtttcaccatgttagccaggctggtctcaaactcctgacctcaagtgatctgcctgcctcagctttccaaaatgctgggattataggtgtgagccactgtacctggctggtaactctgttttaagtttagaaatctccaaactgctttccatagtggttgaattaatttacattccaaccaacagtatataagcattctcttttctctgcaggcttgccagcctctgttgtttttttactttttattaaaagccatttaattaggtcccacttgtcagtttttgtttttgttgcagttgcttttggggacggagccaaaaattcttagccaaggccagtgtcaagaaaggtatttcctaggttttcttctagatttttatagtttgaggtcttatatttgaatctttataatccatcttgagttgatttttatatatggtgaaaggtaggggtccagtttcattcttctgcatatggctagccagttatcccagcaccatttattgaatagagagtccttttcctattgcttgtttttgttgactttgtcaaaaatcagatggttgtaggtgtggggctttatttctctgttctctattctgtcccattggtctgtctgtttttgtaccaataccatgctgttttggttactgtagccttccgtatagtttgaagtcgggtagtgtgaatatactgtgatctaataggcttttattcctgggatgtaagggtggttcaacatatgcaaatcaataaatgtgattcaccacattgacaaaattaaaagcaaaaatcattggatcatctcaatagaggcagaaaaagctttctgtaaaatccagcatcccttcataataaaaaccttcaacagactaggcatcaaaggaacataactgaaaataatgagttgtctatgataaacccatagccaacattggactgaacaggcaaaagctgaaactattctccttgagaacaggagcaagacaagaatgcttactcacaccactcttattctggaagtcctagccagagcagtcaggcaagagaataaataaaaggtattcaaataggaaaaaagaagtcaaactgtctatctttgctgatgatacattctatatgtggaaaaccctgaagtttctcccaaagactccaagaactgataaatgacttcagtaatgtttcaggacacaaaataaatgtgcaaaaataagtagtatttctaaacagcagtgacgttcaagctgaaagtcaaatcaagaacacaatcccgtttacaacagccacatagacaaaacgaaatacttaaaaatatagctaaccaaggaggtgaaagacctctacaaggagaaccacaaaacacttctgaaagaaatcagaaaaccaggcgcggtggctcatgtctgtaatcccagcactttgggaggccaaggcgggtggatcaccggaggtcaggagttccgagaccagcctggccaacatggtgaaaccccatctctactaaaaatacaaaaactagccaggtgtggtggcaggcccctgtaatcccagctactagggaggctgaggcaggagaattgcttgaacccaggaggtggaggttgcagtgattcgcgatcttgccattgccttccaccccggacgacaagagcaaaactctgtctaaaaaaaaaaaaaaaaagtattttactttggtccttgatttatgtgacacacctaggttaaggaagaacaaacatgtttgtaggcaagagagtctcatttttgtaattcatcatcaacttttgaaatgttaaaattaatatttaaaaagtattagctctagcgagtcaataaggcaagcaaatatatagacttgtttgtaaagcaagaaaatatttactttctttttttccctttgaatttacttactacaaggtagggtttgtgtgtagcctagagtttgaaccttcatttcaaggaatgaaatgaaacaagatggctcttgtttcttgatttttgcctgttttttgagcctaagttagtgttctcaaatggggaaaagatgagaaggagagggtaggtgtagactaactttacccatgttacagtgctttgggatagaagcatagcactgcttctctgagtatttcctgcttccccccaggcatttgagtacctgggatattatcactttagttattccccttcccccaataattaattccaattcttttaatggcagtggtggtaactttaagactttaggagtttctaggatcttatttctatgtgtggtttagttttttatttagaaagaatgtgcttttcttttttgtttaggatgaaaaatactaattttttttctggtgctatgcctgacacatattgggaattcaataaatgtttgtagaatgcatttgtaataatttcacttcatggttcaacccccctccagactctactctccccaaacagtcccgtaataagagtgagcccttactttcacgaaagaaaattcaaaattggtatgcggctgaacaaaggtaagtgagtcaacataatcactcagaagcaccatacagtgtgtttcccaacacaattaagaggagacaggacctgggagctgccgagaagtacagaggcttccatctcaagggccttcagttacaagtggatgtccttaatgtattttcagtatttcacaaagcctgatggagggtttatatttgctatgattaagctgaagtaggctaaggtgtcagatttcttactggagtaatacccagcctgggtgacagagtgagaccctgtctcaaaaaaagaaaaagaaattgtcatttaataagaagaggatcactatgaacgaaacaaatttaaacggggagctaggaggtcagtttaggatatgaaaagtttgagatggctgttgatttcctaagtagtgatattgaataggctatgtgctctagatgtctggagttaggagagaggtataagttggagatagaaaatggggcattactatttttttgagacagggtctcactccattacccaggctggagtgcagtggcacaatcttgactcactacaatctccatcccccaggttcaagcagttctcgtgtgtcagccacctgaatagccggaattacaggtgcatgccaccacacccggctaatttttgtatttttagtagagatgggatttccccatgttggccaggctggtcttgaactcctgagctcaagttatccacctgcctctgccttctgaagtgctggcattacaggtgtgtgagccaccgtgcctggccacatggggcgttattagcatattaataacattgatgccatgattagccatatggataatgtttaaagccgtaagactagatgtattactttgttttcacactttataaagaacttccctgagactgggtcatttataaaggaaagaggtttaattgactcacagttttgtatggctggggaggtgtcaggaaatttacaatcatggcagaaagtgaaggggaagcaagcaccttcttcacaaggtgcttcacagaaaagaggagggagaaagagaagagcggggagaggagggaaagagagggacgagaggagaggaggaggagggaggagaggagaggaggggtggttgttcttgcatggcttaagaaggaataggatctggtgggtgagtagcgactggttttagataggagtaagaataatttggacttagtaacagaatgaaaggaagactgtatgggcacagatgcagcttgatatgtagaggtggtggtgagagcttaatttttttttttatgagaaaacttgcatttgcattttcagagatagtttagtagaatactgtcttcaaagcatgttgtggagtggagttgaaagttaaagtggcccttggaaatctgaaaaaataatttgagggctgggcacagtggctcatgcctgtaatcccagcactttgggaggccaaggcgggtggatcacctgaggtcatgacctcaagaccagcctggccaacctggtgaaaccccgtctctactaaaaatacaaaaattagctgggtgtggtggcaggcgcctgtaatcccagctactcaggaggctgaggcaggagaatcacttgaacctggaaggtggaggttgcagtgagctgagatcacgccattgtactccagcctgggcgacagagcaagacttcatctcaaaaaaaaaaaaatgtgattctcatcttatagaatatctgaatatacttattgcataatttgtatgtcaattaagaaagaataatatattttataattgattcaagaaatgaaaaatttcagtgaaaatttccaattcttttgattgtctctctgattctcagggagtcatttaaatgcaatactaagcggaagacaaaattaactccctgtaaaaagcatgtttaccttttaaaaatatttctttggctgggcatggtggctcgtgcctgtaatcccagcattttgggaggccgaggtaggcggatcatctgaggtcaggagtttcagtccagcctggccaacatggtgaaatcctgtctctactaaaaatacaaaaattagctgggcgtggtagcgcgtgcctgtaatcccagctacttgggaggctgaatcaggagaattgcttgaacccgggaggtgaaggttgcagtgacccgagactgcgccactggactctagtctgggtgacagagcgagactcagtatcaaaaaaaaaaatttttttttttttttttttaatgagactgagtctcgctctgtcacccaggctggagtgtagtggcatgatcatgactcactagcctcaacatcccaggctgaagtgatccttccacttcagcctcccaccacgccagctgggaccacaggcatgcaccacttcacccagctagtttttgtattttttgtagagacagggatctcactttgttgcccaggctggtcttgaactcttgggctcaagcaatctctccagcttggcctctcaaagttctgggattacaggcatgagccactgcacctggtggaaaaatctcttaaacctagcacaaattacagaactaggtaacttctgggtgtatcattggataataaacaagattagtcacagcatatggaatatttaaatcacctgggatgaatatcttgctattatattctgatactttaatatctgtgaaagaaattttgactaggtaaactgggatgtttagtctcttaaaaatacagggctttttctgaaaaagtctactttttgtccatattattgtaataacgattgcatatattatatgaattatgtctaaatccaaatctgtcttgtgatggtaatttacgcaggtgtttatatttgaaatatagtttatgatttcttctctgaaaatctgtaagaaaatcatataatcagttctcacaattcagattgtattgtatttatagtaattttcctggtatcagttccaaatcacgtattttaaaatatttcatagtaagcttattaatgacatacttgcttttttttttatcccctttttttgttagcacatcaatcttaactataccagttaagttagtggtggtgttcactgttttaagaatcaagtgatagcagacttagctttaagcattgattgctacattggagtttcctaggttatacttggaagtcactttgtgaaaaggtcatacatcaggaccagggccataatcaactagactttcagaaggggtgtcatagctggaatggacatttgtcttattttgagaaacagttgatctgcgtattttgtcatcagtatctcagcctaaagcagtgcctggtacttagcaggtgctcagtaaatattcattgaaaaaaaaatcaaaattacttcttaattaaattgtggtagttaatttttagatattgttaatgttcagatattttcttctttgtcccgagtttggacttagtgatgggtcttttctttccattgttaataaaagtttattgctgataaaaccaagatattcacaataagttcagtacttatgttcaattaatactatatcatagcaataaaaaacccaaattttgtacaactagctgaagattaacttggatatattttctagggaggctttttctttttgttttttgtttttgatttgtgacacaggatcttgctctgtcacccaggctggagtacagtggcacgatcatggctcactgcagccttggccacctgagctgaagctattcttccgcctcagcctcttaagtagctgtgactgcaggtgtgtactgacatgcctgactaatgttcatgcttttggtggagacaaggtcccactatgttgcccagagtggctttgaactcttggactcaagtaatcctcctgccttgggccttttcaaggtaatttactgactaaagggaaccctgctgaaatgtttttgagaatgattcaattcctgaactttggttcgggaaccgaaatgcttgataaaagattgtgctaggtgcacacaaaacttactagccacagccaactgttaaccttgtgccccattttctcacagtatctggataccagggaagctaatagccttaggatacactgatagaggtgagaggagttgccggtttaaaacttgtatgccaaaggtgcacataacattgttttgagcagcaaggccagggcttggccagatgaaagagtaatctttttaaaggcaaacttgatagatctaccccaccccttcatactcccctccactggaatttaagatccctgagggcagggattttgccaattctgtttactcttctattctaactgattgttttcctattagctagaaggctccctgaggccagataccttgtctctttttgctcacctttatacccccaacacctggcagtatgtggtacatggtaggtggctaaataaataatagttaacagaataaatgactccgtaaggcagtcttggaaggattctgtttgccatatgctttctcctttttggtgtcttattctagcacttacagccaaaacccaaattacttttagttggtacttaatgtctaataccctaacatatatatacacatatatatgcgcatatatatatacacacacacacatatatatacatatatacacacatatataatatatacacatatatacatatatacacatatgtacacatatatacacatatatacacacacatatatatatacacacacacatatatatatatatatatattttttttttttttttttttgagacagagtctcactctgtcaacccaggctggagtgcagtggcatgatcttagctcactgcaacctctgcctcgttggttcaagtgattctcgtgcctcagcctcccaagtagctgggattacaggtgcagctagaatgcctggctaatttttgtatttttaggagcaatggggtttcaccgtgttagccaggctggtctcgaactcctgcctcggcctcccaaagtgttgggattacaggtgcgagccacagtgcccggccttaacctaactatatttctaaaagggtaacttttgaaaataatggtgacatggcaggcaacagctcatgttttgtgatatgaatctgcctattctgcctgtagtatttaatacatagatgttattggagttatcattggagatgcagataaaagagaatatagtggtgtatgtttttgttactcttgcctgcaataagtttgctccccagggagcctcctggtgatatacttttaaccttttgacacagaagaaatgaaaaattagtgtagtagctttgaaaagccacgattgccttctgtggattacatggtgcttctgtggattacttctacacattactatagtgtttgcattaaaaatacattatcaattgtcaattaagtactaaaagtaagataattttcagttgatgatggggaattatctctcttagaataactaagaatttccaagatttaaaatttccttaaccccaataattcttattatttttttcttttagtatttgtgcaaagtatatgtagttagaaagttagaatgtgtttaagacttctagtacaatagcactgggaattgagactgtcttaaaaatttcccttatagtgagtgagtatctttttaagtactcttcatatgcaaacatgtttagttagaatgaatattgaccacatggattttctgaaagatttttctgggaacagatattaacatatctgaaagaattttgtcatctttggtggggtgaataaatcagacttcattaatgaaggataatttgtatttaaatatttaggattccaaaaacaattaaatgaagacattaaaaaaagaggtttattctagtgaaaaccttgcactagatacaaagtaatacttaatttaagcctgggcaacatggcaaaacctcttctctactaaaaatacaaaaaaattagctggatgtggtggcacatgcttgtagttcccagccatttgtgaggctgaggcatgagaattgcttgaacctgggaggcagaggttgcagtgagctgagatcatgccactgcactccagcctgggcaacagagcaagactctgtctcaaaaaaaaaaaaaaaattaatagaagggggaagtgagtgtccatggcttcttccaggcagaagtacatcattatcacatagaataagacatgttcagattgttgggaacaagcgccccaaaatctggccataaactggcaccaaaactggccataaacaaaatctctgcagcactgtgacatgttcatgatggccataacgcccatgctggaaggttgtgggtttactggaatgagggcaaggaacacctggcccgcccagggcggaaaactgcttaaagacattcttaagccacaaacaatagcatgagtgagctgtgccttaaggacatgttcctgctgcagataactagccagacccacccctttatttaggcccatcctatacttttagttaatctaatgtctgtagaaacaatgctaatgactggcttgctgttaataaatacgtgggtaaatgtctgttcggggctctcagctctgaaggctgtgagacccttgatttcccacttcacacctctatatttctgtgtgtgtgtgtgtctttaattcctctagtgccactgggttagggtctcctgacagagctggtctcagcacagataaaaaactgaactgggccacagtcatttgggcagtgactgtctttgatgacagtgctcagcgtggctgtctcttggatcatattgttccaatctggactgggagtttgcctctgtatagagttctaggttagaattaattttcctccagaattttaaaaacattgttttatttacttactgctttgagtgttgttgaagccattgtgattaatgatccttagaaggacctgttcttttttcttcttttctcactaatctctctggaaatatgtagcacattttatttatttctggtgttctgaaatttgacagtggtgtctctgtgtgtctgttttctagtacactgttgaggactccatggaaattttgactagactctagaaaatcatgtcttttggttctggtatattttctttggatatttcaaagccttcttcctctctctttggggagtgggcatgtggagggatttttttttcctggtattttgatgctggattatttttactagtctcatattcacattttattttcctttttatcttttccccctattttctattgttacaggaaaggggtcctgatccagaccccaagagagagggttcttggatctcacacaagaaagaatttcagacgagtccataaagtgaaaggaagtttatttagaaagtaaaggaataaagaatagctcctccacagacagagcagccccaaaggctgctggctgcccatttttatgtttatttcttgattatactaccagagatctctcttgttgccatcttggttttgatgggttttagccagcttctttactgcagcccgttttatcagcagggtctttatgacctgtgtcttctgctgacctcctctctcatcctgtgacttagaatgccttaaatgtctacaaaccagtaggttttagccttattttacccacctcctattcaagatggagttgctctggttcacatgcctctgacgctcttccattttatcttaactctgaaaggttgcctcgtctttatcttctatagcttctagtgaatatttcatttctattattatgttgttaaagaaaaattattctaacacttgttaaaacagcaaggaatactttattcaaggactcttgtggtaggggtggtattagtctgctagaagtgtagactgctcaggctgccgtaataaaataccacaaacgtttgtattctgacacagaaatttagttttttcacagttttgtaacctggatatctgacgtcagtgtgtcaccgtggttgggttctgataagagcacttttcctggcttatagatggcagccttttctctgtgtgttcccttggcctttccatggtgcatgtactcggacagagatctatttctctctcttcctcttattatatggccaccaatcctatctgattagaaccctacccttctgacctcatttaatcttaattacctcctgaaagccctgtctccaaatacagagacattgagggttaaggcttaaacatatgaatttggggggaacaaaattcagtccatagcagtactttcagttcatatgaaggggtattgcagtaggtgggagagatgggcctcaactcctgaatatggcagagacagctggggattgtgaacccagaatatctaagacaggtctcaaccaatttagaaagtttattttgaaaccaatttagaaaggttaaggatgcacctgtgactcagccacaggaggttctgaggacatgtacccaaggtggtcagggcacaacttggttttatatgttttaggtagacatgagacatcaattaatttctgtaagatgtacattagtttcatctggaaaggtgggtaaactcaaggcagggggaggggacttccaaatcataggtagataagagacaaactattgcattcttttgagtctctgattagcctttcacagaatacacaatttacaggtgagaggagggtagaggaaataatcttatgccctagtctggcttagtgaaacaatatggcagaagaagcaatgagatatgcgtttgtctcacatgagcctcagcgagatgactgagttctggctgtccttcatccacaaggaatttccatgtgggcaaattgtgagggaggcatgtaactttttaaaaaatgtttgtagctatcttgtttaggaataaaatgggaggcaggcctgcctgacatagtccccagcttgactttttccttggcttagtgatgttggggttccgagatttttttcctttcacaggatttacagccaaggaacagagcgagtggatcagtggatggaaaattattcatggagacatcaagggcatggaaagtcttgccatactgacttaacaggatttttgctgaaggcaggtcaaggacttagagtgttaatggaaaaagcaaactgtaaaatatttaaagaggtttattcagagccaatatgaacgactatggcccgatgaacagtctcaagaagtcctgagaaagtgtgtgtgaggtggttgggttataatttggttttatacattttaggaaggcaggaattacaggcgaagacataatacgtggaaggtatatattgattctgtctctgcctgaaaactgggaaatctcgaagtgggggggtggtggaatggggagcttatgggtcataggtggattcaaagattttctgattggccgttgaaagagttaagctttgtctaaagactggaagtcagtagaaagaaatgctcgaggtaagataagggggatgtcagcccggcgtgctggctgaggcttgtaatcccagcactttgggaggccgagccaggtggatcacttgaggtcaggagttcaagaccagtctggctaacatgatgaaaccttgtctctgctaaaaaaaaaaaaaaaacaaaaaaaaaagcaaaaattagctgggcgttgtggcaggtgcctgtagtcctagctcctgtagaggctgaggcaggagaattgcttgaaccctggaggcggaggtttcagtgagcccagattgccccattgccctccagcttgggcaacaaagtgagactctgtctcaaaaaaaaaaaaaaaaaaagatccatagatgttgaggttcttgttatgtagagaagcttcataggtagcaggctacagagagaatgatggtaaatgtctcttttcagaccttaaaagatgtcagacttaggtaatctcgcccagatccatcctggaaatgcctggctgcattaattactatgaaattctctacagatgcaaatttcctccacaaaagacagctttgcagggccatttcaaaatatgtcaaagaaatatattgtggagtaaaatatttgattctcttcagggtctgatatctggcatgtgatgctgtaccagagtcaggttgaaatgtgtcttattgctgcaaagaatctgttttgtcagtcttatgatctctattttaatgttattatttgtcagttgtgcctaaattccaaaagggaggggggtataatgaggcatgtctgacctcccttcctgtcttggctgggaattcagtttttcaagttcctctgggtttcccccatccaagagggatccccattcagttggttaggggcttaggattttatttttggtttatgacatgaaaggtgggggatgggaactggatcaagtatcaggggtcggggagtctatctaaattgatttagcaggattcttgctaaaactgggctgtgcaggcctgtcaagagatagaacggagttaaggccaaggttgaggcctagcctagttgaggagaggcctcagaggagcctaattaaagttggttggtcaaggagagagtcttggccaggtgcagtggcttatgcctgtaatcccggttactcagaaggctgaggtgggaggattgcctgagcccaggagttcgaggctgcagtgacctatgattgtgccattgcactccagcctgggtgaaaaagtgagaccctatctcctaagcagttttgttttttttttggcatacccataattgtttttggtgtttctcattccagagtcttctccagagaacaggttctagacttctcttggtgggggtggtggggattggggtaggggggcagtttttccatcaatatggagtttgtgtggttggtgtgaggaaatctctctcagaaaactttcacctagttttccttattttagatttcttttcacccttgttctggaaccttgtactgaatttcttgtatcttttgaggattctgtagtataatttgggttggttttcatattttcgaattcatgccttgaaattcagctctcttgtggttgctgttggttgcctctcaaccatttgctttccaaattagaaaatgcttctgttttctcctttttgcttctctccatcctcatgggctgatgtgtttgtaaagaatccctgtactgtagataaagggctttgatgaaggagcaatgttagctgtgtgtgtgcctttaaatttgttaccttaactgggaagtcatagttaacagttgaaaataggaaagtagttcgaagtttaatttgccattcttttttggactttgggagttttgctttgctgtgatttttcttttcttttttttcactgtcacaaattttacacacagtgatttcaggtaatttttcctaaatgatccctcctgtctattctgtaatttctgtttgtatttaaaattaccacaactattgtcttgaaactgactggtggcttcaaacaagggatatagtggggaaggaaaagagaaagggggaggggtatgcctagtatcttttgggtgccagtagaacagtgatctcagttttatgtcacttaatcctcacagcagttctgaaaggtaagtgatatcccaccatatggataaggacaaagataaaaatcgaagaggttaaataacttacttaagagcttgttagaaagtggtggagctgagtttcaagcctaggtttttttttctgttttttgttttttgtttttccagagacaaggtcttactctgtctcccaggctggagtgcagtggcacaatgatagcttactgcaactttgaactcctggattcaagtcatcctcctgcctcagcctcctgagtagccagaactacagggctatgccatcattcctggctaatgtttaaaatttttgatttttgtagaggtggagtcttgctgtgttgttcaggctggtcttgagctcctaggatcaagtgatcctcccacttcggcttctcaaagtgctttttttaaaaattaaattttttttgtgtgtgttgatacatagtaggtgtgtatattatggggtacatgagatattttgatacaggcgtacagtgtgccataatcacattggggtaaatgaagtacccagcaactcaaggatttattctttctttgtaccacaacgatccaagtatactattttagttatttttaaatgacagtaagttactattgactgtagtcaccctcttgtgctatcaagtactagattttattaattctaactatatttttgtacccattaaccatccctactccccaccccactaccttcccagcctcaggtatcattctactccctatcttcatgagttcaattgtttcagttttttttttagctcccacagatacgtgagaacatgtgaagttttcctttctttgtctgatgtgtttcatttaatgtaatgacctccagttccatccatgttgttgtaaatgacaggatctttctttttcatggctgaataatactccactgtatatatgcaccatgttgtctttatccattcttctgttcatgggcacttgggttgcttccagatcttggctactgagtatagtgctgcagtaaaaatgggagtgcagttatctcttcaatatactgattcctttctcttgagttcctagcagtgggattgctggatcatatggtcattatatttttagttttttaaggaacctgcaaactgttctccatagtagttatattaaatggttttacaattatagttttagaatattctgtgtacttactattaccagtgagttttgtaccttcagatgatttcttcttgttcattaagcccttttcttttggattgatgccacctgggaggcagggcctggaatcaagaaccttagaaatctatctgctgctgtattctgaagctgagctggcacccaagccacagatcaagttcttcccactcttttctcctctttcctcaagcaaagagtctctctgcatggccaccaccatcccaagcccatggcaagtacagcctggctactgccgatgttcactcaaggcccaagagttctccagtcagttcgtggtggatgctgccagtgctgaatctcctgctttagaacagtgggctcccctttggcccagggcacatccagaaatgccatccaagagtcaaggccggggatcagggaccccaggagcccgcttggtgctcgttaacccactctggctgagctggtacccaggctgccagacaaagtcccccttactcttccctttcctttccttattcagaggcagtctctccccatggccaccacagctgggaatgtgctgggtcatacctgaagccagcatagctctcagtctcacctgtgacccgtggtgagtattgcctggctaccactgctgactgttcaggccccaggggctctttagtcagcaggtgatgaattctgctgggactgggttcttccccccaaatcagtgagttatcttctgcctaggatgtgtttagaaatgcccaggagctagggcctggaatgggggcctcaggacctgccctgttctctattctactgggactgaattggttggtatccaggttgcaagacaaagtcccctttacccttccctcttcgcctctcaaacggagggaaggagtctttaatagagctgtgagttgcactcctggccgcccagctggtgttctcactaggtcacatgctccccaaacccggtggctctgagcctatcatagcaccaggacttgcccagaaaatgcagtccttgtggtctagactgcttttcaagtttatttaggaccccagaacaatttagcctgcagtggggcttgctgagatgaactatttgcctctggctagggcttctgtaaatgctctgtttgtgatctctccctcccacaagcctgtagattctctcaccataccaccattgctgctgccaaggggtggggagagagagggtggtgctgagagttgaagactggttttgctcccctctccagtgcctctttctttgatgtgatgttaaaaccagggactggttttaactggtacattgctcacctgattttttgttcttatgaagatgctttttttgggtggatagttgttcaatttggtgttcctgaaggggaagtgattgctggagccttctattaagccatcttgctctgtctccttaccctaaagtgttttgattacaagtgtgagccaccgttcctggctgagcgtaggatttgaagatatttcaggatgagcacagtggctcacgcctgtaatcccagcactttgtatggttgaggcaggttgattgcttgagcccaggagttcgagacctgcctgggcaacacagtgagaccctgtatataaaaaaataaaaattacaaaaattacctgcatgcacctgatggtcccagctacttgggaggctgaaataggagaatgtcttgaacgtgggaggtcaaggttgcagtgagccatgattgcatcactgtgccactgcactatggcctgggtgatagaaagacccagtctcaaaaaaaaaaaaaaaagatatttcaattcttctaagtctacacctgcttttactcttccaaaactgtgtgaacaattcattcatttaccagtgaatattgagttgcttactgtgtgctgggccttagggacacagagaggagtagtccaagtcctgatgaaacagaaatgaaatgattagatttaccttttggtaggattaccagtgatatgtgtgaagtggcacgagtagaagcaggcagctgagttaattacagaagtcctggtaaaagatgatgttcatttgaactaagacggtagaggagatgcagagaaggagttggatttgtgatccctattggaggtaaagctgacaacattaaggaagtgatatgaatttggaaggagctcaagggattggggatgatttcgggtttgatttgaaggagtgctgttagtgccttcactgatactaaggaagagcaagctggagtggtagaccatggcaataataacataataattatgttacacctattagatacattcatgaagaggtgtccagtagacaagtaaacatctgggaactcagtggaggtttcggctagagcaacaactttgagcatcactcatacataaatggtatttaaagccatgggactagatatgattagggaaagagtatagatgtatgtgtggtaatataagtctgaagtagtggtattgattcacttctatgaagactcttcatctaatttgtcaacttggaattgtacataaacctgatagcgtttgctggatagggaaagcaactcactttgtagccactgcatagacgacatcaaccaacaagcaagttgcaaacatgccaatagttagctgcttttgaatgaactgtatgccaaacgtccttgactttcatgaaactacacctgagagcatccacatgaggatccacatttgagaatgccacacaaaaggaggattatggcacatgaatcagcttttctttttaaatatagataagtagtgaaaaaataagtgcctgtcaagatgacatctgggatcatttaccagatgatccattgttacattttagtctcatagcatccaggctcattaaaacaaaatattttgcatgtcacggattgttttggctactctttagagacagatatgaatgttaaatctcagaatgctaagtatgaaagaaaccatacaggggtaatggaaaaattaggttagaattcaccttaggcaaaaactgtaaacaatccaaatattcatcaacagagcaataggtgaacaactgtggtatagtcattcattggactagtacgcactacaaggttaaatatgttgaaagcaaaaacagtttgttgaatgaaagaagacagacatgaaagaatacatactgtatgatgtcacttatatgaagttcaggaataggcagaaactaacagaacagtaggaatgcccatggggaatggttattgaccaaaaggagtcatgagacaactgttttgttttagaaacagggtcttgttctgtcacccagaatggattgcagtgatacagtcatagctcactgtagcctcaagcagtcctcctgcctcggcctctcaaagtgttggcattctaggcgtaagctaccactcatgaccttgattggagtgtttcataaatggctatatccatttgtccatattcgtcaacttgtatacttagatttgtacatttcactgtatgtcagttttacctcagtggaaaataagaaaacaacaaaaatggcatactgagtagttccgtgaggatgagcttcgggagcacatcagtccattctcagagagtgagggaaagtttcccagagataataatctctctttttatccttttacttccacagttgatttatttttttcaactcttagctacctccccacaataatatctattcctatgactatttaatttattgtgcaaatgcagaatactttagggagcaaaaaggagtgctggtataaattacactcaactggtaaaaactatcattgtttgcttctgttctagtcagagggttgtactctactgcagtcatacctgaaggaaggcagtagtagagcaggtgtacctgagggtggaacaacctctgcttggcctcatctaaaagtagataaagggggccgggcacggtggctcacgcctgtaatcccagcactttgggaggccgaggcaggcggatcacgaggtcaggagatcgagaccatcctggctaacacggtgaaatcccatctctactaaaaatacaaaaaattagctgggtgtggtggcagatgcctgtaatcccagctactcgggaggctgaggcaggagaatggcgtgatcctgggaggcggagcttgcagtgagccaggattgtgccaccgcactccagcctgggtgagagagtgagattccgtctcaaaaaaaaaaaaaaaaaagtagataaagggggcagagttcagcaagaggcaagggaggaggtggggattttatgtggcatgggcagatgtgtttgttagttgggacttacatgtgaacttttgaaaaagatacattatttgttttatatatatttcaaaactgattcatgttgctgtatttgttcctttgaaacaggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaaggtgagtttctcagaaagatgttgaaatatgatttctttcaaaaataggtgttttttttcacaagagtaaggtctgtcttcttaatgaggtagatatttgggaaagcatatttctggtaagtgagtctgttttctcctgacttctttgattaaatcagaggtatgtgccctagggaaaaaatggtgccctatgataaaatcagatggaaatttagtgagcctttcattctttgtttttttcacatccctttgatcatccagttcttagcctttcattcttaagaactagctgtatgataaaatctaaacaataatgacattttaatttcttgtgccacattactaaagttattagtgtgtctgtgatcgacatgtcacaaagtaaaaatatgaaaagtgaatgtggagatatcagattttgcttttttgccttagcttctattataaagtctttttttaaagttttttgttcacttaaaattattgctatcatttttgtaatagatgctttaattctgtacacatggtatttatttctttgcatgcttagacataaactagacagcattacaaaatgaaagtctgagggaaaagtgactaggagttgtgactcgtttacagagaaggcatcattgtaaatacctgtttcagtcttcatggagactgatacagtctgtttttgtggaacttcactccattctcagagagtgaggggaagttttccagaggaaataatctctttttattcttttggttccacaattggtttatttttcaactcttagctctcttagcacagtaatatcttattcccatgatagatgtccacaatttttagtttaataagtatgcctgttaaacagttcttctgactaaattaaattttgtaggtgtcatttctgtttactttagactgaaaatgttcatgaataatttatattctatgatacatggctaactaatgccatatgactaccatccttctgggaaccttagaaaaacaaggtggatctctcatgaggtcttttcacagagaaaactattctgttactgtaaacaacccagggactgaaatgcataatgtataatgtgccatgttagaggaggccagttaaagataccctcaggacaggaaagacaaagtgtttctggtttttcctcttattagcaggtacctatttgtacttaaaattcagtacatgtttaaaaaaaaaagctcagttactttacatatttgaaggcttttgatttttgtttaacatattttataagcacagtaaatcagaagaccaaaatgaaattgagagtgtatttcctaggtgtttatatatagttgttatgtatattttgttgtattcacaggtgacaaaacaattcagttcaattatagaagaaacttgatttaagtggatatactttttcatattttaaatattttaatatgctttacactcttattcaggtacatatgtagaaccaataaaaactgtttacattagggagtgatataaatttcatggatctgtagataattctgtgaactaaagtgtacgttttttccacaaagttttttttgaggattaacaagttctcagagattacctttaatcttaattttcctccctactttctgatcaggttcttaataaacatactgctgtaataaccagacagttaaaaagatccttaagagaagcaatcttttgcttagctcattcattgcctagagataatcagcttcaaaataattattaaggaattaagtacataaaggggtggactggtcatgcacacctttgtgcagtgtgtgcgcagtggaagtacagtggaagtgtagatgagggagtgaggaacatgtcttgatagcaatggcttttcaaggtttttgtttgtgacccatagtaaaatagatttcacattgcattagctatgtgtatttatgtgtgtgaatttataagaaataaattttacatttcaacaactgtgtgtgtagtgtttgtgtgtgtttacttataaatgaaacagttgatcaaaagaaacattcttagcacatgctatgcattttgataatttctaataacttttattcttttaaaaatgctgttttaggctagctgcagtggctcatgcctgtaatcctagaactttgggagtccaaggagggaggattgcttgagctcaggaatttgagactagcctgggcgacatagtgagacctcatctctacaaaaaatttaaaaaattagctgggtgtggtggtacatgcctgttttagctactctggtggctgaagtgcacttaagccagcaggtcaaggctgcagtgagctgtgattgtgccactgcactctagcctgggtgacagagtgagatcctgtctcaaaaaaaaagaaagctattttaatccactaaattggtttcatattctgtatttgcagcagtggtaagaagccgctctgaagccttgtaggctgaagccctaaatttatggcatagaagggtctgcattttcttttccctgtctgctttgctggtcttctgttgtgtcaaccaagtctccccttcatactcttactcttgtgtgcctctttctccttctcttctgcaagtattaagtccttaccataccccaggtgatgttatgtgctttgtgtcattgctaacattgctcctgcctggagtgccactatccatacctgctctttattttatttatttatttttgagttggagttttgctattgtcgcccaggctggagtgcagtggcataatcttggctcactgcaacctctgcctcccgggtttgggcgattctcctgcctcagcctcccgagtagctgggattacaggtgcccaccaccatgtctggctaatttgttgtatttttagtagagatggggtttcatcatgttggccaggtttttctcaaactcctgacctcaggtgatccacctgcctggggctcccaaagtacagggactacaggtgtgagccaccgcacctggccaatctccatatccttttgcttagaaactacttatttttcttttaagactctgattgaggtcaccttgtttatgaagtttttctacagatacccaatctctccctcccccccattcagtagaattgactgttgactactttttcctttgaggagtggtataaattcttagctttcctttactctttgttggagataattgtttactttgtctctccctccctactagactatgtaatcttctcaagtgcaggggctattttattctgtcattagagcttgatgctctgtatttgacttgtggtaggtgtttaatgctgagtgatcaagatatgtttttagcagaaaaaagcctccttcttctaagagaaaacaattaatgaaacattttaaggagagaggaagatggggtggtgataatttaaagaataaagaaggagggagagaaaacacctttcaggactccttactggccttttagcctgctcttaactttctcattccagcaactctttgtcattggcctcccctcatccccactcccctcatcatctaacttcttggaacctttttaatttgacatggctcctaccaggcagagctaaaccctgaagtctggggagcccgtaaccctcttgccatggctgtgaaagttgggcacatacatatatgacattagcagttatttctgaatgcattttcctatagaatcattattataaattgtggcttgttttatattaccattaatatacttaatgcacatgatgggttaattttgcttttgtggcctgtcctacaaacttctccacatttataacattaacaacatgtgtactgggttccaagtaattaacttccagagtttctatggcataacagttttctacattgggtgtgacttagaattgaggtagtcccagcagcgtggattttactcattatagttgtagctttacacacacacacacaaacacacacacacacacccctataaatattattttaaaataattgaaccatttttccctgcagttttctttgatacaattagaaacttcagccacaagagtaattgtcattgtttgagaagtactgtatcagcttataaataactgtgagaatggcatggattaaaatttaattctctttggatgtcatttgagatcatttgttctctcttatgagatgttatcttaattctgcagtgttactctagcatttaagtgataaaataaatataagtattcatggatacttgtaattttacagacgaaatattttttggtattttttatatttctgacagatttttgtacaggagtttgtgtcaaatatattttactgaaacaatagctattaatataaccctctggttatctgattgaatgttatttttttctgtcttttttttttgagatggaatttttttctgtcttttttttttgagatggaatttcactcttgtcttccagggtggagtgcaatggcatgatctcggctcactgcatcctccacctcctgggttcaagggattctcctgcctcagcctccccagtagctgggattacaggggtgctgcatcacgcctggctaatttttgtatttttagtagagacggagttctaccatgttggccaggctagtttcaaactcctgacctcggatgatccacccgcctcggcctcccaaagtgttgggattataggcatgagccactgtgcccggttactttttccttttttaaaacactgaaattgctgtatctaccacattaacattttatttaaaaaaatttgttaaatagcatatgtatgtaaatttaatattaatatacctctttttttgtccttctttaggtgttggagcctaggatacttacttactgatttttattgttgatttcatgtccacagtaatagtagataatatttttgagtaaagttattgttctgttttggggttaatgacttgttaaatagtattatctgtattatattttaataaagagcatattgttgccactattacagtgtatgcaaccaattaagcccttctattgttcttactatttaaaagccttgagtttaatgagcatttgttttgcttgttagacatttttggctctcataaaccaagtgtttcctgcagaagaggacagtaaaaaagatgtggaagataactgtaagtaccaagttaaaaattaactctccgcacagaaaaggagactgttcttttaaaaaaataaattagtggttatataactgatacactgtgcgggttcagaaacaatctagtcttttgacatgaatattcatgtgaatgaaggaactcgagtcctccatgttgtctcacatttgcattttggtgaaagagtcttgagtgttcttttggtgttatttgagttgcataaatgtggggaatggtaattactgtaaggcttgaactaaaagtctcttgttaacagttttgaaagttattgaaccttatttagagtcaggtggtttttattgtagtatatgtggttcagtaatttggaagttgagtcagtaggagtcatttaacatcaccgtttgaagcaaacatgcatttaaaaaaattctatataattactaattgaaaaattaatttcagaacaattatattaaaacacagcattaatttgacttataacatctttgcatgtttgatgaaaaaagctcttctcgatggaacaggccaatgtttattcttacatttttaagattaagcagtaatcatttcatattgggggcagcagtgttaacaattatgtacacttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagactagtgggagtaatggggagccatggactgtaactgtagagttaggcaagcctaaattctgattctatgttgttaggaggctgtctgctcgtgggcatttcgtctctcttctgaaattctcatctgtagaatggaagtaatgtgtatgttgtatgattagagatgatataaagtgctttgcacagcatctaatgactcttaataaatggtagctgtttttattaggtgcaagagattgaggaaaaaaatgtagaattcccttcctttccaaaattgctggagagtttgtctgattaaataatacatttttgaatagcaatcagaataaaataataaggaatgagactgtaccatatctaaaatacaaatttttgtgctgttaaaacttgctagggtgtgcagaactgggaatcaatccttttcatttattaatgtgtatgtctctaaatgtgacaaatggttttgaatagtttttaatccatttcttaaattaatattttaaaacattctctctccatttgctttgtcttgctatgcttgtctaacttacaaatttttgcaacctcagtatttgctgcctctggcaggtggtttccttggtgatgccagatggcagcagtgttaatgtgtgggtgttaactattctcataagatagtagcccatccctactgaagacacttttctgaaaccacattattaacacaactttggttgttgagtttagaatgtagggtttccagctgcagtggttctgtcacttagtactttcatctgaggcatgccaccataccactgtcctctgctgaatgacacactgtaacacaaagctatagtggtagctttgtgttatacacttgcacacacacacacatgcacacacacacagggtctcacatgcatatttctaaaattcttttcttctttatattatggtaatgtgaagattaaatgattgatgcctgtagagagtgttctgaagtatgtgttgaaggttctactgaaacagaagtagtgccttaacagtgccttaacagtgtagcaacacttattacctacttttcggtctaaatttttttttttttttttgagacagtctcgctctgtcacccagactggagtgcagtggtgtgatctcagctcactgcaaccttcgcctcccgggttccagcaattcttctgcttcagccttctgagtagctgtgactacacgtgtgcaccaccatgtccagctaatttttgtatttttagtagagattgggttcactatgttggccaggttggtctcaaactcctgacctcagatgatctgcctgccttgggctcccaaagtgctgggattataggcgtaagccactgcaccgagctatagctctgagttttctatgtgaagggttttatatgtagaaattagtatgttaattttgctgtttgactgttgcttattgtcacaagaataggaaaattgggcgtgtgaagtcagtaattaaaaggaaaataatagcatttttccatgctgattttgagctaccatgactttcatggcacataatgttcttcgtgaattattgtctattagatgttgataataataaagtatagagtataaaattggaaagaaaccgggcgcagtggcccactcctgtaatcccagcactttgggaagctgagatgggtggatcacctgaggtcaggactttgagaccagcctggccaacatggtgaaaccctgtctctactaaaagtacaaaaattagttgagcatggtggtgggcgccggtaatcccaactacttgggaggccgaggcaggagactcccttgaacccaggaggcggagattgcagtgagccgagatcacgctgttgcactacagcctgggtgacaagagtgaagctctgtctctaaataataaataaataaaattggaaagaattctaaaagttgcctcagtctctttttctgtaatggaatgacttctacaacaacatatatttagaattgattgacttctgtgttgaagttgtttgtgggttctttttttcttttagtgagccagagctgtaatgattaaacaggatcttaaatgctcagataactctctagtcagatatctaaatttaataatgaagtcatacctaatcttcattagaaacttttgtatatgttatatatttatttattaaaacagtgtttataaagaaactaattgtttattcaaatattttgttatatgtcttatgttaaattgtttcaaaattttaatattcttttgggtatagttaaatctgttaataattaggcataaaaggtaaacagtttacataaagagttgcatgtaaatagccaagccaagtaatcctaggactgactactaggaaaggacaggaggaaggaattatttggtagagcaggaagttatttgtgaggcccttgtggacatacctaggtcatacctttagggagatgtaggcagttgggacttagcatttcacattctggcaagacagggttgcaaatattttcctctccctctctctttttctgtgtcttcttgaaaatggaatggcctgtgtggcatgatttcagaggaataccctcctgtccaaattcttattgtcatcagcagatacttcatcagttaggaatttatttggtttaataaacacacatccctgaaaaggtaggtggtgagtgtggaaggagtaaagataggagagcaagtagtaattcccatgtctgtgtaggcttatatgattagcgttcacaggggaagcgtactgtaggattacgagtttttacttagaggaagcagtgacaacatcatgcaaccaggtatttcagaggaaagtgagagagatggggagtggttcaacagagtgctttgggtaaagaaagaggaacgtgtagaccaggctccaggggacaaggatggaagattagggatatagaaaggtaggtgacctcatacccaaaccagatatattaatacctctgctgcctaaccctctctatatccttccttaattcaaaggaaagctgccattcagctgttaggagcctctacccacttcttactctcttttattctgccctaagtggcactagaaagcagtgaggtgactgaggcaggagaatcgcttgaacccaggaggtggaggttacagtgagctgagatcgtgccactgcactccagccttggcaacagagtgagattttgtctcaaaaaaagaaaaaaaaaagcagtgaggtgaaagtgaactggctgcattaaatgattatagatggatgggcagtctgtggaggtagttatggcaagaggctcttgtttgacaccattggttaggtgttgaatagtatgttagacatacatgcagtgtaggcacatgagcagtttcaatgagggatcaaacaaatgaatcaggcagcatcttgcccccaaggatctgatttagtagacaaaaccagatatgtaaaattatcataataacactggcagtgtgtggtaagaaccataaagaaattgcaaagatagtagttgtagtggtggtggtgagaatgggtaagtgtcatttgtagggtaacctttgtactgaccttaaagagtaggtaggtttttgacacctagaaatgtagaggatattctacatggaagccgatagatgaatgatacctgcatctaataaatagttcagtctgtctatgagttagtattaaggtgaattgtggaaaattatatgaaaaggtcatgaatgtaggtttattaagagctctgatcagacatgaatttggatgttgatagagacccagtgatgattttatggggagagagatttgatgagggctctactttagttaatgtgctgagaagtctggattagagaggagagagactgaggcaataggtaaataagaggctaccatgatcacaaaagaggtaatgagaactaaactggtattggagcagtagaaatggaaagaaaggagataggttgagagattcagattatgctttgagtacctgccatgagctggcactgtgctgtactttcttacatggcataaagatttggaaactggtttagaataaggagggagagagaagatgattttagtgttgactaaggtttacaatttcagtgacagagaaaatggtggtgctaataacagaaacaaggtggttgagaagaggagtggtttttgtctactctagcaaggcatagaaatggagctcaggagattgaaggacttggagaatagattgggagtcagttctgacacttcagtagagcagatgtcacacaaacaagatttatctgttcaaactctcccattaattagcttcatattctcagttaagacatacataatttctctaggagtcttcattatgtcagttgtgaaggactccctgaatgatttgatggtctgttcccattctaaaattttatcttttgtgttttatctgtgaaattctgagtatcagattggattggtgtcatcactttgttgtgtcagaagtatattaaaatcagagctatctattgtagtacttttttccctcttgaattgtgctttttaatcaaccttcattaatgagtactcactaggtttactcttttagttgaaaattcattacttaaaaatatcactgtaacacacatgtaaactgaatcgcttttaaatcagcttctagggtttacatcagccagggttttaaaaaagatggagttaaatgtaacctaacaattgatttttaggatgagtcaaagtgattcagattaagatagtattgctttattttatttgttttcttcaattctctaatgacatataaattttatgtcttaggttcactaatgtatttaaatgaagccacactgctccataatatcaaagttcgatatagtaaagacagaatttatgtaagtattttacctgtagtgtaagtttttgtggagataattatttcatgtggtactctttgattttgtcacgcttgaaattgtctaacagaaaatcatgcttgatctgagcctcttgaatagagtgtgaggttagtgaggacaaagatttttttctaatttacaactcgaactctaggagttaaagcatgcctggtacacagaaagcacttaatcagtatttgtgggatgaaataatgaattcagagtgtcgtttaatatcttttggacttaaaaatgtccagtttgagtatttttaaaagcactgtaatggtttttggttttgatttttgacttctggtatgtctgtagatatgtttgattcactttccacattgtttggaagacaatgtaaggcagcctataaggaatgtatattgaaattaaaaatttgaatgaggaaaaaaatgtaaatcagaataggaggtagtatctgaggaaatactaagaacacaggaatgctgaccatagagcctaaatagttgctgaatttcattagaccgtaggtactctaccttgaaagtccagaatattcaaaaatgaaagaaaatgctttcagtgtaaatagtcaaggtttacaccaaatcattcagatggatacttaacctagtatgttttaattataattattctttgggcatgcatgagactttattccagtatcacctaactgtgtagtcctttggtgactggagataaattaccccactgtagttctcctgttataaagatggggctgttcattatttttgaacgaagaaaacacatggcttctttgacacttactagatcaaatgacagtcttaatctattatatcactatcagtttgcctaattgtacttacttaattctgactaaattacatttagtctctgccatctgtccaagtagtgacagctgggagatagaacttatttattctattccaaaagagtatacttgccatcttctagttatatgtagttttaagacttttctccctgattttttcaaaatcaactaaataaagaacatatttaagtttaaatgtggctattcttgattagaaatatatttagaggcaaaatttactcaatcagctgactcatgttgagtatctaatatgtgctaaattccaaaattaaaagcaagcttaagttgctcattaaacatttaacccataaatgttctaggcaatggttaacatatattgtttggaagaaatctgggaccaaatggtcactacagagctaaatcaatccttggcattcagtgatagggatgggcccagaaggtgctacgagctgtattaaactccttagtagcagggtgaatacagtaggtaaggaatacaaatgactaaaacttagcggtaggagatttcataagtagagtcaacaggagaaggctgaatgagatagagctagagactcagatttctgtctgtggtgacttggtggtgatgccatgtccctgaggaagcacatggaaggataatattttctttgaggcagaggtaggtgggaagagataatcttgagtttggatatgccgaactaaaggtgcctatgggttggtaagatacaaatatttattaagaattggagaaatatgggtccctataaagatcagggaatactcagggaatatttaggactgatttgggagtcttagttatatagataattgaaattttttgtattttattttttctatgagctttgtttatctttaaatgaaaatagtaattggaatattttatgtttatgcttttcgtatttagacatatgtcgccaacattctgattgcagtgaatccatactttgacatacctaaaatatattcttcagaagcaataaagtcatatcaaggaaaatctcttgggacaagaccacctcatgtctttgcaattggtaagtgattttaaatgtattttaattcttgtctttctttatattgtacaaatttactcaatttttcttttggattaataaaagataccataaattgaatatatattttggagaaactgtatacctcttggatatatcaacattgttaggagcaagtattttacacagggtgaggaagaatacttttgtagtcaactaatggggcaggcttaccatacatcattatctgtgttaaatgcctgtgtcctctaagagatgtctgcccaggtgaaagcaggatataataaaagctgacctaatggtacttttagactttttaataccatcagctccatcttaaaattgtcctccttcacaattttgaggttctggccttcatctcttacccagctcatcccttatgagtgtgttacttgggctagatttcagctgtaagagcagacttctgggcatcatcttgcatcaggggtttataaaattaaaggattaaaagtagtatatgcttcataccactggagaatctatgtgggaagacagtagtgtctctttgcctttctcagcctcttttattttgaagtcctccagctctgagtcatagaggttggaggttttagatcagaatgagcaattacccctcttcccaccaaatgcggaggtgttagctaaccctttgcattcagacataaagcagctaaatgacatgtattggaactagttcgtagtgcatcctgtttctctttgggctttcccttcatgcttgtgttttggcctaaccagagttcacttccagatttggttgacctgtatgttgtctgctactaggtagagtgaatatggctgacataattactctaccagggcagcagcagatttacttttggcttgaagaagctatgacaggcatcgttgtgttgcagcctgcaaaacggtgccccatcccttagaacctgaatacgagcaaacatcactggagaaaagttacatgtttaaaatgtaaataaactagcttttatttttagctttttactgcgaaaaaacaagtgtttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaaaaaaaaaaaaaagaaaaaagcgctgctgataaattggacaaagggatgtgtgcgctcttgtatatggtttgcattctccccttagagtaaaagccgtttctgaagtcttcttggcacatgtctgaggtgagaaatagttgtcttatagagccaaattgtgatgacctagttttgaattaaagttgtcttaatttgagactgctttaacagcattaaattgctttcaacttgtctgtgtagtcttaacatttaatacagtttatagcctaaattgttggagtctaatgaagatagttaaaaaatatatatgtaaacagaggcaaatctaggaaatttaaagctgttaattttgcctagttgtaaaatgttgacaaattgtaaatttaatagttgtattagaggaaaaaaccccacagatataatctaggaaatttaaagctgttaattttgcctaattgtaaaatgttgacaaattctaaatttaatagttgtattagagaaaaaaacccaagttgccattatgtatttttttttccagctgaatttttggttgctagatttcttaattggaagctcattaattcttgcttttcactggggacttcattagttatgcatagtgaccatttttttaatccctctgcagatcagctctggaattaggaagagatgagccacagcccataatatcaagacattctgtcagaaacttaagagttgtttatttggatttcatattacttaacttttaggataataagatagaacatttaaagtaaatacttttaaaatgatttgaacacttttgaatgactttattttaaaatttcattaacattgaatagacatttatgatttctttaagagtaagtggtcctaaagtgaactttctattattaactttatatttaatatattgctcatcattaatgtcttattttgaccctagctgataaagcttttcgagacatgaaggtgctcaagatgagtcagtctatcattgtatctggagaatcaggagccggcaaaacagaaaatacaaaatttgttctaaggtgagtattcagctaacttgaagtatttgagtaggttgatcttttttttccccccttgagatagggtcttactgtgtcacccagggtggaatgcagtgtcaccaccacagctcactgtagccttgacctcctgggctcaagccactgttccacctcattctcccgaatggctgggactataggcacatgccaccatgccctgctaatcttttactttttttgtagagatgaagtcttactgtgttgcctaggctggtttcgaatttctgggctgggcttgagcaaccctcctgccttggcctcccaaaatgctgggattataggcatgaaccaccatgcttggcaaccaggttgacttttttctggtaaaaaaatacttaagtaaaagttgtcaaccatttctaagtgtatagcatagtagcattaagtatattcacgttgttgtgcagccaatctgtaccatctccagaactttcatcttggaaaactaaaacttgacccatgcaacaacaactccatttatccactcacctagcaaccaccattctactttccagtttttctgtgaatttaactactttagctatttctcatgtaagtgaaattacacagtatttgtctttctgtgactggcctattttatttaactcaacttaagattcatccatgttgtagtatgtgtcagaatttccttccttttatttttattttttagtattttggatcccatccttcctttttaaggctgaatactattttattgtagatctgtggtacattttgtttatccatgcatttgtcaatggacatttaggttacttccacctcttggctattgtcaatagtgctgttatgaacatgggtgtgcaaatatttctttgagaatttgaaaaggttgacttttaatacctttgcatacttcatgacatagtttggaatggtgggctctatcctttttaagatacagacatcttatatggaagctagtctatagattactgaaagccagctctgacatgttattcacacgaggatcttggaggatactggtactggttagacaaagggtgatctagaaatattccttaagaatctcacatttacgttctgtctatatttctgttgttagcatggttaaaaccattttttaccttaagcttacgataatttgcctccttatttctatttccctatagtctgcctcctaatgtgttctctttgctgccattaaattaaactctctgcattgtgtttttttgtttgtttgtttgtttggtttggtttgtttttttttgaaaacagggtcttgctctgttgcccagtcacccaggctgtagggcagtggtgcaatcatagctcactgcatcctcgacctcctggggccaagtgatcctcctacctcagcctcccaagtaactgggacccacaggcatgtgccaccatcctggctaattttttatttttttgtagagacagggttatgctatgttgtccaggctggtgtccagctcctggactcaagtgatgctcccactttgacctcctaaagtgctgggattacaggcatgagccaccatgcctggccttacactttgtttagaattatagcattttaaaaatggaaggaatcataacactcattgtagtatagttcttttaatttacatacccatgaggttagatctagtggttgaactactgctaggagcagcatactcaccagtgttactcccacagaattatagttcttagttgattgctgcatagtggtactatgaaagtttgctattcattatgtaaatatgtatgctgttcagagttatttatgtaaaatcaattgaagagtttgttaacagctgttatatatatgtgtatatatacatacacacaattctggttaagtgaatgcttcccagtattcttggattctaagtgtttcaatttctttttctttctttcctgtatgtaatagtctatatgagtctatggttaatgtatgaaaatgaacaaaaagttaaggagttataaacttataatatgaacttacattttaaattaaggattgctctttattttgaaatgtgccaggcaaatagttatttctctgtgtttcatatttcagtgaaacaacatgaatagtgataacttcccagttgttcggaggcagattgcctcattttctgtagccaaagattgaattaataggctctcacaaaaggctttgacatctcctatagtttatgaatatgatatatttaaaatcaaatagttggataaaatcagaacattcccaaaacaatttaaaaaacaatgtcaattagatgttaaatgcaatacaaatagaatttatttttcatttttataatttcaacatttagattcaggccacacatgtgcaggtttgttatgagtatattttgtgacacagaggtttggggtgtgaatgatctcatcattgaggtaatgagcatagtaccaccaaatatatatatatatttttttgaaacggagtctcactctgtcgcccaggctggagtgcagtggtgcagttttggttcactgcaaccttggcctcccaggttcaagcgattctcctgccccagcctcctgagtagctgggatgacaggcgcatgccagcatgcctggctaattttttgtattttagtagagaaggggtttcaccatgttggccaggctggtctcgaactcctgacctcaggtaatccaccctccttggcctcccaaaatgctgggattacaggcatgagccaccacacctgaccccaaatagaattttaaataaatttaaaaagctatgacagaatagttgcatttaattacacatttgttataatgatgatctaggtttcagttttatatgtactagataattataaattattgtacaccatattattgtcatcaacattttttatcctatattttaaacagatacctgactgaatcctatggaacaggtcaagatattgatgacagaattgttgaaggtattgctaatttttcagttgttacgcgtgtactgaaattaatttacaagacttcttttagtggtctggaatgttcttctctcagagatgcaaaagactctcttatctcctactaatcattgctcatatatcatcttgttatttacctaatatcaattgtttctgcccccacccgcacctcatgaaaacactaagaaggcagggatttttgtttcatattccaaacccttagaatggtaactgatacagagcataaatatctgttgaatgaatgaaagaatacaggaatgtctttagcttccagtttgttttatggagcttgttttgtgtaaaggaaagaggaagaagggttatttggcattaggtgcttttttagagaagtcattttttaacgaaggccgtagtgtgtaaattgatttccttaagctatccatgcttgtataccttcttagaaagtcttcttgtacctcagtttggagactgctggcctagactaccattatgttgaatctcctgcatgatgccctcctgcatcatagactcctgttttgtctcttcacttagattcttacttctccttaatccagtctctgtatagaatttggaataatttctttttctttttcttttctttttttttttttgaggtggaatctcactctgtcacccaggctggagtgcagtggcttgatcttggctcactacaacctctgcctcctgggttcaggtgattctcctgcctcagcctcccgagtagctgggattacaggcgcccaccaccacatctggctaatttttgtatttttagtagagatggggtttcaccatgttggccaggctggtcttgaactcttgacctcaagtgatccacccgccttggcctcccagaatgttgggattataggggtgagccaccgcgcccagctggaataatttcttttgctttaaataatctgatggcttcatattgctctcaacatcatgccctagattcataacatcacccacagtgctctgtgtggtctggctcctgcctcttctgagctcacctggagtcatgtttcttctgactccttatgctttaatcacattgggctccttgtagttctttgagctgtcttaaacaggcttctctgaacactttttctccttctccctgtcttactttcccccactatgtactcagtaagcattttttaataataatggtggtaataacatatatgggatgtattaggcattatctcatttgtttaaaaatctgttatgtaatttaaatcttcacagaatgaattagaaactattttatccctactttaaagatgataatatttaaatatgctgaagctcatatagttcatcagttgtgaaattcggatataaagctaagcattttaactacatgccgtagtaaatgcatattttaacactctcttggcattttttgtttttaaattagagacagcatctcactatgttgcccaggctggtctcaacctcctgggctcaagcaatcctcctgcctcagccttgtaagtagctgggactctaggagtgcaatacacatgctcttgacatcttaaagaaaaatgttggttgaacaaaaacttattaggggccttgtatgttcatgcattttgctagatcatagcaaatgatatgtgcatttttcacaatgatgtaaaatctgcatgtagatcaatctaaatacaactctaataaacatttttaaagttgagcaccagtaaagtttttttttaatataaagaatttcctagtttcatttacagtttttatgtggtgttgtaacatacccagatatgtacttatcttgtaagtaatgctttattcacagtaaagtgccttactttagcgagggagtcgttcttaaaaactgaataaattaataaaaaagaacaaattatgggctacctcagtaaaagactaattagtattctgatttgctcacttgaggtgcacactcacttaataattggatatacacccagtttcttccccagtaatgtgctgtacagtatgtagtgtgttatagtggagacaagttggaaagtgttattccaagtgcttctatagcttcttttttttttttttttgagactgagtctcactctgtcgccgagtctggagtgcagtggtgtgatcttggctcactgtaacctctgtctcccgagttcaagtgatagcgctgcttcatcctaccgagtagctgggattataggggtgtgtgccaccacgcctggctgatttttgtatttttttagtagagtcggggtttcaccatgttgggcaggctggtcttgaactcctgacctcaggtgatctgcctgcctcagcctcccaaagtgttggtattacaggtgtgaaccactgcacccagctcaatagcctcttaatggagaatagtaaatgtaactagaagggtatagcgtcttttgatcccatccttaatagaagtttagttgctggttttggaatgagtatattattagtagcattaatatgattttctgttggagaggttcttatcctattttgggatattttacttgtattaaattcttcagcaaaaactagtagattatcagtaagggagttggggagacctgtaattgagtcctctttttgttaacacagccagttatgtggactttgaagagtgagttgaccatggtttttttttttttttcttcttgtttttttttgagttggagtctcactctttcacccatgctggcgtgcagtggcaagatctcggctcacctcaacctccatctcccgggttcaagtgattctcctgcctcaggctcctgagtagctgggattacaggtgcccaccaccatgcctggctaatttttgtatttttagtagagacggggtttcaccatgttggtcaggctgatctcaaactcctgaccccatgatccgcccacctcggcctcccaaagtgctgggattacaggtgtgagccaccgcgcctggctgaccatgttggcttcagtttttttatcccatctgaaacatgagggatatatgttaatatttcttttagttttaatgttttcttattttggcatgtgaaatggctggggaatgatctttaaaagagtttagagactagttaagcattctactctagatagaataggagaaatctgcttgaaaaggcttcataagaaatatgacttcatgtttattttttaatttattttattttatttatttatttttttgagatggagtatcgctgtctcccaggctggagtgcagtggcgcgatctcggctcgctgcaagctctgcctccggggttcacgccattctcctgcctcagcctcccatgtagctgggactacaggcacctgccaccacgcctggctaattttttatatttttagtagagacggggtttcaacgtgttagccaggatggtctcgatcttcagccctcgagatccgcctgcctcggcctcccagagtgctgggattacaggcatgagccaccaagcctggccagcttcatgtttattataggaagaacatgcttcataaaaaaaattttaacactgaacatcatgaagcactttaagtttgttgatggagaatatgtgtgtaagattaacactaatttggtatgtttgtaattgagatttagatgagtataagagtagaatctagtaactcttatccagtcatgatatgtgtataggtgattataaaataacagtgaaaatattatatttgttcactaggattttaaaacccattattctgagagccttaggtaattctgtaaactcttaatttgttaaatttcactggatatacatgtaaaaatgttaaatatggagactattaatatgtgaaatgttttagaaaagtaagtcaaataatacatctcttgcctatattttctcacaagaggtttgctgttttatctaagtactgttgtgggcctgatatactagataaaacagtaaaatttttagggaaaaaattttaaagtctagttataaattttgtaacatagtggcttaaaaatttagtctttcctataacatttatattttcttgttatatatttgagaaattttcctatctcatggacttgaatagtgcctgagcatagtgggtaatcaataaatatttgtggaatttggcattacatgtgaattccttcatgttaatttttttttttttttttttgagacagagccttgttcttgtcgcccaggctggagtgtaatggtgcgacctcggctcatcgcaacctccgcctcccgggttcaagtaattctcctgcctcagtctcccaaataactgggattacaggcatgcacctccacgcctggctaatttttgtattttttagtagagacggggtttcatcatcttggccaggttggtctcgaactcctgacctcgtgatccacctgcctcggcctcccaaagtgctgggattacaggcatgagccactgtgtcccgcccatgttaatattttttagaacatttttttctagacatatatattaacaaatggagatataccatgcatattttgtaatgttccgtcatgctaattttttgatggatttttttgtttctcaatagctaacccactcctagaagcctttggaaatgcgaagactgttcgcaacaataatagcagtcgatttgggaaatttgtagaaatacattttaatgaaaaggtaagtgagagtaagctttggaatgatatttttggggagtgtttgtgaaaatgcaagggtcagttggtgctgtatttgcacttaatggtaaatacctttaagtttcattgttactttagatggttgcaggaatatatgtgtccactatgaccatctaaaagctcctttcacaatctaaaacccagatgctgaatttgacttcagcattgagtattactgtatagctagtcatgtaagatattctagcacctgtgttgaggtacggtgcaaggtcaattgtgattcttaggaggctcaaaacttaacaggatttgggtagagacttaaatggggatgtttaaaatgaaggatgaccattataaatactctgtgcttacgtttagttatttgttttttcccctttatttggtgaatattataacctctttgatagacaaatggtattagaaaaggtaaataatttaacattggttaattatattttaagactttaaatgcaaaaatatattttctctgtgttttgttttttagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcgggtaggtcagaagaaaagaaatttcatatagccaggtgcagtggctcatgcctgtaatcccaacactttgggaggctgaggcggatggattgcttgagcctgggagttcgagagcagcctgggcaatgtagcgagaccctgtctctaaaaaaaaaaaatacaaaaaattagctgagcatggtggcactcacctgtagttccagctactcgggaggctgaggtgggaggatcacctgagcccaggaggttgaggctgcagtgagccatgattgtgccactgcactccagcctgggtaacagagcgagaccctatctcaaagaaaaaaaaattttgtataatttttgaaaatataattgccatcaagcctaatacttattttagtgaattttgaaatctacttgttgtgtgtatgtaacttacattggatcaagtataacatgttagaatgaccactgtactgagaagatctctattaaggtgtactgctgagtttatagtataacactgtatgaggaggcacataatggaatagataaaaggatagatgttaaaccctacgtcaatttaaactcaattagaaattgataatagctctgtaatactagctttaaagttacctttgacttatctgtaaaaatgtttgaacactaaattaatattaataaaggacacatgattgaatttcttaatttacttcaacaacaaatatttattgcttgcccattgggtgccaggcattgggccaggattaaaaagataaataatacacagtccctgctcttgatcaacttagatgtggtgggaaacgcacacacacacacatgcacacacacacacacacacacctgagcattacaagcgagtagagtttctaggagcggtgactggggatggtttggttaacacaattttcagattctcaggttagaaaacagtgtacttgtatggagtatgggaatgtagtttatacaaaggaatgcaatgtgagtaaggaatgtcgtctgtatagagttccccagctgattctgatagtcttttttggtcagaaagcctccatttgagaatcataacacacataattactgctctgtggttgtgtgtgtgcgtgtgtgtttgcagacagcttttcttttacttcaatttcttttaatgtgtgtttgcaaattttaaaagtctgttgtcttaaaacactttataaatgtatctctttatatacttctaaaatgtccagtcttttctagagctctccaaattaattggaatttgaagctagttgcccacatttccatgaaagtaaaggaagcatttcttttttactatggtttttaaaaaaggaataaattactaggaattacatgaaatataataatgatgatacggttttgtcaatacttagctgacaataaagtgatgtgactgttctggccttaatctagcatttcttcctgcttggaggcttgggagtatagtatttttgggtttcagaatgtacagcctttcctggtacaatggcaggcatcctgaaagggcagctattgaaatatatctggtcagaggatttcctgtttctgcagtgtgaaccaggaggcctgatttcctttcttacaggagagtccttgtgatggtaagaggaagagtaggggaacagcgttgcatacatctgccatcttgaatattcctctcatatgcaggcacaacacacccactactatatccacttcccccaaataattctgccttaaagtcacttgaaagtgtgttagtgatttcatcaggtttttctgtagtttagccctctggttataattgagagatcaggttttaaaaacaaaggggaaacctgcagtaggttgaacacttgtaaaattgttgaatttttttggtcactactctatcaaaattagtatgtaaagaattgtggatgtatacctgtctgtaaacatttttattaaccacacatatactttaaaaagtaaaaggtttaaaaatgtttgcatttagacatttcaaatatttctgcacatgtttctggagccaattgctgtaatcatggatagatccttgaatgtaaagaaggcttggatagaaaaagaatagatggccgggatagtgttctagttacagaaaaactaaaaggacacgtttctatccaaggttgtaatattaggccccactgtccagaagcaaagtatttgacaaaacaattggagtgaggagacaaagtgcttggtagcaaagaacatatttattttggctctacatgtttaaactattattctgctaagtaaaagagctcttatttgaaacagtccattgaaaatgcttaccaacattgtccctgctcccttctcttttatttttttcccaaagattctagggtggaagaaaaaaaaaaaccatgtatatagttgtcttgtttttactgtattttagcatttaattataatggagaaggaaagatagaggcattgattgtctaaaatattaatttatccccaaatcattcaaatttttataaaattttttttggtatgtgtatgatgaggtgtatttaatttgggaattcatgccatggtacaataaaatcatagcaacctgatttaagagaagctgagatgtttaaaaaaacttgtccatcctgttctctgtgtacatcctttctgatcagatttgcccaattccatctaaatgtctttaggctgtgtgtaattttcagaaaaatgcagtacttttagtctaccgtatagcaaatatgttcattcactttttattagaaacagtttttaaatgaagcaagccttcaattgtgagactaataaatgggagcagtagattcttgttgataccagtagattttctttttttgaactactcctcttgttctatattttggaagcatttagcttttgaaagcctttggtaagtgaagtaaatcactgaaataagaaaactttaaattatttgatccataaagcataaagcaagtagtgtaatttatgtacagtcattgttagctttcaataaatgtgaaaagcatgttttaaaaaactgactctaaaaatcaaaaattaagaaaatcaaggatagaatttcttaacttctcagaatttaaaatattacttgaaaaattaaaccatactatcggttcttacttgagattctacatatttagtaggaaggtgattttcatgattttatacactatgtttagatttttgatactgaaaagatataaaattgttgccctttaaaagtagaaaacttttatgtcattgatttttaatcattttatttaatctatgctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggatcatatatgttaattatgtttaatttgttttgtcatagtatttaaaccgaggctgcactagatactttgctaacaaagaaactgacaaacagattttacagaaccgcaaaagtcctgaggtatagtagaccattgttcataaaatctttaacttaaaaaaaaactcatgctgaaagatgtgttataatttttattttagagcccaagtaagagttctaacttttaggcttatactttaaaaaattaaatattcatctaagtctctgtcacagtgtaatactttatacctcttgttgttatctagtgaagtgacaggttctggttcttctggttgggcatcactgcattgctctcctctcattctgttttcaagcatgaaggtattaaattgcctaagaatcattctcttctagcatttttgaaacttgctcttatattacccacttgagcttaagtatatgtcttttacaatttattgtctatttcaaggctgacgtgaggtttgatgtagacagtaaatagattaagcgttcttgggaagaaatgcttataggctaggcgtggtggctcacacctgtaatcccagcactttgggaggccaaggcgggaggatcgtttgaagccaggagtttgagaccagcctgggcaacatagtgaaaccccatctttacaaaaaataaaaaaaattcactgggtgaggtcgtgtatgcctatagttctagctacttgggaggctaaagtgggaggattgcttgaaccctggaggtggaggctgcagtgagccacgatcatgccattgtactccagcttgggcaacagaattaaaaacaaacaaaaaaaagctggtcaggtggagtgggtcacgcttgtaatcccagcactttgggaggctgaggcaggtggatcatttgagttcaggagtttgagaccagctcggccaacatgatgagaccctgtctctaccaaaaaattacaaaaattagccaggtgtcgtggtgtgtgcctgtaatcccagctacttgggaggctgaggcaggagaatcgcttgaacccaggagatagaggctgttgtaagtggagatcgcaccactgtactccagcctgggcgacagaacgagactctgtctcaaaaaaaaaaaaagcttatatattattgtagttctgtttaaaacatcatatttatgtaatatattatgaaaaatttatatattggtttcagtaaattatatttctaagaataattagatataattataccattaagtattatttttaacacattaagttcttaatgtaaaaatttacaacccttataaattttaatatgcagtgtttaataagtgatattaagttacacgtactcaaggggcttaagttatgaaatactaaagtaaggattaatgatagatactggttaatgttacttttattaattttattaaatatttaaattgagtaatcgaacaagtttttataatagtcagtttttaatgcttctacatttgtaagcccgatattttttactcttcttaaaatgaatgagatgatttatatttttagcatatttatataaaaggatagaaagcaaataaaatattccattatttaaaattctaagcagacaaccctacagttaatttttgtttaatttggcattttatatatcattatagatacagaatctgaattacaaactataaactttgctatagccatggttggtacttttaagaagcaacattaatatttattattgtatctttctttgtcttgataagactatgtttttctgagatatcaaaatatagtagctatattcctttcactaagataatggagacctttcctagtgggacatttcagcagttctgaaggggggaaaaagatataaatttgatcatttgccatggaaaaaaatggagtagagaggaaagaaaacgagtttactctccaaagagtagcatgtactctccaaagaagaaaattgccctcttattctagagtcagtatactctttcagaaatcttattcacattgagtgtgcgtttatatgtacagttaaataatggattaatatgtttaaattactttttatgtcttctttatcaggaggatgaggtgatcattttgactaattaaaccctttgcccaattccatctgaatgtctttaggttgtgtgtaatttttagaaaaatgcagtatttttagtctgccatacagcaaatatgttcattaacttttgattagaaacagtttttaaatgaagcaattctttgactgcaagactaaaaattctgcatgatgtgtgttttctgctgaacagttttggctgcatgtgattgtttcctttgcttcttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagtcctgactttcttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtcacatttaaattttttattgcaccttttaacttactttttctttttttaattaacaagaataatgtatatttatacagtacattggaatacaatgtaatgtttgatacatgtatacattgtggaataattaaatgaatatatttatcattacctcatttaaaaaaactgtaatgttgattcaagtattgatattccctcctttttcactcaatttttgtctttttctaatatgctaggattataagactttagagcgaaaattgtaatttaattgaaaaacatctaatttcattattttaattgaaatttttacggataagtgtagattcacatgtagtaaatagtgaaatagaacagagagatcctgtgtatacttttcatggtcatttagtttttgaatgttagaatagtaaagattttcccattgacagattttatttttgcatgttatatagtgcattaattgacctggtgtagtagttttagtgtacttaaataatgtaacgatcagttaattggtgtcttcttgttttgtagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtttgctttttatttttttaagaggaaaaaaattaaatagaatttctgttatttatttgtcatatgaaaattgtctctttatatgcagtttgcttaaaaactttaagaaatatctaaaatatactgagttaaatgttgaatctcccaaatgaagaatgtttcattatcagtcattctgagctctgttttgaacaaatcagtgatattgcttaggaataaacctctcatttttgaagtataaataactgactattttatcctgataaatttagggtaatttttagttaaattttccagttatattacacttttccaataggtgagaagattaattctctatcatctattaaggcatttttgaaaattttcaggatcattgggtgaattaattagggcaatttaatatataaaagcccatgtactttattaatgagaaatgaaaataaatgaaaattttaatcttatgcagattgaaaagagtatttaaatacatggcaaaagcaacttttcaactccagtgtttcagtctgtacatgaacagtaggactttgcataattctaaatttgatctacgaatacagggaatggcaaactatgaaccacagcccaaatttgacccactgcctgtttttgtaagtaaaattttattggaacaatgccacacccactcatttatgtgtggtctataccagcttttgtgctagtgtcagagttgagtagttgcaacagaggctatatgtcctgcaaagcctaaaatatttactatctggccctttagagaaaaagattgtcaacccctatattaagacattattgtacgatcttataccaaggatgagttaaggaaaacctacagcaccatttaatgtagtagtcaataatgggctttggtgttagatcccagaggctctctgagctttggtttcctcacttgcaagattaaataaaccatgagaaggacttttaaagtacagccagtacctagtgtaatgctaaaggttcttgccttagccatgccaaagaattggtgtggtggctgcctgcagtgagtgatggagacagggaccaagagaaaaaaaagccatagactttattgagcagagtgacagtacaaagctttcacagtgtggaaggggtcccgagtgggtagccagagttagattatgcagtttccttttaaactcttcaaggcgggaaatacgtgcagggggaagatgttaccagagcgagaaacaaaggcagtaaattattttgtgatgtgttttagattttgaggaaaaccggaattgcaacttaggttttatttactttatgaccttgcagcggcttggcaaaggagacgggaatttacgggactttacaaagtatgtttacaaggagttggaattaggagcatagataaggcccactggtcacagaaaaatgggcatttaacatttcttttagtttcaggggagggggaagggagagagggagagaggacatagggaagcttatggcaaaatttttgctgttatagctttcttggggaagaaaacacatgcacaaatcctggtgttaggaatattttaagcacatatctttaatattattcatccaggaccaaagtaagtcctgatacaggaaatgagtgagtttcacagcttcctgagcccctactcgacccaggaaggccagcgggcacctcctctcactagcaatagtgtgcatatagggaaagagcacaagaagacaggaaaaaaaagaagattaaaaaaagtgttatatgcaagactcttcttattctgcatttcatcataaacatcgtaattgtaatctgtatatcataaatataatgaggtaggggatattatctccattttacagaagtggaacctgtgttgaaatgatgcatgtggttattgatgaagttgtagatgtgagagctggttctgctcatgtctgactaacacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaatgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttgcatgatcaagttatttgaagagtatgaaatgcccaaaaggtaatgctatttgcgttatctcttatttttcttctctaacttccttctattgagggtaaagtgaacagaaatcagggaagattggaaagagacagggaatcaataagattaatatgtgattcaattaattattttaaaagctaagattttattatatttgtcttcatccttcctatgactcttcctatagatccaaatggtttctttctaattagaagtgatttcttttttccctagggagcttaatttggcatgtcttagcaatttgaaaaaatgttggttttggcaggatatggtggttcttgcgtgttatcccagcattttgggaggctgaggcgggagggttacttgagctcaggaattcaagaccagcctgggcgacatagtgagaccccataaaaaaaaaacaaaaaaacccccaaaacacacacacaaacgcacacacacacacaaaataaattagctgggcatggtggtgcatgcctgtagtcccagctacttggaaggctgaggtggaatgattgagccctggcggtcgaggctgcagtgagccatgatcgcaccactgcactccagcttgggagagtgagaccctgtctccaaaaaaatttggtatttttataattattctactggaaagattattctccaataagcacttataggactcttaactgtcataaagaagtttttgcatgatgaaaatgcagaaaactgcattgggactgcctatgtttttaaaattccacataacagataaaatgttattataagaaactttaaaaatgtttgaagaagttcttttttggaaagaagtgatatgaaaactttacatgatagtattttgccttttaagacttattaaaaatcctgttttttttttttatcttagccttacataatttttggaggtgtgtaagaaactttgcgatatagtaaaaaagaagaaatatttaaatgaattatttgatggtcaattttttgagagctatataattttaggcaatatgtatatgtatagaacctacacgagtaataagcacattttcatagaatgaaacattcaaaatattctcaaagtatctctcttttttctttttttttggtaggagctttattgagatctagttaatataccatacagttcactcaattgaagtgtatatttcagtggttttcagtattttcagagttgtgcaaccatcaccatagatttagaacattttcatcaccccacaaagaaaccctgtacccattagcagtcactcctcattgcccacttctctcaaccctaggtgaccactaatctacttcctgtctataaatttattctggacatttcatataaatggaatcatacaatatgtggtcttttgtgattggcttctttcacttagcataatgttttcaaggttaatccatgttatagcatttagcagtacttcattttatttttattgccgaataatatttcattgtatggatatactacattgtttatccatttgtcagtttctagacatttgggttgtttccatttttggctattatgaataatgctgctgagaacgtttgtgtacaaatttgtgtttggatgtgttttcatttcccttgagtaaataccttggagtggaactgctgaatcacatcatggtaaactctgaccttttgaggaactgtcagactttttcaaagcagcttttccactttacaaagctattcccatcagaagcgtatgagggtttcagtttctccatatcctcaccagtactatgtgtatgcttatagcaatcgtacagggtgtgacgtgttatctttttgtggtttttatttgcattttcctgatggctcaagatgctgagcatctttctgtgtgcttactgaccatttgtatatcttttttggagaagtgcctgttgagattctttgcccatttattaattgggttgtctttttattaccaagttgtaagagttttgaaaatatattctaagtacaagtcctttatcagatatataatttgcaaatcttttctcccattctgtatgttatctttttactcatttgatagtgttctttgaaactcaaatttttatttcagtgaagcctaatttatctgttttttcttttattgcttgtgattttggtattatatcaaagacatgaagatttactttgtgatcatgaaggtttatacctagtttttttctaacagtttaatagctttagctcttacatttaagtctttgattccattttgagttaatttttgtttatggttgaggaaggggtccagcttcattcttttgcatgtggacatccagttgttccagtacctttattgaagaagctgttctttcctcagtgaattgtcccaacatcttattattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagaatagttaatcgttagtactttctctgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttttcctcacatacccctgtgcaagcacacaaaaaataaaatggcacacgtgcaggctggatgtgccaatggcagatttctcaaaatgcccacatgggtcaagacctaactgcattgcttttttttttttttttttttttttttttttttgctattctctgctctgcagtgtaaagatattgaaaatgtcaaaaaggcttgcagatacccctaagggtaacagtaaataaggaaaagaggaagcatttgtactgatctctagcacagaaagtcaagctgttggaggaactggacaggggtatacatgtatattagtgtgtatatgaaacataaatgaattttgtgtttcgaattcagctcatcatgtatatgcagttattccaaaactggaaaaaatctaaaatctgaaacacttttggtcccaagcatttcagttaagggatactcagcctgtacaggtaatagtaaatgtctcttcactcccttcgaccccaagcaatatgagtacatgcttattacgtatatgcataaacacatccatagacagatatgtacatccaaattgatctatttaggtgccttacagcgtttgcactaaaattactccttgaaatttcttgaagtcatatgaattttaatgatgagatactctatttctctaaagagttaatatattgaaaaggattataatctatcagtgtagtttgcttatagggtcaaaaaaaatgaaacagtgacagtttaatattgatgtgcttaaaggattataccatggacttccccaagggaggatcttctgttgatcttagcagtacgggtgtttgacaaggatagtgaaaaagtgaggtagatttaaaagttacaaataagccttgcctattatatggttttttgtaagtgaagtataattctaagaaatgggtcttgaaaatctggtttatataatacttattaatttcaatgaaaatatatttctattaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaagtaagttccttaagtaattgcactgcaaaaattttgccttgcagtttgtcaaggaaaaacataagttacattctgtttaaaacctgagcttggtagatcaaaattctctacatctcagtgtagtaatccaccatataaataaatggagtttaacatagctcttaaagttgttccttgctgatatttggaattcataaggtaagagagaggtttacttttctacaactatgaaaatatgagctgatggtataaatcaatatatgacagttttaggcaacagatcattttactttaaaagtaatttttttatgccaataatgtgtactaaaacacatctattaagcagatctcacttcagcaaaatacttagcaaatgacactttccttatgtttaggattctttatttgggagaaattacaaatgacgagaaataagggcttaaccaagattttaaaaatcagtaaccaagaacttctagattgtacctggatgtttttatacttttgtctccatgtcctatattttatatatttttggttttggtactgtagaataaaattgacattcagccttgtcattctgaggcactgcaggatcttcatttgtggagggaagaagaccctttatctcttactaataagataggcagtgagctctagtgacatatttccgaaaaagttgcaacaaatttaaacaaagaattttttgaaaaagcttttagcctctcagaaaattggctatctcttattcttttgaaaattttagcaaggtatgcttagcctgattctttgctaagcaaattcaaaattgttcttgttataaagaaaaactctggaagaagtttgtagagtaccaccctacagcctacagttacttggttccttagagatatctctgcggcccaagggaaagcccataaatgtgcaggtgggtggttctcaggcattgcttcctccattttcccattttctccttgttccaaagcagttttttgttgttgtttccttttttcaatcaatgccattccagaatccaaagcagctcttttatgtactctatatatagcgtgtccacatgaaacttcaagaaagggttccattgcagaaaatataagtgagaaatcactgtttagagaggcttaagtatcaaatgtcaggctgatctgaatgacttataattctacttccaaatttgactttcttttttttttttttgtgctctcttggtaccccatgcttatctttatgatagtatttagcatggtgtttggaaattctcttctgtgccagtctctcttcatcagactatcattttcttgaggacaatggctctgtgtctgtacctgcaacatttaatactattataccatatagtcagttatattaaatagtagaatgggacagttcaaattttaagatgtaaacattttatcctaaacagtgtaaagaagttaccaaactttaaagttatcctgaattaaacactgtttcctttgcatttaaggaaaaccaaaagggaggttattcctttgaataattttgtatgtattcaggatgtaaattaaggtcaaaatgattttttaagcctaattttttttaccccaataatagacttttgatctaattttaggtaattccattagttttcttgtagcagttttctacttagccccatttatctgtgcctattctcacatgacctttggtaactctttattttgttcttctctgtgtgtatgtttaggtgcactctgtggcattttcacagtgcactattataaagaatttttactagcatagttttcttttatagggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttggtaagtagagtttcttttgtgagtatatatttgtttcatattttttcacacattagaatttgttcttaaatcttttctcctttgtaactcattttacttgatgtatgtgtaattatatgtccacactcacatttcataatatgacctagatagggagctgatactttaaagagaagaggaaagactcgtggggattagttttgatgatactaatgctaaaattaaaacattgattgaaactgctagagttaaggatatctctatactctaaaaggaatacaactgaataaaggtaaatccttgtgtgctactaataaagataatacattcactgattaaataacaaaaaaagataaatagagtcactaaaaccatttactaatttgtagagctggggataggttgacctaacttacaggccaacctcattactatgtttagaaattcattgctgttgctgtcagcaagtagctatattttccatcaaattaataagatatcaaggtaagtagttaaacaactgtagagctgttcaaccagaaatgaaatgggtcaccagcatgtgaatgctgctttgctctgagtgacaaaaatataaaaatcttgaaatgtaaatctaatgggttttgtattgggctttatcaatgtgggcattctttctgactgtgaaggagtagtgtcttctttgtggtttttgccaaagaaatgtatgagtgtttacatttggggagggatggagttttgcttttgatgtaatacgtattttaaactttataattctctaccttttgttcaaaggtagagaattattattattattaattttttttccttttctacaacagttttagcataacacatacaaaggattataaaattgtaaagccgagtgtatcttagacatcatgcaatataatctcttgattttagaaatgaattggtatccacagcatttttgataagtaattttacagattatgcagaaaaaaatcttctaaagcacttgtattttaagtaatttttgtgcttaatttagattgctttaatacctgtgctttaaaaaattgttggccgggtgcggtggctcatgcctgtaatcccaacattttgggaggctgaggccagcagatcacttgaggccaggagttcgagaccagcctgggtaacatggtgaaaccctgtctctactaaaaatacaaaaattagctgggtgtggtggcacatgtttgtaattccagctacttgggaggctcaggcatgagaatcacttgaacccgggggcggaggttgcagtgagccaagattgtagcactgcactccagcctgtgtgacagggatcctatctcaaaaataaataaataaatagttaacatgtggcttacattttatatcttttagtatacaacatttatctcatttgagaaacaccttatttgtcaactgaagcagggtatttttaatacttttaatgcctataaagttttgtcttgaaatgagaacatttgggaagtatagaacaaatatatataatatacaaatttaacctaattttaaattaagccattattacaattacattttatcctatgataaatttatatgaagttgatctcataatgactcttggttctggttttatattttcagagtactttgagcataacagttttgaacaattttgcatcaactattgcaatgaaaaacttcaacaattttttaatgaaaggattctgaaggaggtaattgccattataagtttaatttaagatctgcataaagctattttaaattttaaggaagagatatgctgcagttaccctgattggtgtggatggatggtgtataacggaaggtggctcagggaatctgggaagcccagcagaggccccggggctcaggcacgtcagaagtgttaatggttcagctgaagtttagggacccgataaaaacccttaataggggcttcctcagaagtgaacatctgtttttagtagtgacttttaatggacttgaagctctgtttctttttatgattttgttgtctctacttcttttttttttttgagatagagtctcattctgttgctcaggctggagtgcagtggtgtgatctcggctcactgcagcctccgtttcccgggttcaagcgattctcctgcctcagcctccccagtagctgggacaacaggcgtgggctaccatgcccaacaaatttttgtatttttagtagagacagggtttcacaattttggctaggctagtctcgaactcttggcctcaagtaatctgcctgcctcatcttcccaaagttctgggcttacaggcgtgagccaccgcgcctggcctgttgtctctacttctaccacaccaaacaaccttctacccgcatccctgcctttggcatctcccactcttttttttttttttttttgagacgaagtcttgctcaggctggaatgcagtggcgcgatctcggctcactgcaacctctgcctcccaggttcaagcgattctcctgcctcagcctcctgagtagctgggactacaggcacgcgccaccatggccggctaatttttatatttttagtagagatggggtttcaccatgttgaccaggctggtcttgaacttctgacctcaggtgatctgcctgcctcagcctctaacagtgctgggattacaggcgtgagccatcatgcccgactgtagctccccttcttcaggtctctctgcttctgcctactctgctgctggctcacctttccctgtctggcagcaaagccatcaagtcaggagatttgatgcatccattgtcctggagtgcctctgggcagtactttccttgtcatgccaccttttggactgtcagctgcttctactttatctgggctgaaatgtgcaatcattttatttcctatttccatcctttctatcttttcccacattttaattatgtttatgtttttgtgggcttcccagcacattctagcttttgtacattttacttacattctgtagttaaatgaattctggcataaacaaacaggtaaaacaagtacttaccagtaagataatttctctgaaaacgtttatccagtcacattagttctattaccatgtgaagttttaccttcatgcctctaatttaacataagctaatccttcccttctacaccaacctaccaaaaaactttatctagaaatattgtaaaaaggagactgtattttgatttatgttcacctttttaatatactttaaaataaatgtgaatttcaaattgagttgtgtttaagtggacagtgccttctagaatgtcagaaatcttttctagtatctcatgggaggaaatatttaaacactcaggaaacaatgttaaaacatatttacttaagttcattgcatagtttatccatctatgataaaatccctttaaaaattttaagaagacacaagacatatttgaggactcaaatttgatcatatattgttcttctaaattacacttattttccccaagtgatgtatcatatatattatatcactgtgttggtattagagcccatttgcagttaattgctatttccttacctttagtgcctgtctgcaagtgttcaaaaatctgttatgtttttggaaaaccatttaaggctataccagtttgtataaacctttgcattctaattagcaaatgttatgttcagaaacagtgcaaaattcactattgctcagtattgctgtatctatgattatgattatttcatttttaggaacaagaactctatcaaaaagaaggtttaggtgttaatgaagtgcattatgtggataatcaggactgtataggtatgtgttttttaactccacctttgaaaaatataggaagatgtagtgaatgtgtttagtgctttttctgtgctttttaattgacattacttgttatatgacttgaaactggtatttgagagaaggttacttctgtattactgcctggaagttattttttccaccaagacttcaaaggtatctttgttggaagttttctataatctcttctatttattttgaaggatgttttcctatttaaatagttagcatgtgaattggttaagggggaaacttaattgcctagtcagtaaagacatttattcacctgaggaagtccatagttaggccaggctccaggcaagtttgtcagggtttgccctgcttttctgtgattctcttgtttctgctgtattctgtgcattgacagcatcctctaactggttgcgagctggcttcatgtgtcacagccagataacactgcgcagcaagagaatagaggctctgctttcattttagtggtaaagaaacctttccctatagccgcacagccagttttcagtcttccatttctttcccaccccatctctaaaataaactgttgggcaaaccttgtttttaaaacagtttgataatcctgtcagtaactgatgtgctggatttgaaaaacatagtataataataatactactttacatcagtataaattttcaaagcactttcacatttcacttggtccactccacatttccttaacacacggaccctttctaacctctgagtctttgactgtgtggtttgatatggctggaactcttccccttccatttgtctttcagcccactttcacctcatgctacatctatcaaaatactcccatttgtagcttagttcagcatgcccctcctgccctaccactaattacccaagaagcatcattttctcactaatgtagttagaatctttctcttcctatgtcttatagctttgttccacttaatcattgttatatactgtattcaagcagtttacattttatagttagttttggacaggaaggaatttcaaacgaatggaaagagcgtaaaaatgtgttgttacagattttgtttgaaagcgtttacatcagtttctaaaagtattattaaaaagctatgcatgtagaagtttctgtagttttactttactttgaatatagctgtcatttcgaaaaggaggaatttccaattccttagcctcttctcctggtttacaaatggaatggttattatagtcatttgctttctttatgtagtagcttttctaaaacctatattaaatatatactgttacttttttataaacggccagatttgaaataaaaatccgtcagctctctataacttttgagagaacacatatagaatcacatgctatgttgtttctgatcagtccttgaaatctgtgattagtgaattgttcacatatctttaaaatgttatgtttttacactattgtgagtgttttcattttttgaaatagatttaattgaagccaaattagtgggaatactggatattttggatgaagaaaatcgccttccccagccaagtgatcaacactttacatctgcagttcaccaaaagcacaaggatcattttcgactcactgtgagttttgccattctgaaattgagactatggtgggacgagacattattaaaaaggtgcattagctattagatattactagataattagaataaaaattatggcgtgtatagagcaactatattatatccagcacagtatcttccttagatggatggatatttatatatgatttttatgtagtcaagagactttttctctgatgaaaagtacatttcacctgtctaatacgtacaatgtgcctgtagtctgagatactagggaagctgaggtgggaggacagcttgagcctgggagtcgaggctacagtgagttgttagcatgccactgcactccagcctggccaaaagagcaagatcctgtgtcaaaaaaataaaagtacaatgagaattacctgctgtcttcatggtctcccttctgagctaagtgggtatcagttgctttgttttgtgaccttaatcacattccaggagttggcactcggagtcgcaagcagccatctgtctgcttatttgtaagaccagcagttaaggttgtggcttagaactcttgactggtgcaggcaatacaaattagataatgatcagccaattcattttgaccctctttcctaaggagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcggctcactgcaacctccgcatcttggtttcaagtgattctcctacctcagcctcctgagtaactgggattataggcatgcaccaccacgcccggctaatttttgtatttttagtagagacggggtttcaccaggttggccaggagagtctcaatctcttgacctcatgatctccctgccttggcttcccaaagtgctgggattacaggtgtgagccaccgtgcccggctcagaagacctggtttctgaactgctgttaggtcgcagagctgtgcttgagtctttagagccattttccatgagggtggactgtgtggctattgagatgtttcctgtgttcacctcttctgaacctgtcttttcattcagccattgttacctgaggtaataaaagcacagctccatccttgtacccagaaagagcctggctagcacagacaatgtgctagccacacaaatggatgtcagtttcgaccacaaagatagttgctgcctcatctcatagacaacatcattaacaacaacaacaacaacaacaaacaggagagtgaaaaagaaaagccgtttagagttgcctagtggaattagggaactaataggcaaaattgcctctcaaacaaactgtatattattttgagattgtaacatagtataatgattattgctttgatgaatccagaaacttaagtgaatggtaacaagtagttttgtttctattcatcattaacaaaatcagtggtaaataggtgaattggatttacctgaaaagctcatgtaattgtgttaaccttcactagggactaaaatctcacatccacctgctccattgacttgcaattcttctgtatccctatatatttcttgtaatgtggaatctatttctgttacttcagtggagatagaaataaaacaatatgtatcctcaacaaaacttctgctaaaattgaagatatatatccaatcctattccttaatagctcgctggtctttgttatgaccagcctatggatgcatgattacctttaccaggagttggcacctagagtcataagcaggtgacttaccaggggcactaattgctagtcaacagaattgtcacgagtgtctcagaggcatgtgacttaaaagacagtaaactgaagcatcaagaatggaccttggctgcttttgtcaaccaagaacaagagtaaagcagtaaatcctattttatataggttattccttttgttgtattttttgaaaataaataaaataatcatttattgaacacttagatgtggcaggcactattctaatgtttttacttgaattatttaatcctgttagatgtgtatgctacagatgagacatacaaggagaggttaagtgacatgcctaatatggcatgtaaagaaatggtaggttgggagtcaggctaggcactttggctgcagagccggcactctgacttgtcctggtgtattgcctcccacagggaacagcctctctgttctgctacctctttaaccttgagcaagcctctaaggttcccaagtcagttttctcaattttatttttttgatttttctttttctttttttttttgtagagacagaattttgctgtgttgcccaggctagtcttgaactcctgagctcaagcaacccacccgcttcagcctcccaaagtgctggaattataggcatgagccaccgtgcctggccagtactaactgggcctgaccctgcttagcttttgagatcagatgagattaggcgcattgagagtggtatggcggtagactctcaattttaaatgatgtcttttttttttttttttttttttttttgagacagggtctggctctgttgccctggttggagtgcagtggttctttcttggctcactgcaacctctgcctcccgggctcaaaccatcctcccaccttagcctctcgagtagctgggactgcaggcctgctccaccatgcctggctaattttgcatattttttatagagatggggttttgccatgttgctcaggctggtctcaaactcctgaactcaagcattccgcctgcctcagcctcccgaagtgctaggattataggtgtgtgccaccacacctagcccaacatcacttttcttacccttaggttatttcaagggtcagatgtgatcttgtaagtgaaaacattttagaaactttatgatatacatgtgagatattatgattaaatggtacaacctaaaatgatttagttttcttgaaatagattcaggctccttgtgtaaatatgttaggctatattatttgaaacggtaggagagtccctttgctgatgtcaggtgtttctttgactggctgcacatggaaatgatttgatataaatggtatgggctttgggatgtttaaaagttctccaggttgatccttttgtagttcataagcctgatgattggattttcatgctcatgtgtgcgatcttcctccctcagccttgttaatgtgttggcacattactcatctgacgtgataaagatagattttaaaaagttatccaggtaattctaatagagcaccaaggttgagaaccactgctttagaaataggtggttaactctgtaaaatgccaactgggttttgcatgtgcttttaaaaaaaaatttttttattacaagcatgttcttttaaattgtgtttttttttgggtctctttctctccgtctctgtctctgtctctgtgtgtgtgtgtgtgtgtgtgtgtgtgtgtgtcttacacctattttctttcctaagagattataccaaatatttgctagattttattgatactttaaggcatactcaatacataaaagcagtataattgtgaaaagtgtgaaaatttcctgtataattttaagtgttttacatctcagttgttttgtaaagaatgattatgtaatatatttttgatcatttaataactcatatatgtattgtttttcagattcccagaaaatctaagctggcagttcataggaatatcagagacgacgaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgacggcgttggacagtgcagatacagaacatttctgtcatcacagaaagttcctttggacagagccatgttaagtgatgttatcacaagatggacagaaacattcctgtttgatttatttttcagacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaaggtatttgtgttatttaattttttttttactatatttaaaatgaaattattgttttatattctaaaatggataatgtagatcactgtcagaaatctcacagtgaagttcaagagcagaccctgcattgttgatatttgtatgtaaaatatcataatgtaggcctagtaattgaacatacagaaatgcttgtaattatctgaatgtgttcattcttggttcttaacatatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgattcagtttgtaattcattttcaatgtgtttctctcacaatggcattttgggtgtgcatattacactaaaatttgattaaagcttttaataacttctgttaaagataagcacttaggtgtggcaaactcttcaaactgcttatttaacatggaagaatatttcatttgttttattaattttggatcaggaatttattcttcaaggtctgacatggaatggcacagggtttgtcttagaacactactaattggttctagttattgaggagtgtagaaaaaaaatgttaaaatttgtgaagttatgagtttaatgaatgacaaactatagtatgtagaacaaaaaatgtatacgagagaattaatttcttatatatttctacagagtattattgttatatttataataaaactctacatttgcctttcactatatgtactttaaatatttaaaataatgtaattaggaaaaagatttaagtgtctgaatgttatggtactgataatataagcctccccaaatttattttggattgaaatgggctctaaataactaaattgataaaatatttataagagctagtttttttttaagcttaaacataaatatagggaaaaacctcataatacatttttaggtaactgaataaaaagccttgaattttgttataagttatattcattattatgagtttctgattcagtgaacaatcttttttttatttgagtattcttctatttctgaatcgacatttgatagcagattggtttaaaaatagtatatttgcctatatgaaatggatgtcattcactattttcctactctaatattattgtagtattgctgataagagcatacttgaaattttagaaaatataaataaagacattcttacagtttttctttggattacataatcttttatgttgagccttgaaacttcttataattgcttatatttaatacaatgtatttttttacattaagccactgaaagtgatagctgaatgatactaataataaaatatttcacgtttttctctgagataccttgaaatgaaataggaatagattcctagttttaaatatagtagaatagctcattaaattaaaattgaagtatataaggcaataaacacaaaacaggctatcatttacagcaatacttcagttatccagcatccctggaaaccagaaattttctattggaaagtgcctttttcaggttattgaaacataaaccctttactgttagtgttttagaaaaagtcatcctttttgatggaaacataattctattataagaatatttgtatgttttcaaataaaaatacaaataaagcatgagttgcctgaggctttttactcttaagccttatggtccttggctgttctttgatagttgactttcttccctcttttctcagctgctaagagtttattttgatgcttctgttcttttgactttatctccattttttttttttttttttttttttttggagaatactgtgcttagtctgtggatgaaggagtctggactttgcgacagttattttctttccaaattagtcactttaatacttttcaggcatggtggttcagattgattacggttgtcagaactctgtcagtgagataagtgggatacaactgtatttctttaattcaatgacaaatccattccattttaataacttaagcttctcagtatatgtgatgtatactgtaatagtatcactcacaggagaatgaaatttggtgtcaggccgatgttggaatcatgactttgccattattagctccgtaacctcgggcaagttatttatttccttggattgtcatgttctatccttaattagattaaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtcaattttttttgagaaaattgtccaagcatttaaaaataactgaaatgtaaaatgttttaaaatgttaaagaggcagggtgcggtggctcatgcctgtaatcctagcactttgggaggctgaggcgtgtggatcacgaggtcaggagatcgagaccatcctggctaacatggtaaaaccctgtctctactaaaaatacaaaaaaatttgctgggcgtggtggtgggcgcctgtaatcccagctactcgggaggctgaggcaggagaatggcgtgaacccgggaggtggagcttgcagtgagcctagatcatgccactgcactctagcctgggcgacagagcaagactccgtctcaaaaaaagaaaaaaaaaaaagttacagaggatttctatagctaggcaggacaattttgtttacactaagtgttccataaaacaatcctaatatatactattagtgtatattttaaacatgtcttcattcctaatgtgtgtgacacaaactacagtttgccacattcaaagactgtgctattgatctcttattaaatgcatcctcactattttcatttacttccttcattgcctgtacattttttcctcattcattccatctgcaaatatgtgtgtatgtttttaatattgctaattttcagtcttttaattatacaacttctgtgtaagttattgttcttgcattacattagccattttgcatgatgctgtctgttaaagaatttgtgtaccaggaggttgttaaactggaatgtgttgtatttggatgttattgcatgttattttattccagtactggagagctaatattaactcatgacactgtgtactttggctttttgaaataataaactgatttcctttctttcacagacacagttaaatttgcttctggataaacttcgaagtactgtgagtatgcttaaaaagaaaacaggtttttatgggtcatctaaaactattattagtaattatgcaagtaggcatagtaaccctgtactaattaaaaatacattttaaactttattctcttattttaaaaaattagttttttttctgaagaaaggtcaaatatatatgtgaagtcagattattttataaatatatagaattcttgactatttaaaaattaagattatcttacagtttcaagaaagtgaaaataagtggtaatagtggagaatttttcttaggattaaagattagttatgaaattcaatcttattttattactcttacagtaacattctccagacatggcaatgttgatgtggaaaaaatggacaaaatatttttgtgccctgctatagagacaaaatttattagaagcctgttttttaactatacattttagtaattcaccccattttcttaaatgagaaaaacatcatagaaagaaattatatgtggtttatataaatgaagcatgattccaaagtaagacttattttttacacaaatccacagaacttgaaattttgtttttgtttttgagacaaggtctcattctctctcgcccaggctggagtgcagtggtgcaatcacaactcgctgcaacctccgcctctctggttaaagtggtcctcccacctcagcctcccaactagctgagactacaggcatgtaccaccactcctggctaatttttgtattttttgtagatatgaggtttcgccatgtttcccaggctgttcttgaacccctgggctcaagtgatctgcctgacttggcctctcaaagtgctggcatttcaggcgtgagccacggcacctagttagaacttgcgtattctttttcaaatagtcattttgaatagctagacatttattatatcagtattattgttgcttaacttactgttagattaatttttggaaccattaaaaatctttttaatatcctctttggctgcaaatatctatctcttaaggccatgtatatttaaaaaccaaatctgatgaagagagtatttttatttcttagatagggtgctgctctaaaattatgagattactttgtgatttatagaaaaaaaagcatttctaaaacgtgttctagaagtgtctgtgggccgggtgccatggcttatgcttgtaatccccagcactttgggaaggctgaggcaggtggatcacctgaggtcaggagtttgagaccagcctgcccaatatggtgaaacctcgtctctgctaaaaaaatacaaaaattagctgggcatggtggggcgcacttgtaatcctagctacttgggaggctgaggcagaagaatcacttgaacccaggaggcggaggttgcagtgagccaagatcacgccactgcactccaacctggttgacagaatgagactctctctcaaaaataaaaataaaaataaaaataaatgaataaataaataaaagtgtttgtagggagcttcattgttgaaataattatttgcaaggtaactactttgaagagaaacagttatttggatgtctattagcttcagtactcaacaatacgtttcattgtatacataatcagtattctttctacctcattcagcataatctgataattgattccaaatgaatgcctttaagctttaaaaaatattgtttgacaaacaaatgttaaaatgtacaacagtgcagcttagggacctactgtatgtttttgaaatagaatgattgaaaatattgttttgttttcttttacactttggcctaagtcttaaggggcataattttatttactccttttgtcatagggaaatttccttatcatagaaatatggcatacataaatacatttaaatatagaaaaaaatcacatgtacatcagcctgcaaagtgtgttgtttaaatatgttaaacaattaaatgtgttaaactttacagtgaaagacttctctttttacagtttttgacattcaaatctaaaatgtagtatttttgtaatattattaattagtaattcaaaaagtcattgtaagctttaaagcagaaaaagtatgcttgtaaaattttgagttttttttttttttgacggagtctcactctgtcacccaggctggagtgcagtggcgtgatctcagctcactgcaacctccacctcctgggttcaagtggttctcctgcctcagcctcccaagtagctgggattgcccaccaccatgcctggctaatttttgtatttttagtagagatggggtttcaccatgttggccaagctggtcttgaactcctgacctcaggtgatctgctcatttcagcctcccaaaatgctggattacaggcatgagccactgctcccagccttgagttctttagtaattacttttacaggttcatatgttaatgttaatatgctttgaaagttgcaggtattcatagaaacagaaaactaagaatgctatatgtattgtaacaaaaagtacctttattttcctagggagcaagctttattcgttgcatcaaacctaacttaaagatgacaagccaccactttgaaggtgctcaaattctgtctcagcttcagtgttcaggtattttcataatctctgtcagtgtgtgttagtagtcatagctcaaatacaatttaataggttcagtattttcaaataattcaccattatcttgattattttacagtgcaataaaattttcatcttatattttctttaattataagaaaagtatagagccacatgtggtggtgtacacctgtagtcccagctacttgggtggctgaggcaagaggactgtttcagcctgagttcaaagtcagcctgggcaacatagcaagatctgttttagaaaagaaaagaaaagaaaagcatagatggcaaattatttgagcaatattgagatgttgtttattgtgaaataaacaatttcacattaaacatttatgaaaactctctaacagcaaaactggatcttccttaagtgggcagctttctcaatccagcagtagttcatttctcattccacacatgatggtcagaaggtaggttttgttgtcctttcttcccactccacgacttgtaaagaaaatgaaacacgattccctctgcatctgtgacacttcatccatttgcttaaactatcacttcctacccctcaccctgccatgtctgaccttgctcaggcaccaggcttgctctgtttgctttatgccttgcccatcctcccttctcaccaacactacccctaatttttcccaaggtatcagccttctcctttcttgtttaccttttgatccaactcagcttcctgacacttccttaaactttcttctctgactccttattttgctcttttgagaggtagatttactatgaagctaagattacttaagcttcagggtccttcatttaaataaaccccttccaaagccctgcatgtaattttctgcttcgctaaaggcctctccccaactatataagcttcagcccccgcctcacaaatctagatctacccttgacctctctcacaaaaccatagctattgagaaatctaattctgttctttcttattgtctgcacagggttggtagacaagacaggatggcaccagttaaattcatcgtcattatctttaaagggctctcaaacctgtcctgccaagttttcctggtcagcatgttctgtttctcatcagagactggtcagacccatcctgctttcctcaaatctctgcgcctctgctgtcagatgggcttacctccttaactaaatatcctaaagcttctcttgtctgctatcaagcacttctgcctaccacttaaccttccctcttgttgagaaagtaggggttgcctctctgcctggttgaggcttatagttctttgaaagccatctcttcctagtttttcatggatcttcagcattgtttatgtttgtcatactattccctttcagatggatctttcccattaccatttaaacatgctgaaatctcatctctaagccacatttctcttacagctacctcttcctccttatttttctccagttccttttctctccaagaataggttattgttgctttttcagtttcatgcattctacttactctttaactccaggataatttagctcccaccttgatgaggtcaccagtgattgccttgttctgaagcaaatgtcccttttgcagtccttattttagtggacttcatagccacatttgactctggccaacccttttaacatatccttttcttggttcctgacatggcgtatgcccctgcttttcttttgaattctctgaccattcctgattcccctgcaggctcattttcttctacctggacatatgttatcatttttcaggatttaagttaggcctctttttcttctcattctatgtcagtactgtccagaagacctttacatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaagtgatccttctgcttcagcctctcaagtagctggaactagaggcatgtgccaccacgcccagctaattaaaaaaaattttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatgtgtattcccttaggtaggctccccagttctgctattgtaaccttctaaatagtgagtcctgatagtctctaatccaagctgtcaccatctcttacctggatttttgctgtagcttcctaagtattctcctatctcttcagtctgtttttcacatgcatccagaattatcactccacaactcatctctaatcatcatgtccttttactgcttaaaatgctctaatggcttcagatgagtattagggtgaagaggtcccatagagcctggcccgtgtgtccctagcttcatttgtttacactctctccctcccttctctccttcagtcaccctgactttcattttcattccctaaatgctgcatatttcctcccagcacaggacctgtgcacatgctgcctcctctgtttgggatgttcttgctatactttttcctttatctttcacatctcagctctgtcatcacttcatatgaaagcttttcttgatattcctgacatggaggggagcctgaatttggggtgctgagctcaagtgcctttatttcacagttgtagttacaaattttatacatatttgtataattattttatttttccctcctttattccataagccccatgagggtgggaactgcatctgttttggcttacacatacattcctatttccctggcatatactagactcagtaaatatttgttgaatggaatgaacagtgtagaaaatatgaagatttatttgtgactaatgctaacaaatactggaaaattaagtaattcatgtctgttgtattcttccataaagtagagatgtatttttgtaatattcaagtccatttttttccccattggaattcctctttatttcctaagtgaacacctagtgtcctggcaagttgcacctgtttagatttagctatatatgctatcagattagtggagagggtataggctactgatgaatgctttagctaggattcctctttcaataagcagtatatttcaacatcttaagacatgttggcactttaacagataataccaattcattatactttgatttttttaagtatcaataatagatatcataatagtaataatgataatgatatagaatttgttccagtcatgtagctaggtgatgagaaaatgcaaaaatccataagttgtagaaataaaaatatttacgaagctttctaaaataaagatatttaagatttgaattgtactttaactttccattttcattttaaagagaattaataaatttaagtcaccttttactaaaattactatttttttttttgagacggagtttcgctcttgttgcctaggctggagtgcaatggtgcgctcttggctcaccaccgtaagctccgcctcccaggttcaagcaattctcctgcctcagcctcccaagtagctgggattataggcatgcaccaccatgctggctaattttgtatttttagtagagatgggctttctccatgttgaggctggtctcaaactcctgacctcaggtgatccgcctgcctcggcctcccaaagtgctgggattacaggcatgagccaccgcgcctcgtcttttttttttttgagacagagtctcactctgtcgcccaggctggagtgcagtggtacaatcttggctgactgcaacctctgccttctgggttcaagtgattatcctgcctcagcctccccagtaggtgggattacaggcgcccaccaccacacccggctaattcttgtatttttagaagagactgaatttcaccatgttggccaggctggtgtcgaactcctgagctcaaatgatctgtttgcctcggcctcctgaagtgctgggattgcaggcgtgagccaccatgcccggcctaaaattactatcttctgattggcaaataccagggcaaagtaggggaaggtgaaagaaggcaagttttcttcttctgtaaccttggggctgtgctgcctgtcttgtagcaaagaggggtgccagctctgcaccgagaagccactcatcaaactccaagagtaaaagccagttcatggaaatgtttagaaggcagagtatttgccttagtggttaaaaaaaaaatttaagcttcaaaacatcttaagagtaaactagctgcaagtgctgagaaagcagttgtaggcttggtaatttgttaagcaccatgaaattcttaatgaactgtgagccagtttatagtttgcagctacagggcaagccaggagacttagatgcatacatttccaaaggtacttgtttatttgatacaagtgggcaaaaactgtgatgatactaaccaaactttacttttctttctccaagcaaagcctagagctaaatctagttctggagattttttttccccatacgaatgatttctttaatgtgtttcattaattaatattgaaaattcacagtaacagaaattaaatagtacagaataatataagtaacaagaaatctcagctcttaggggtgaccacttaactctacgtcttgggtatattttttatgctggttagattaagctctgctttattcttttaaatatgtcatatcccatcatatggttgtaacataatcaattgagattttagtttttttctggttttttttctattaccaacagtgacccagaggacatctggacattgtccacatgcatatctttgcccacaagtgtgaaaaatcatagaatagatttaccgagccaaagggatatttccaaattgccatccaaaattgttacactggcttacttttctgctaagaatgcatctgtgtgttttcctacactgtcatcagctctgagtactagttgttatcttatacctttgccagtcaaatgggttaaaattcaatctgactgtctgtaaaggccatctttcctgtgagattactttaaaataaaaattcactggtttaaaaagtcttagagtttgttttaatttaaatttttggctagcaggaatttattttggtgtaagaagtgagacaaggatctagtgttgtttttgttttccaaatggcttgccgtttgtcataatactatttattgaataatcttactttctccgttgatttgaatagtcccagagactgaaatctaggtcttgtaaataaaagtcctggcatcacttatagctcagcctttccctgcctatctcacactttttctgacctgaaaagctcacattgactcaagactcagattaaccacttactagagttatactgaaaatagatatttatccaatagactaatcatcccagtagtctagttgctttgagaagtgagtgaaaggcagtctttatagtgaaacagtgagctcttctttcttttccatttgccttatgcactgatgataacttgggaatgtatctactttttggagtttctttcaggaattttgttctaaaattcacctcaggcctttgaaagtggtttaatgcagggctttgccttatatactgtgtttgtgacacagagtcttctaacagaaaaaaagatacaaactagacttgatctttccttagttttgttttgttttgttttgatacagtgtctcactttgtcacccaggctggaatacagtgtcctgcaaggctcactgcagcctccacctcctttggctcagatgatcctcctgtctcagccccctgagtagctgagactgcaggcatgcactagcatgcctggctgatttctctattttttttttttttttttgtagagatggggttttgccatgttgcccaggctggtcttgaactcctaggctcaagcagtttgcctggcgtggcctcccaaagtactgggattataggcatgagccactgcacccagttagacttgatctgtctagagaccaataatttgcctctagaaaagagtcttattgggtttacaggaaatttgactatagtagttttaggtggtggataagttgggacataatgagcataaatattttcctatataatatttagttgctgataattctcataaattgcccgtttctaaacagtatcttacaaaaatgatcattcacaaattattttggacttccgaacagtgattgacagtgctttgtgcttgttcgtgaatctagggatggtgtctgttttggacttgatgcagggtggttacccatcacgagcttcatttcatgaactctacaacatgtacaaaaagtatatgccagataaacttgcaagattggatccaagactattttgtaaggtataaatgccacccaaattgaaatttcttagctatgaacttgtcttttctattaataattgacatttaactttttaacttttatttttcaggctttgtttaaagctttgggcttaaatgaaaatgactacaagtttgggttaaccaaagtattttttagacctggcaaggtaaatatacattttttactttaaactgtaacatcatgaaaacaaatagttggggttagtgaatatcttaaagtatttaataatttgtattattcttgaattatatggtcactaacaacatgaattgctattttccataccatttctcagaaaagaaaaaaaagttgagaggaagataattatatataatgttcataatttgtttagctttactcatacatatttattctaaactccccatttattttagagcacaggtgtccagtcttttggcttccctgagccacattggaagaagaacagttgtcctgggccacacataaaatacaccaacactaatgatagctgatgagctaaataaacaaaacaattgcaataaaaatctcataatgttttaagaaagtttatgagtttgtgttgggcctcattcaaagctgtcctgggccacatgtggcccatggactacagcgtggacaatcttgtcttagagctttaataattatttgagaactaatagtctcatagagaaagcactttttcttgtttaaactcctgaaaaattagaaatatttattgaaagcttaagacaaagatttaaatatcttttctctcgttatgttacctttaatttaattttgactataagaagccgttatattggttgatgggtttttgacattcttaatattatagtgggttatttggtaaaggattgaaatcattatggaattttgtggtatatagtggaaataatgtattttattagttaagaacctactagctgttttatttgtgttgtctgtcacttagtagcaaaaatttctcatctctgtttaaaatggaaatgggggttgggcgctgtggctcacgcctataatcccagcactttgggaggctgaagcagtgggattgcttggttccaggagtttgagaccagcttgggcaacatggcaaaacctcatctctacaaaaaaatacaaaaattagccgggtgtggtggtgcgtgcctgtaatctcagctacttgggtggctgaggtggggaggattgcctgagcctgggaagttgaggctgcagtgaaccaagattgcgccactgcaaaaaaggttgggggtgggtaatgggagttaggagagacagaataattttggcggtacctggtattatatagctaatatgcacttatcaaaagctccataaggatatctgagaatgtgggtgagccaattcagagatacagtagtcctttttcattcttttcttaataaagtcttctcgctagccatctgtaatttaaaagtcatcccccccccccacttttgttattgaatatgctacctagcattaagtaacctccttacctccaaaaaagctcctgaagaaagaaaggaagcaaaacgtggccaagtgtgtttgtgtttgttgtattctctgccaaggcctatgtaattgacatgtgaccattttcagacagttagattttggatttgaattctgtttacatcatgtctttatgtgttcaaatgcatttatattttaatactgatactaaattatttcacttcctagtttgcagaatttgatcagatcatgaagtctgaccctgaccacttagcagagttggttaaaagagtcaatcactggctcacatgcagtcgctggaagaaagttcagtggtgctcactctcagtcatcaaatgtaggtgttttcctttacacctataggatctttcattgtttcaagatggtttgtggagtgttgtaaagctgtctcagaggtgatgctgagcaacagagactgagacttgttcacactgggtcccaggttcctatttgtagatgttctttctttttttattttttgagtgtatgatatttattttctttattcaaatgtgttataagagtgtcagtttcatagtgtcctaacaaaacagaattcactatcttgatctctcgtccccgcacccctcaccatcccctaatctctcagacttaaaccagaacttttctttctgcctgcatggcatctacaatacacataccccgaaaattctaattgtaattgattttcctttcttatccctgaaatattgtcagtcaccagatcctgttgattccttctccaaatactgtacattcctttctttttcttgccagtgccttagtgaagtccttttccaccttttgcataataattccattagctcccagactggttttcctggtttcttagagatatctctctaaactagaagccttttataactttcctttcataaaaggtgaagtctaaattatttgatgtctttcaagatcatgtaaaatggtgtgtcagttttttgtttcagtctcttcccccaccatcccctcttaaatcctgttttttgaacggaagtctgtcataatcctgaaagacactgtcttgaacaccataatcccaaatgttgaaatcttaaaagatgaaagtcccaaaactaggattctgtaaaaataataaaaaaagatatttatttacattttaaaaaggggatttgagaaacgtataaaaacatgacagaactcttcataggccacttttcacaataaaataggcaataacatatatataggcaataaacatatatgtttattgaaactataaacacatatactaacaatagttgcatgggtataacaggagcagacaaaccgtattcataaagaatagggcgaaaggtgaaatgcataaacacatattattgtggttggtaattgtgcacccagctttgttactgcagtcatctgaaatactgtgatgatgaacaagctgtcttttgatgagatcagtcaaaaaccatagtgagtcaccactgcatttgtagttgcccagagaactgaaatcttgagaaattttatcttttacaagtgcagatgtatgataaaggacatctgttcattgattaagtttcagtgtttttatatacatacacaatgtttacccagaaagtaaatgttgtggtaatgcattttcatggagttaaatttgcaaaaaatgaatacagtaaattagaactctccaaaaatttctacataattaaaaaatgctaacaatttaagatagtgaaaataaaaacaaagaaaaaaaaaacacccaaaactaaaaaggaagtttgacataaaaaaaagtgtatcacagggacagattataggcagttgcatggagatagtccatagagctggctgtctttctcagtcattaactatattttgaagtcttgtaccacgaataataggtgctttttttcttttaggacatggttcttggagaatatgttcatattcattttcttcatgagattgctctttttggaattcttctgtgattcctctgattgggatttttaggatttttgatgttagggattttaatctaggaattttgatcttttgggatttcaacatttgggattatggcttttgggattaggaattcaaacccctttgacatactgggctaagctgcttttatgtgtggtttggccaggtcatagcagctacatagctggcccaagacaaaagtgagggacagaacattttggggttacctaaggatctgtggcaaacctttaattgttgggagctgtgtaggaatcagtaacttgattacatttacagttgccccttatactcatcagagtacctgaaatagtgctaggtacatgaaaaggatccagcgaatttttccttatcagtagaaaaggaaaattcttttggcctaatgaaaaagaatcatgctaacaaagattatttttgaggtattttgttagacaattgtgaatatagataaaaagagaactattaatataaaaagaaaaaagatagcagaatcttttccccatcattttccaaataaaatacagaaacatctttattactgtagtttaatacgttcagctttacacattgcattatgataggaaacacattatagtaaactcatctgttacaccattcatttgtggactgtgttctacagtggtaccgaagtcagtaaccgggcagggatctttgcagaatgttaataggaaactctgaaaaaaaagttcaaggtcagatcatcctaggaaattgtgagtaactgaagttaagtagatttctttgctgtaggattctcagaggcttcactcagtatgttcattgtgaacctccatacagaagtatagtgtacagcttttcataaactcatttgacaggtaaatccttttttcaggacatacctattcacatttcatagaacaaatgttgcctaagacagtttgggaggtagcagtgtagcatactaaggaaataatgcatttaaaatgtaagcctaaccagatacatgatattgtaactgcccagtgggttctccttgcccactacccagacagagctgatttatcaagataggaattgcagtagagagacagtaattaatgtagagtcggctgtacgggacactggagttttatgattactcaaatcagtctctctgaaaactcggagatctgaatttttaaggataatttggtaggtaggggcttgggttggagatgaaatcatagggggtcaaaattgagtttttcttgcttgcttctgttcctgtgtgggagcacagaactggctgggccggattacctatctaggtggcatcagctggtgcattggaaggtctgcaaaatatctggagcactgattttaggtgttacaactgtgatgttatacctgggagcaatttgaggaggttcagattcatgcagctggaggctgtgtggctcctaaaccgtaatttctaatcttggagctaatttgttagtcctacaaaggctgactggttccccaggcaagaagggggtttattttgggaaagggttattatcatgtttgtttcaaagttaaactttaataaactaagttctttcccaagattagttcggcctacacccaggaatgaacaaggacagcttagaggttagaagcaagatggagttggttaggtcagatctcttttacataatttccttggttgtaatttttgcaaaggcaaaattacatctttcaacatctttttatttttaagaagaataagaaattatagaaatgttaaaactggctgggcgtggtggctcacgcctgtaatcctagcactttgggaggctgaggtgggaggatcacttgaggtcaggaattcaagaccagcctggccgacatggcaaaaccctggctcgaataaaaatacacaaattagcccagcatggtgtgtgcctgtagtcccacctcacctactcaggaggctgaggcatgagaatctcttttttttttttttgagatggagtcttgctgtgtcacccaggccggagtgcagtggcacgatctcagctcaccgcaagctccgcctcccgggttcacgccattctcctgcctcagcctcccatagctgggattacaggcgcccgccaccatgcctggctaattttttgtatttttagtagagacggggtttcaccgtgttagccaggatggtctcaatctcccgaccctacgatccgcccgccttggcctcccgaagtgctgggattacaggcgtgagccaccgcgcccggccgagaatctcttgaacctgggaggtggaggttgcaatgagccaagatcatgccattgcactccagcctgggttgagactgtcaaaacaaaaacaaacaaaaaaggtgttaaaactttgtttttgatgtctgatatataataatatggtcgtcaagatttcatgtttcttgagcattactttgtgaaaatgagtttttttaatatatgttagatttaaactgaataattttctatcattttattttactcttacacatagtgaaaaacaaaataaaatatcgagctgaagcctgcattaaaatgcaaaaaactattcgaatgtggctttgcaagaggagacacaaacctcggtaagatgaatagttcctaaaaagaactctacaaaacctagttactgtaatacaaaatgacaataaagtcataataaaaagcagtttggatactcaggttttctcatgttctttgtaaaatgatgtattagtcttttatttgtaatatttatttgaagttagttaattcatttattaccttattacttgcctcattctataaaaggatttgaagtggcatacaaaaatgtgtaaagactataaaacaagaagtaagtagttgagagaagctcttttattctgattattttagttatttgagtttcttgataatgtcaaggtgacattttttaaaaaacatctcactaatatgtttacataattttcaagattatctgtaggaattacattgtcccattataaattagtgtatttcttatttgaatctttcatttttaatttacacttttaaaaattggaagtctgaatatctctattgatccatcacaccttttcaaagagactagattaatttcctctgtgatttgaattctcaaagttgtagaaggctttaatcccattgacaggcatcagtgtcattcacactcatatttgattttttttagccttcaacaagagatctgaaaaagagaatagtagataatattgaaaacagaagtgaaataccctgtttagcattttataaatgaaaaatctgccaaaagtactaaaggatgaaattaagctctaatgaagtattatttttacagcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaaggtatgtaatttcaacccgaatgactttgactttttatgtaatttaatatattttgttattggtattgaaattgtatagaaaacgtccttagtttttcaaaattacaaaatgtgttgagactcaatgatggcaagtacatgctcatcattattacctctactctttatgtttgaaaaatttcatagcaaaaagttaaagaagacaatttttatgccatttcttctgttgctaagaaagatatccctcgcaacttaatacctaggtgatgggatgatctgtgcatcaaacccaccatggcacacgtttacctgtgtaacaaacctgcacatcctgcacgtgcatccctgaaattaaaataaaagttggaggccatacatggtggctcatgcctgtaatcccagcactttgggatgctgaggcggacggatcatgaggtcaggagatcgagaccatcatggccaacatggtgaaaccctgtctctactaaaaatacaaaactagctgggtgtggtggcgtgcacctgtaattccagctgcttgggaggctgaggcaggagaatcgcttgaacctgggaggcggagattgcagtgagccaagattgtgccactgcactccagcctggtgacagagtgagactccatctcaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggggcacctgtagccccagctacttgggaggctgaggcaggagaatggagtgaaccgggggggcggagcttgcagtgagccgagatcgcgccactgcactccagcctgggtgacagagcaagactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccaggtgtgatcgcacgcgcctgtagttccagctacttgaggcaggagaattgcttgaacccaggaggcagaggttgcagtgagccaagattgtgccactgcactcctgcctcagcgacagagtgagactacgtctaaaaataaataaataaatgataaaagtaatataatactataaaaaatttggaggccagatgtgatggctcacacctgtaatcccagcactttgggaggcccaggcgcagggatcacctgagctcaggagttagagaccaacctgatcaacatggccaaaacctgtctccaccaaaaatacaaaaaattatttgggcatggtggtatgagcctgaggtcccaaggaagctgaggttagaggattgcttgagcctaggagatggaggttgcagtgaacagagattgcaccactgcactccagcctgggtgacagtgagacccctggctaaaaaaaaaaaaaaattggagaaaccaccaaaaacctcttaatacctccacattaacaaattcagttagttactgttatttttacagtataattttacttgtttttactttaccttacattctcttttatgcatacatttttacagttcttatcataatatacatttcaatttctatctctaccattgttatatacttgtccatgttaatacattatcttcatagatacgataatgtaattaattttgtgaaaatagcaatttcctctccaattttgtaggaaaaaaatgggatcccttattttgttttgatttttatttatttgattactagtggagttgaagacttttctatatgcttgttaattatatttcatatttcattaattacatttcatatcttctcattatattttagagttttaatgctttttctcagtttcataggtcagtgcaagtatgtgggatataatgaatatcttaaagtgagcgttttatattttctgcagatattttatgtaaacaatggcaatcttggaggtagaaaggaaaaaaaagatctggaggaaaatgaaaatgctataaatagactcagctgattttataaatctgtcaagggccatctttgtttatgtggtatcattataaattaaaattaacccacccacattttttgaaggctaattttagaaatccaataattttggatatattttgtaatttttaaaatattctctaggtactatttgaacattattctaaaatagtagtaaactattgctaaattagctgatcattacttaagaaataattctttttgagataagaggcttgctctgttgcccagtctggagtgcagtggcatgatctcggttcactgtaacctccgcctcccgggttcaagcaattctcctgcctcagcctcccgagtagctgggactacaggtgtgtaccaccatgcccagctaatttttgtattttatttttataagagacagggtttcactatgttggccaggctggtctcgaactcctgacctcaggtgatctgtccaccttggcctcccaaagggctgggattataggtgtgagccactgcacccggcctagaaataatttttaactgcagtatattaccttatccacagattacctgtctaattgatgtgtaatacttgtgtgcagagataacataaaacattttttgaatagtatttaatgtacaaacagtatagtaaagataacggacgtattgcttaccatcttacctagtttttgctgtatttgcatattggagtagttttttattttaaattgtaaaaaacaataaaaacattaaaatttatcttagccatttttcagtttataattcagtattgttaagtatattcacattgttgtgcaacagaagaaataagcttttacgtacctatttattttattttttaaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgtgaggcatttatattattttgaataagagacttaaagaaatagtgaattcttggtattgacagtggttaatgacaattatttgttttgttttgtttttgtgacagggtcttgctctgttgcccaggctggagtgcagtggcgcgatcttggcttactgcactctgcctctcgggttcaatcgattttcctgcctcagcctcctgagtagctgggattacaggtgcgcaccaccacgcctggctaatttttgtatttgtagtggagacggggtttcactatgttggccaggctggtctcaaactcctgaccacaggggatccacccgcctcggcctcccaaagcgcttggattacaggcgtgagccaccgtgctcggttgacaattcttaaaactgtgttcttattttaatgaactaattttgtaataagtttgaaaattgagagaataaggtcattttataatagtgataccataaaataattttaactataatctgaatttgttagcctcttacacctgaggattttcttctttttaaaactatgatttgtttattgttttctaagctagataaatgacacttctacttttctgcagttttaaaactgataacattttgaaagattgccatgatagggtagagagaacagatgagttgttgacttggagagggactagagggaagcacctttaatcaggaccttacagccaggctttgtaaccacattcatctagagatgttaaaagttatagaatataattatatttgttttatttaagaattattgtcaatagagttaaattttattttattcaaaataagttgatgtatgtggccaggaggttaatttgcattcccaatctgttacctttgtttattattaaataatagttaaattgccttctgaaggattctttattttctgttaaatttttgaagagttttctattttttattaggaaacttgagatggaagcaaagagaaaacaagaagaagaagagagaaagaaaagggaagatgatgaaaaacgcattcaagtatgtacttactgggttgaatttctattaaaatggaacctacaggctgggtgtggtggctcatgcctgtaatcccagctctttgggaggccgaggcgggcggatcacgaggtcaggagatcaagaccatcctggctaacatggtgaaaccccatctctacttatacgaaaacaaattagccggacatggtggtgggcacctgtagccccagctaattgggaggttgaggcaggagaatgatgtgaacccaggaggcagagcttgcagtgagccaagatgacaccactgcactccagcctgggcaacagagcgagactccatctcaaaaaaaataaaaaataaaaaataaataaaataaaatggaacctatgaaagaagtgaaaatgagatcttgatttgctagataagctgtcactagtttatcctagagaccaaaggccagtttttgaagtggttatgggaatggactttggagctagggaagtgggttcaaatccaagatcagtcactgacagaaattgtgacattgtacacattatagtgaggaactatgggtcacagttgtctctctgtagaatgtggataaataatagttgcaagcatttgacagttaatacatgttaaagcattgtgaacactgtgtagatcaataaatattaataattgtttttatacctaggggaaagtcaaatgaaaattcacttaaaatgttaagttttaaaatatcatataactttgtagatactggaattaataaattaggattaagagtctctctccacccctagtttttaaaaagtcccatgttgagaataaattgctcatgtatttgaatttctgtttgtcatggctttcataatatatcctaagcataaccaaaactttaaattcctgacatctgctctctaggtgttagtgttaatgggatgcctaagatactcatgtgatgtttgggacactaatatttgtagtcatagagttatggagctgtggttcttctaccttctcttggtcttgggaaagaggcaaaatggggatgtgtttgaagcattaatcataatagagaagaaagtagagactgaagagatctgtgcttaagcaattctttagtaaagaacttgtatgggggcagttatgctttccctttattttaagtaataaggggagtgatcaagtaaacaagtgaagaactcttggtgaaatagctttctgcccttgtcaggctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtactggggcccctgggtggggtatagcgctctctcctttgctttctctacctctctgcctctcatttccatgcagaagggaataggagaaaataatattctgaaggccctgatatatttgagctaaaataattttaaaattatttgtatcgactttcatactcaagtgaatgagataattgatttttcatcatattattaaattgttgacaaataagactaaaatttcactaatgagtactctattaagaaaatatatcaacctttaccctgaaattgtttaagagtatagtatattaggtagacacctaatttctaaatacctgtcatcaaacactggcattgaaataagtgactgtgttatataatgcagtgtaatgtatttgtagttgagatttttctaatgcaaaaaaatttaatgtattaaatatcctgtcagttgaaatgagaactctactctgcaatgcctcagaataaatgagtttccctttacaagaagggagggttaaattcattgaaatattttggcttcttgggtttctgaattatctctaagcactccactatagtggagtgtataggaatgtggaagctcttattaaaagttgcagaaaggtttaatagattcagtttaaaaaaatttagtatgtagaggcattaattattttgattatttataataacaaaactaatttgtaaggttcctttgtatgtaggtatatatatgttgtatatatactgagaggcacatagacacatgtaaccatgcttttccgagcttaaaagcagtttatgacaaaatatagagtacaaccactagatggcgatgtttccttgtgaaaggatcaaactgcaatgtaatggaatatttggcaaaaaaacaaaagacggggaaggaaaagggcatattgagttgccttcatgctttttctattaggttggtgcgaaaataattgcggtttttgccattgggaaaactgcaataacttttgcacccaccaaatagtatgtgattgtattggggagctctgggactgcttgtatatgaaagtacattatattgtaaatgaactgaatatggctatatgaacaaaagatgttataattattaagctcttgggtttgagtccaatatttgggctctttattaagatttcactgtaattaaaatattttggcccagatagggcttttataaatgcagactcagctcagctgctgttctgttccttccacctgtgttgcatcagaatgattgggagtctttatgtgtaactgactagccgcctagggcaggctcttaaacgaaccaaactcttacagctgctatccctgatgtctgtgaggaagtactgcagttgacagagttgattttattatggcagaagtcaatttctaagggacttgttaatggagtcattgttggtactcatcatcaagctttatatttatgcacttgaaatgttaagctgtatccagtgccattccatatactgtatacaagatactgtctcatatgtggaccccttcccatcttcagaaaggtacatgtcttccaggttgagaagagtggatcgtttaggacctttaacataaacaagttacctgtaatttaaattaagcagaattagctaggtaatgggaccatattaagtaatgaggagatattcaaacccttatgacctgaaaggcagaagagctagttttagttatgtggttcaggcctaggggtggtatgaagaatgcccttcaaatcctttctgtcagctctccaggaagctttccctgaccctcaggtcctcatgagctccttcccttctggtcgtcgtggttattttatactgtgaactacaagcattagcacttcattatgaatgatgttctatacagatatcacatgtttgatagtttaatcttactccatgggctatagctaaatgtttttgaatgtttattttacctttgttagcactgagttttttctctaacaaatttatgagtaagaactaagtaaactgttcttaatctatagcatgatgttgttgggttctatgctgtgttaaaaaatgtatatattatagatagattctgcttcaataagcaattttaagttacttttccagcttggattcctatccggtaacttctaagtaagaattgttttctatgtatgtcatatgttctgaaatataatttcaatcaattacacatatgattcttgatgcaaagagatggtttcaaattacctaaaattgtaaaataatatccagattctattaaaaacaaacctcacaatatatgaattttctaatctagatgtaatgtatttgctctttaattttcactgcatgccttattttccaatcatttttaatgaatacttaaaaatatattaaaattctgagtgatctcatgttgattacaaataattgagtttttaaaatcaatgagtaaagtaattgaaacacaaatttgcacaatccagattttcacagttcacaattggttacgatattaactaaaatatattcttttcacagaaatgatggaacaagacccaaaatgacaccgtatgtcacttacctttacctttttaaaaataggttgtagatactttttgggagtagttttctcattggagtaaattttaaattattttcttctattgaaaggtaatgagataacctttttcatatttttcttgtctaggaaagtttaatgctcttgtatggtgctcaatcacagtagctcatgatttggtttccttctttgtattgtctgtttaaactataatgtaacacctattttgttttatgtatatatatgaattttttttttttttttgagacagagtttcgcttttgttgcccaggccagagttcagtggtgtcatctggggtcaccataacctctgcctctcgggttcaagcgactctcctgcctcagcctcccaagtagctgggactacaggcacgcaccaccacactcagctaatttttgtatttttagtagagacggggtttcaccatgttggccaggatggtctcaatctcttgacctcgtgatccacccgcctcggcctcccaaagtgctgggattacaggcgtgagtcactgtgcccggcctgttttatgtattttttttaaactgccccttaccttacttctttatagaagcaggtgtggaggcataaataataataaaatatttgattttcagtatatatggtagttcattctgctatatctaaaataattcatcatctgaaattgtatatgtagtgctaactttggtgctaatgtatctttttcatatgaaaatctacccacaaagaatccaggtaacatttggaatatacattttgtttatataaaatataaaacatattttgtatgtatgttatgtatactacatataaggattttggaatatatataaaatctttattttaacagctttaaggactccaacttaacatttatgatgaggattctcaactctatcaggctccagtcccaataacaattttttaataaatgatgcaacctatgtaaacaactctccaaacaatatatgtaaaggagaaatacaaggatagtcatttataataaaatgtttatttaatatgaaagtgcttctgcataactgtagtagaagacatgataagcgatcagatgtttttgcttacgtatagaatcaccacgaatgctgtatctacaaatacaaattgatataggaatgttgtgttgggcattcacatgccatgaaattgtgaacaatcctttgtgaagttctgaacagagccaagtacaatattctctcaattacacagtatttgcgtaagccctagacaaattctgtgaatattaaaggcatgcaaaaaatacgatgtttacatgtataactttgtttacatgtaaaatatgtgtttgtatgtgtttttcacctctgtatgtctcacagacatgttaaagttaaatggggcatggagtagttcttccttgggtaggacatttggcattcctttccccttacctcagcagatgccaggagtatactcacacattgttgttaccacaatactgccccaaattttgaaaatatctctgagtgggcactcttgccctccattgccacaactgctttatagttaccatttgagcttgaattaaataagcccgcaatcagtgtctaaggtgaaattatatttgcatatagtttggtaaaatcagaaggaagaaagcacctgggtgcaggaaccatttctgtctggcaaatttgttgcagtgtattggtctaggtcaggtgtatcttgatgcagggtcagggaggataatgcatcagtagagattgccatccattgtagtgtcagagcatgcagaaaaacacctgtgtgatcaacagacccagtggtaatgagatttgaaagtccatagactcccttaaaacctaccatgggaaaagaaatggaggaagctttaggagaaaaagatggtaaaaacagatgctcttgaatcctgagacaaaaaccttgaggtggagtgataatagaattaaacatacttatcaaaatctgctgcatttaaaagtgagacgattctgagaaactactagcttgaagagagattgataaatgtattgctcaaaagataatttttattagattgtatttgtgttatattttgtttttgctgtccttcactgtcagctttgaaagatatcttgttctctgactgtgctttcatagacctccatccatacataattgtagacagtgttcattacgagaaaagaggaatacaggagtgttctactcctttagtcagggtcccagctcttggcaggcattcaggaaattgcacctggaagcaaatacacccatcttcttttcttatgattttactgatttggaagggtttgaggttactagagtttgatgagtagaatgaatgagaaaataattacgaaggaaaagagcaaatagggaaataagttaaagaagtgttgatgaacactatgaaacttcattctgttttaaagaattaaacaaaatttgataaaagttacactcttctgggtaacaaaagcaaaataagttttttgcctttggcaaatgtttatccctggaaaatcagaatgcctcagatctttcattagtccattttgatattctttttcttaaaagcatgctttgatttggaatttttagagctttgaatacatcagattctttttaaaactctgacgctgtcaaatacatcagcttgtggttttcaccattgtgccttatctaagtaatatttactaagcaactctggtgcaaaaatcctcatatggaatctatatcttgccaagtttcctgtatggatttagaccatgttatttgtattctatatggaaaagaataccataaaagctttcctgagattttatctaaaagttgctactgcaaaaatggagagacattcaaataacttgaactggatttaaacaaaaatttttctgtgtgttacggctagatttgttgaatagtatattctaggcattaacaaagtaaaacagttatgaacagttgttaaataatattgaaaatatatattttaattatacttttagatcttttaattaatttatgtagtatgacttttatgtaaccatattgtattatcgtttttcttgtagggaacaaatggccaaagaaatgtcagaatttttgagtaggttagtgcagtgtaattgggggaaataagtgttcacctcaaaatcatatttttaaattacttttgattatttggaccagaacctgttacatgagtagcctagtctttctatgtaaagtgatatttctttctgtacaagaaatatcacttctccctcaccccacccaacaaagaaaaagttaaaaaccagtattccttcaaagtcatggggataccattggcattttgaatgggacagttcccttggcagtggaactctactgcttatctctggcctccaccaactcagtctcagtaggggacttcttcccctcatcatgacaaaatgagtattttgcaactctccctggggtggtgctgcccctaatttgggcaccactgtgcgtcgttgaagaggaggtagaggaagaacatgactcttgaggggctctgcactgtggcacatggtttgaaaaccactggtgtaaattgagccaccagcaggatctggtccattacttttataaatggatatgattcactaacatgttaattcttaattttgaagttacaaagataattaaaagtgttaatatattaacacttaaaaatcagtttgctactattgtattctttacatgattgtctttatagcaagtctgaataatcagcaaattacccctttactattttagtaactccagagatgggggtggggaaacatttaaatgtgttgcattgatgtacttctttggatgctatgttttttagtagatgtacttttgtttgaggtaataggaatgaaaagttagggatattaaaaccatattttaagcaataatcatttgaatttaatgtaatttttaaaagtatcaaaacacattttacatatattctaataccttatatacattctgacaattataaaactgtatattatgtcaatttacctcttctttcaaaagaaaagataacaacaaaaacaaaacttaataattttcagctgccctcctagaaaagactcccagaacagcttaaaaataaaaggattttttttgtttattgattggtagtttagggatgtagaaaagacaaataatatttgaataaatataaaagcataatttattgttaaggaaatgagagaccttgctgatacacagctggccatttttgagcaaagcaattaagaccaaaaagctacatggaaaattgccacttagaccgcttatgaaaagtatagattctgcaacaaagctaaaacagattttaatcataaaaatacgggaaggactaatggccacacattattctttttttttttttttcttctggaacatttttttaaaaaaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccctacaacagtccccagagtgtgatgttccccttcctgtgtccatgtgttctcattgttcagttcccacctatgagtgagaatatgtggtgtttggttttttgttcttgcgatagtttactgagaatgatgatttccaatgtcatccatgtccctgcaaaggacatgaactcatcattttttatggctgcatagtattccatggtgtatatgtgccacattttcttaatccaatctatcattgttggacatttgggttggttccaagtctttgctattgtgaataatgccacaataaacatacgtgtgcatgtgtctttatagcagcatgatttacagtcctttgagtatatacccagaaatgggatggctgggtcaaatggtatttctagttctagatccctgaggaattgccacactgacttccacaatggttgaactagtttacagtcccaccaacagtgtaaaagtgttcctatttctccacatcgtctccagcacctgttatttcctgactttttaatgattgccattctaactgatgtgagatggtatgtcattgtggttttgatttgcatttctctgatggccagtgatggtgagcattttttcatgttttttttggctgcataaatgtcttcttttgagaagtgtctgttcatgtcctttgcccactttttgatggggttgtttgttttcttgtaaatttgtttgagttcattgtagattctggatattagccctttgtcagatgagtaggttgcgaaaattttctcccattttgtgggttgcctgttcactaggatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccccattgcttgtttttctcaggtttgtcaaagatcagatagttgtagatatatggcgttatttctgagggctctgttctgttgcattgatctatatctctattttggtaccagtagcatgctgttatggttactgtagccttgtagtatagtttgaagtcaggtagtgtgatgcctccagctttgttcttttggcttaggattgacttggcgatgcgggctcttttatggttccatatgaactttaaagtagttttttccaattctgtgaagaaaggcattggtagcttgatggggatggcattgaatctgtaaattaccttgggcaatatggccattttcacgatattgattcttcctacccatggatcttccatttgtttgtatcctcttttatttccttgagcagtgatttgtagttctccttgaagaggtccttcacatcccttgtaagttggattcctaggtattttattctctttgaagcaattgtgaatgggagttcactcgtgatttggctctctgtttgtctgttattggtgtataagaatgcttgtgatttttgtacattgattttgtatcctgagactttgctgaagttgcttagcagcttaaggagattttgggctgagacaatggggttttctagatatacaatcatgtcgtctgcaaacagggacaatttgacttcctcttttcctaattgaataccctttatttccttcttctgcctaattgccctggccagaacttccaacactatgttgaataggagtggtgagagagggcatccctgtcttgtgccggttttcacagggaatgcttccagtttttgcccattcagtatggtattggctgtgggtttgtcatagatagctcttattattttcaaatacgtcccatcaatacctaatttattgagagtttttagcatgaagggttgttgaattttgtcaaaagccttttctgcatctattgagataatcatgtggtttttgtctttggttctgtttatatgctggcttacatttattgatttgtgtatattggaccagccttgcatcccagggatgaagcccacttgatcatggtggataagctttttgatgtgctgctggatttggtttgccagtattttattgaggatttttgcatcaatgttcttcaaggatattggtctaaaattctcttttttggttgtgtctctgctaggctttggtatcaggataatgctggtctcataaaatgagttagggaggattccctctttttctattgattggaatagtttcagaaggaatggtaccagttcctccttgtacctctggtagaattcggctgtgaatccatctggtcctgaactctttttggttggtaagctattgattattgccacaatttcagatcctgttattggtctattcagagattcaacttcttcctggtttagtgttgggagagtgtatgtgttgaggaatttatccatttcttctagattttctagtttatttgcgtagagttgtttgtagtattctctgatggtagtttgtatttctgtgggatcggtggtgacatcccctttatcatttttgattgcgtctatttgattcttctctctttttttctttattagtcttgctagcggtctatcaattttgttgatcctttcaaaaaaccacctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcgttgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgaattctagtttcattgcactgtggtctgagagatagtttgttataatttctcttcctttacatttgctgaggagagccttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttccgtctcgttgatctgtctaatgtggacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatggccttctttgtctcttttgatctttgttggtttaaagtctgttttatcagagactaggattgcaacccctgccttttttttgttttccatttgcttcatagatcttcctccatccttttattttgagcctatgtgtgtctctgcacgtgagatgggtttcctgaatacagcacactgatgggtcttgactctttatccagtttgccagtctgtgtcttttaattggagcatttattccatttacatttaaagttaatattgttatctgtgaatttgatcctgtcattatgatgttagctggtgattttgctagttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctggattgaaaattcttttctttaagaatgttgaatattggccccaactctcttctggcttgtagagtttctgccaagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattgggtaagttctcctggataatatcctgcagagtgttttccaacttggttccattctccccgtcactttcaggtacaccagtcagacatagatttggtcttttcacatagtcccatatttcttggagtctttgttcgtttctttttattcttttttctctaaacttcccttcttgcttcatttcattcatttcatcttccatcgctgataccctttcttccagttgatcgcatcggctcctgaggcttctgcattcttcacgtagttcttgagccttgattttcagctctatcagctcctttaagcacttctctgtattggttattctagttatacgttcttctaaatttttttcaaagttttcaacttctttgcctttggtttgaatgtcctcccgtagctcggagtaatttggtcgtctgaagccttcttctctcagctcgtcaaagtcattctccgtccagctttgttccgtggctggtgaggaactgtgttcctttggaggaggagaggcgctctgctttttagagtttccagtttttctgctctgtttcttccccatctttgtggttttgtctacttttggtctttgatgatggtgatgtgcagatgggtttttggtgtggatgtcctttctgtttgttagttttccttctacagacaggaccctcagctgcaggtctgttggagtacccggccgtgtgaggtgtcagtctgcccctgctgggggtgcctcccagttaggctgcttaggggtcaggggtcaggggcccacttgaggagacagtctgcctgttctcagatctccagctgcgtcctgggagaaccactgctctcttcaaggctgtcagacagggacatttaagtctgcagaggttactgctgtctttttgtttgtctatgccctgcccccagaggtggagcctacagaggcaggcaggccttcttgagctgtgatgcttcccagttggagcttcccggctgctttgtttatctaagcaagcctgggcaatggcgggcgcccctcccccagcctcactgccgccttgcagtttgatctcagactgctgtgctagcaagagactccgtgggcgtaggaccctccgagccatgtgcgggatataatctcctggtgcgccatttttttaagcccgtcggaaaagcgcagtattcgggtggaagtgacccaattttccaggtgccgtctgtcacccctttctttgactaggaaagggaactccctgaccccttgctcttctggagtgaggcaatgcctcgccctgctttggctggcacacggtgcgcgcacccactgacctgcgcccactgtctggcactccctagtgagatgaacctggtacctcagatggaaatgcagaaatcacccgtcttctgcgtcgctcacgctgggagctgtacatcagagctgttcctattcggccatcttggctcgtgcctccacattattctttagctagtcttatatgtaactaagaatcactatgtcaaagaattttaagtatgtaggatgaagtatgctattttttattttctagaatgaaagcatacagagaccttttaaagaagcaagggcaccttatttatttcattgttaagcttagtattgaaagaataatttcctttacttcaggaagaaagtgacatattctcagacatcatttttcaattaagtatgtgtcttcactgcttgccaggatggctgttatctttcaaaatgtaaaagactgagaaaatacatgtttattttcaggtattatatcttgatcaatcctctttaagaggaagtatattttaggtagtaggtggataatggagaatttccttgtgtcacacctaagaagcaatatttttgttctttaatagttagttagtttaatattttgtgccaccttcttttcatgtcttgaaatgtgatgtatttaaacgcttctcgttaccttgagcttaaagtcttgcagcttattctgagtgtctgctatttgcaagtgtaatcttttgctgaaaaataagtttattattacagaaaagaaattgttcccatattttctgattaatgatctcaaattatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagaccccttctcaaaaaaaacaaaaaacaaaaaacaaacaaaacgcaaaaccaaaaaagcaggccttaaagcactgcgtagcactgttttgaaaaagttgaatttatttcattttattgactgctttggattttatttctttcctctttccccatatgtgctactaaatgagtcatgatacagcacttgtgccctttgaaatctctgttatttacctcatgagctaaaacctcttgaatttactagttttcttattacttatgagggtgtgttttttgtgtgcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccattcttaatctcatctgtcaaagaaacaaaaattatgtttttctagtagctgtttccggttttcaaacttatgcatgctttcttgcctctttagtcaatgttttcttcatgtttctggtttaaacatgcaaaaatgtgtaataattacagaggtcctgctgtactagccaccaaagcagctgctggtactaagaaatatgatcttagtaaatggaaatatgcagaactacgtgataccatcaatacttcttgtggtaagtgtttggagaagatcaaaaatagaaaatgttcatagtgataggtgataaatacctagattagggtgaggtgtgtgtgtgtatgtgtgtgtgtgtgtgtgtgtgtatgtgtgtatgtacatataatacctatattatctgaatcttttggtccatgaatgcacagtaacaaatggcaatgcagtgctttctttttaaggctatttttcttcccacagaacaattagagtaaaatactatatccagaggatcccacatagttatgttcttatttaaatcacagtgtttgagttcagaaaactatgagtaggaacgatgaattcagaaaactatgactagaaacaaaagtatcataattgtacataatttctcactacactttcctccattgagtatatctgcataattataaaaaatgtcttgcttgtaaatctagtttgtattttatcacagtgactttttattctattgtcaagacttgttgccttcgacaaattgcttaatgtttctgatgcaattccttcatataaaagacctgtttagttcagagttcttctgtggagcagatgatataagatagtaacactgtgtaaagaaatgatctgtgaatttgaacaataatattataaaatgcttatccttatgaataattagcttacttttgattttgtaccattaatttaaaaataaaaaaatctccttatgcgacagaataattatatcattatgttagacgaataaattaacatgtcaattttttttttttgctcaatgtaatcaatagatattgagctcctggcagcttgcagagaagaatttcataggagactaaaagtgtatcatgcttggaaatctaagaacaagaagagaaatactgaaacagagcaacgtgctccaaagtctgttactgattatggtaaagagaaatctgtacttttgaacgttttaaaatatatgtatataaatgcatgtatctgtacttaagacatgggtaaaatgtcccatataaattttctcctattttagaactgtgagccattgaacctaatacagccttgatggcctatcttttatagcgttatttttatgagtatgtctttaaactcatacttgttaagatatattgaatttactataattgagacaagaattttcttgtctgaagagggtgtgcatgcataattttcacacacacaaacacgtgcacacactcacaagattaaatgtgaaaatgtcaggattgccatgcatcttttaccttacatgtgaaatgaattttacatatgaaaatgagttgctaaaaaggatgatggttagtttttatttttaaattttctataatttttattttttaaataaatagagatgaggtcttgccattttatccaggctggtctcaaactgctgggctcaagcaatcctcctgccttggccttccaaagtgctaggattataggcatgagctactgctcccacccctttttctaatttttaaaatttaatgtagctcagtttttagaaatagttccctgaaatacccaatattgttatcttttttatttgtaggtataagtacttttctgttgctcccagaatagggttatagcctggaaaaagaaaggaattgattcatgcattgtccatttacactctaattcctttgtttcaaaaataattttactgcaaacattattttacaatactgcaaatatataaaagtgagaaatattaccttgcttcagactagtgttttgcctagatcaagatttgattttttgattgggatcctgaacatggattttgttactttgttatgcaaaaggccaaggtgtatacttgaaattggaaagtagagtagaagagatgtaacctagtacaagcatgcatgagctttaacattaactgagaatacgtgtgatatgcgagttgtaatttcaatctttaaagcaataattggacttactgtgttcaaattggcacaatttattcgcttaattctggttaacatcaaggtgacagcagattcaatattttgtgtgtttttttcccctaagcggtatattcccaacagttgatagtatagtttagcaatgcaggacccaaattgacttaaaaaatgagttcttggttatattttgctttcctcactaccttccaagtaaataaaagcagtgtttaaataaagtcaatttaatagtggaattctagtgtttctaagttgttgcaaagaatagattgagtgagggcaatattattattaataggggtaatattagtgccagttattgctccaggggtgtcagtcagaatacaggactatgcaagggcagtgggagatcacttgtaaccaagaagtggcaggtggaagccccactaaatattgtgacactgctctcttctccagtttcatatttttcctcttctaattgaacacaacaaaatgattacattagctgttcactgtctgtgtagtgagttctgaccacagattacctttgttttgcaaaaaatgacagtgagctgttctttttagctgtaaatattataattactaactttagcttgacagactttcattatattgtatttcaaaattaatacatctgagtgatcacacttcttaaaaagaggttcatgttgtaatatttggcacacacattttaaattaatgtacacatatttattgtatttgtgactcaaactttgataccttattcatctagctttacccaaaaaagttgcaaataatacgtggctcaccttgctggttcaactactgtttctgtttgtaatatattatttaagaaaacaaaagagtagattaggaaagcttcctaagggttctatcaaggtttatggacaaatttaggaatttatgtgaacacaaccccacacatacatattaagccttcagagaacttgattatgagtcattttcaggatatattttatcaaatgtaacttctgctctgaaaagtacttttttttgcttttctctttctctttatgttcttcctcatacaaaattcatcttgacacaggagcatagctaaaagcaaaggttaaagagcaccaagaagctcaattgagaaaattctatacttaaatgatttcctaatgtggcagctaaacaccctttaaaaggaagtgctgtgtagtctaatatttagaaggaacaattcattaatttgagaaaataaaatgatgacaacttatgattaacaaaaatgtagcttcgtattgttgacttaaagagtaataggttgacagctaatggtaaactcttaaaataatgcataaggagcctcagaccctcttcctggtacagtcctggatgagcatactttcatctcatttactgcagagggagattttttagaaataattttttggtcagtggcaaatcacctagtaaatatttatagtaattaattgtttaaaacaatgattttggaaagtagttttattttatagtttataaaataaaaatggcatgagtttaagatttagagagtttaaaaaaagcaaaacatactgttaccaaaacgtagtaacgtttttactcctgtaatgtatataattttttgatgaattctcattattttctatgaaaattctagtaatgtatgaaaggtactataatgtctattaagtcattgtattaggtttttgtttggatatgtgttccaaaaatcacaaatgaagtatgattttttaattttggtcctctttatatgtgcttcaatcagaatttcctaagcctaatgagtcaaaatagccttttaaaaaaatcagaaagcagcacctgcttttaggtaattctgagaatatttggcttgtggataggatatttacttttcagtcaccacctcgattggaaggctttataaattagaaaaatgctcatttaacagttttggcatttttatcttttcttcaacataaaatatttgttcacagattttgcaccatttttgaacaattcacgtaagtcaatgggtggtaactcatgagctaactggaagatgggttaaaatactttacaaagtactaacttctattaaaagttgttttgctacaattttcagtggaattgtagtgtgttaaagttgttatatccatactaagatatattttaatttgagatgatgctttatttggatcactccaatatgtatatgtattacaaaaaatctagtgaaattaatgttttatcaaattacttgcattaagaaaatgactagcattttaaactgagagtatgtacaattcttattgtagcaaaactcttaacatagcagctgaccttttagaataaagactaacttttaggtgctggtttttggttactgtattttcaaacactgatggtgtctgcatttctgccaaaggtattttagttttatagataatgtgatagtgtataaaggtttaataatgatacctccttaaataggaagaggagattattctgttacgtttatagcctcttatgatacacattctttgataatttaaaagctttgagtcaccttagtgcacagtaaatctcttgtagaattagttgattagtaatgatttggatataatgtcacattcatttgccaactggttggacctgatgttttgaagtgcttcttataatttataaggctgtatttgaagattacacaattgaatgtgaaggaaagttatttagaatattagtttcaagcttttaatgtctgtgtctttgtgtttttccagataagtattcgtttctagtcttccccaacaaaatttcagttctcctgttagtaagaaaagctatcaaagactttctatttagtttctgaattttatccagtatcttaacttacaggagacttacttcaaattaaaaagtaggttaattaatgaatgactatcagtatcatggtaaatttcctgtaaactggacattaaattctaattcactactttagatggagggaaggtttttaaattcttagttttgaattagtacattttcaacaatgtagggagttttgaaaacttaaaagtagaaacactgaactgtaagtagctctgggaaaacaggagcaaaagaatagataagcagatgtctgttaatatgtgatgcagcttttaaagttactaacaaaaccgggcctctcgttccttcatagggatatatagctttgctaactgctttttgctttctctggtttgcaaagaaataaattcaactgctataaagcttttgctatttcttggtgtaaaaagtagagtaagagtattttcatcctttcagtatttgcaaattcttacagaagccatgtggctcttcttggctttatatcatatgtacattttacaatatttctttgacacacttggattttcatagtgagactcttaactgagctgctgtaaatggttgttccacttttgaagttctgtgagtataaaacagattaaacaggctaaccaaaattatgctgctaaagatgtaaagtcattgccccagggaaatgtttacatttgcagataaaagaaaaacctaattgttaagtaatgaaaattgagctaggaatgaaagattgatatgaatgaaatgcccagtactagtagaaaagcaaggatttttcttttcttttggcaaggagaatcaaatgttacatactttgcacttcattggattttattctaagagaaatctgatttcagagtaagtaaatatctttaagggaaagtttatgcttactgttataaggttttttttgtcatatggttgtctaaatgttgttaatatctatgtcattgtggtcattttaaatcctaaaatttgttggcaaaagaaaaaatttttatatggcttctactttttgtggaaatagtgattaaactgacaaatgtctacatccttcagatttttgaaattactgtttattttgttctatcataaatagttgaataaaagttactgtacaaatttgaactctttacaggaagaatataaatctagtaaataatagtagtttgttttcctgccgtgtgagtttattttaggttactgttacagtgatttgtgggaatctgacaggggtttgttgctggtagtggtggtggtagtggtatgtgtgtgtttgtgttggcaatgctaagaaacatcttaagggaaagacaattctaagaagtaacactctgaattttattaatttgtaggcaataaatattttcattttgttttaaatttactattagggacctttcttctttttaaaaaattattggggtatattttaggattaaaggctcttttcttttcccttgagctgctggtataactttccttgttctgtgtaatagctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtgtgtatgattcacatggaaaacaaattatagaacaaaaaagatcataaactctctgaatgaaacattctaatgtataatataataatttattacatttcagggttgagggatggagtcttgcggttaaatcacatttccagttcagtgaggattaactcatttataatgtgaaattgcttggattaaattatgttcttagcacatagaaacttgtctgtatcctaaaaacctttccatttgtgtttcatcatatccattgatttgtagtggcttgaggaaatgtagcatttttattaactctggtaacttgtttgatcaatagcagtgtttattaatattgaaagggtccttgatgggggacaaattttaattgtttctggtgattttattaagcagatttccatcttagagaaaaagtcttaggaagttttcaaatctatgagaattaataggtatttcaggcatacaactggtaagaaatggtcctgaagagagagatggtaattttctgatatctcatgaatacaggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagta

SEQ ID NO: 36367 - DNA, 44831 bp, Homo sapiens
gaagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggtaagtatggtctgttttaatagcgtggattgagtttttgctgtaataaaaagtaaaactaaagtgtcaggatttagaaacattgatgattaaaaaaaaaactctgttataggtttatgagctaaattgaatcaactgcttgctctagttctgtgtagtcaggctgtagggtacaaacccatattcttagaatgctgcaggaatttaaataggtagcaagttttcttttttgtttgtttctttttcctttcattttttttttcatttctcctgtcattatgatatcagagtagtaggtatgacagtgagttgtaacagaaatttggagttttattcatttcttcatcatggccaccttttcccccctccccttttattcccgatcactcctgttcatttccaggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaaggtaaagctcttcacatgtttcctagactgcagctatcagcacttcccacactttttaccccttatttttctgggcagaacttttttttttctttttctttttctttttttttggtcaatgaaaacaggattacctttgcgcctaaagaaaccgtggtgcagttaaacatcgcgtgtttacagctggtaggcagagggggttgagggagaagaaagctcttttcgatgctctagtagggtagtttacatttccttgtagagatgttgggtttggagaatctttaacgatgatttttaactgatcctttgttgcggagacctatgatcagggaaacagttgtttttttcagccctggcggctgaaggccctgggagctaagaggaaattgcagtccagagcttctttgagaagctaaggcgggaaagggactgtttggaaggaatgcccagcttgcatctaaagtaatggtgatcttaacttcctgatgacacatgctgtatcggcacttaaatccagtgtgccagaagaagtgttaaaggtggccgggcacggtggctcacgcctgtaatcccagcactttgggaggccaagctgggcagatcacgaggtcaagagatcgagaccatcctggccaacatggtgaaaccccgtctttgctaaaaatacagaaattagccaggtgtggtggcacacacccgtagtcccagctactcgggaggctgaggcaagagaatcgcttgaacctgggagatggaggttgcagtgagccaagatcgcgccactgcactccagcctgggcgatggagcaagactccgtctcaaaaaaaaaaaaaaaaaagttttaaagttagtggaggatggttcaaattaggaaactttgatggtaatggaaagttataaacaacaaagcattcttttggtttataacccatctcctatttggaattagatgataatttgacagataatttgatgtgtgcatgcgagagagagagagaaaaaggagagagggggcaagaagggagaaatgtcggaggtcttggggagttgtttgtggctatagacaggtagctgttttatttatttatttatttttttgagacagagtctcactttgtcaccaggctggagtgcagtggcgcgatctcagctcactgtagcctccgcctcctgggttcaagcagttctcctgcctcagcctcccggtagctgggactacaggcgcacgccaccacacccagctaatttttgtatttttagtagagacagggtttccccatgttggccaggatggtctcgatctcttgacctcatgatccacccaccttggcctcccaaagtgctgggattacaggcatgagccactgcgcccggcctacaggtagctgttttaaatacgtgcttcatttatcccagctggcatgtcattcacttgcttttgaaggttggtagtaatgtgaatagtgtatattgtagaatcaccatgagctctgccataaccctcactggtggtgaatcgaaggactaggaaggctcacttgcttctcccgtctcacggggtgttagtggtaggcctgggaccaaaacaagctgtgggcctttgggaccttattgcctgtaccacggagagacttgttgaagactttgaaccactgatactttgataggtcaaggcctctgacccaccttctgtttagaatcttagtaataatgaacaaatattcactaaacacctattaaacaattttcatttaattgtatttatctctataagacaattgttacattcaagaacagtttcaatttttatagctataactgactttcagttttatggtatccttctatcttatgttctaatagggaaagtaaacactttataagtgattttcgcttccttttcacctttctcttttctctgtatccttcaccaggctatgaggcaccaagtagaattgggaaataatctagttacggcacattcccgtttcaaaaaagaaaaaaaagcttgcttttccaaaaataagctcaacagtagattagctaacactgacaagaggaattggattttctatcatatttcgtattaaaatattggcattatgtagttaattgatgatctgaaacttcctttcatcactattgtacttgaaaatcatctgtcagtgattctttggggagtgtagcatgcagaataatggtcccgcctgagatgtccacgtcctaatccctggaatttgtatatttctttacatggcaaaaggaatttagccggtgtgattacattaatggtcttgagatgggagggttatcccaggtttagttgggtgggtccttcttacaaaagggagacaggaaggtcatagtcagagatgtgatggcagagcgaagtttggagtgatgtggggccacagccaagcaatacaggaagcctccaaccagctgagagaggcagggagcagactccccccagagcctgcagaaggagccacgcagccctgcttacctcttgaggcataagatgcattttggacttctcacctccagaactgtaagatagtaagtttgtgtggctttaaagcagtaaattggtggttacttgttacaatagcaataggaaactaattcacaagcatgtgtatttctacatttttgagaaatataacagcaacagtgtatggtttatgcaactagttaatcttctatttaaattagagctttatgaagggcaggtgtgcagataaaccaacgtgcaggtagggcctgtgacctgtacaggattaaatggaagagctggagccagaagaaaatattctggttcctaattttgaattgtttttatagttgtctttgatttgtttatttgtttttgttcctttaaatatgttagtaaaatttattaggaaataagtttttaaattttaaaatattttattttatttttgagacggagtcttgctctgtcaccaggtggagtgcagtggcgtgatcttggctcaccgcaacctccgcctcgcgggttcaagtgattctcctgcctcagcctcccgagtagctgggattacaggtgtgcgccaccacgcccagctaattttttgtattttagtagagatggggtttcaccatgttggccaggatggtctccatctcttgatctcgtgatctgcccaccttggcctcccaaagtgctgggattgcaggcatgagccaccgcgcctggcctaaaataagttttaaaatataattttgaagtattcataaatatcaactgtgttatagtacaattaaataattgtaagattttgaagctctagtggagaaaatgtatgtacatttctttcatacatatattcagtttttctttctccttcaaaaatctcaagtttggccaaaatagtaaagattatttgctttacgaaaccattctatgaaatgcttaacctttaaaaaagtgttcaatattgagtctggcggttcttagaagtaacagttacagccttaacatgaaataattggtatagcgtgttcctttttgtgtcctcaagttctgtataaacatgagtactggcctgttcttaacatggtttattttctattaatataaataaataaaaacataacaatgttcacaacaaaatttctgtgataaaggagacatggtttgaggcacaggatggctgtgattcagaagacttgagttctgagtccagctcttttcctcagcgaagagttctttgtgagcagggcaaatcagtttctttatgggcctcaatattttcacctgtaaaatgagtggtttggaacttctcatttaagatggtggcccgaacacctgtacaaagataagagggcagtaataagtggaagacagttttaacaaatttatgaaatatagaaagtagcttgaatcttgtgatacagataaaacagcagataaagtgagaataagcagctgaagtatgtgcgtaaggaagagaacctagctatagtaaaactacagaggctgtgggcatagagatgacaatgaagaagagatgaaatgagtggctaaaactagggctgttaattaaaagtgtgcctgtgaaacagctgtgccagttttctgccaacattcccactgtcccccatgctcagcattttcccctagagagctagtaagttagtgaggagttactaggtcaggatctggggaagcacagaagcctagtgaggggagcttcagcatgtggggctgtctttcccttgggggcatttgaaaattctggaaggggctgttgagagagtgttttggactgccctgtggctaggagacagggatgagagtccagggccctctaatattgtgtggcaaacttcttttacttgtgttgggaccaataaaaggctgcttcctagaagtaaaggtaactcagagattggcccttataggcactgccactcagcttcagattatcatctcatttgctgaacttgtatgggggtaaacaaaaattgctagtgcccccaggtacctagtagaaataaatttaaattctttgtggaagaagacagcatcatattagataaaattatttctagatagcaaacagttttatacgtgcaaggcccagtctaggcacacaaggagatatgacaacatgaataaaatcctgcagaaacagcagacaaaagaaacagatccataggagatattggcattattagatccacatttttaaatagctatgatattacgttcaaggtgataaaggcaagattaaaagttttggtggagaaatgaaaacttcttttaagaggaataaatcaaaattctagaagtaaaaactatagtaattgaattatgaatttaatatgtgtaacagcatgctagatataactgaagagagatttagtgacctggaggagaggtcagcaaaaagtatccagaatgaaagctgcagaggcaaaaatggtagaagagcccaaaacagagaaggtgttagttttctattgctgcataacacattaacacaaacttagttgtttaaaacaacacctattgattatctcatagttctatagtcagaaacctgggtgggtttgcctgggttctttgcccagcatctcacaaagctgaagtcaagatttcgactgggctgggctcagctcacagatggaggttctggaagggtatctgcttccaagctccttcagcctgttggcagagtctagttccttacagctttaggtctgtggttcccaatctcttgatctctttcagtcaggcgctgctgtctgctcccagaggctgcatgttttccttctcaagtgacctcctccatcttcaaggcagcagtggcatgcccagtccttcccatactcacatctccctgattttccaccctttccatgagccagagcaaactctgcctttaaagggctctcgtgataagaataggcccacctggataatctgcgttttgttaaattaatgagtacgtttagcccttttgcaagatgcagggtcagtatatgtacccctccccctgcaaaattgcatatttatatactagcagcatatagaaaatgaaaatttgaaaaggataccacttaaaataggataaaaacttttaaattatcatatctggaggaaaaatctaacaatatgaaagacttgtatacaaaaagctaaaaaaattagaaaaaatagagaaaactgaaatcgtggtgggatgtctgattttcagagttagaatatttaataccatgaaggtcatttttcagacttgtctagagtgattgcaatcaaatctcagtcgtcttaaaaaacaaagaaatgaacaaactgattttaaaatttatatgtaaaaataaaaaccctagaatggtcaagacacccattaagaagggaggaacactccctctgcgagatgtgaagacttaccataaaactggtgatcaagctggtgtcgtgtggtgcaaggagaaacagtggactagccctgaaacagagtcatgcatgtgtgggcttctgacttatggcagtggtggcctgtggagcaatgaggaaaggctagccttttaaataaatggacataggaatgttcatgtagaaaaaagtgaaatttgaccccaacctcatattatacacaaaagtgaatgtcagttgaattgctgtaaatatataaggcaagccagtaaagctatttgaacataatataggagaatgtcttcatgatctttggggtagggaaggactcctttaaacacaacataaaaaaacatttatctgctggatgtggtggctcatgcctataattccagcactttgggaggccaaggtgggaggatcgcttgaggccaggagttcaagaccagcctggccaacataatgagactccccccatctccactttaagaaaaaaaaaaattatcatagaagattgatcaattttgtattaaaattaagaaatgttgtttattttaaaaaaccaagatcaagaaactgaaaagataagcatagatgtgagaagatatatgactgaaaaaaaatctcttgttcagaatatgtaaagaacaacagtcaagaagattataaagatagacaaacaaatagtcaataggttgtcacaggaggatacccaaataacctataaacaggaaaagtgctcaatgccgttattcatcaagatagtgcaatttaaaactgcgacgaaataccattccacactcagcagaatggttagaaactaagctgttggtgataccaagtgctggtgaggatgtggaaccacccagaggcagctctcagatgtgacccctcgtgtactggaaccacgcagaggcagctctcagatgtgacccctcgtgcactgctggcagctgtacaaatttgtagaaacgctctggcaaagagtttgacattatctactgaaatacaatggatacgttcccactcttagttgtctactcatcagaaacacatgcataggggatccggagctgcgtacaggaatggtgatgactgtgtgttctgtaatagattgaaaactaaaaacaactgaaatatctatcaacgtaatgtgatatagttatacaaaggaatcttatagcaatgatggaaggagttatagctacatacagcaacaatggatgagtcccataatattgagccacagaagtcagacacagaagatttcaaaaaacaggcaaaaataaactgggagctccagggtgcatgctttagctggtaaagcaagaaagtgattattgtacatgtcaaagcagttatcactggtggacaggagggacactaattagttgggggtgtgagaagcttttgggatacagagagaacatgactgataaatcattgagctgggaaacaaaaaaagaagcaaaggaatcagtacagtatcgggcataagcctcctcactgtcagcactcagtgtggaaatcagtggaaaagtgccttcaaagttctcacagaaaattgattttaaactcagaaaacttattatcaatcaagggtgggggcagagcaataccatctatcttccatgcaccttttctgaggaaattccttgaggatgtactccagcaagagaggcaacacaagagcgtaatgcaagaagcagtggggactgtgaaaagaaatcccaggatggtggctgcatggcaggtcttaaggaagctgcaagaagagtgtctgcaaatcatgtggaggagatgccagacaacaataatgtaagaagctaggaagtgccagtgataggctaaagagtgtctgcaaatcatgtggagtaggtgccacacaacagataatgtgagaagctaagatgtgtcaatgataggctaaaactggcattttttattagtaaaaactaataataatctagaatgtaataaaatctattatttattagaaatgtgtggggaaaactagaaaaaatcatggtctaattatgaaacaaagaggacatgatgtttgagcagttgatgaaatataagagaatcctttgtccttgatcctggaaatagtctcaccctcttatgagtggcagcaagagccatgtgatctttagaaaatgaaatgtaatcccaactctggccgttagtgatatttacattgtacacatacacacctacactccatgtattgattttcaacttctagaaacatcctaaagaagaaatacagaagacttagttatgaatatatggtaaatggaggagaaagggatggaacagtctcattttacgtaagcagaagtcaagacgttcccttcagagttgaagaagcgtgaagattaggggtgttacttaaagacgtaaccagggaaaacccaaaaagcagaacaacaaaaaaaataggaggtgttggcgattggggatttcaaggaagtggccaaatactcagttttcgtaatggggagtaggtgaatcatttctaaagctgataaatgaagagatagtgataacaatgtattctttgagtgaccgcaataaccacaaccaggaataactgaaggtagttcctcatggagctgagctacaagtggggaagcttatgcccacttagatgcttagacttggtccatttgccttgttttagccaaaaacttttttaaaatgacaaataaaaattgtatatatttatcatgtccagcatattgttctgaaatatgtatacattatggactagctaaattgagcgaattaacatatgcattacctcacatactttttaaaagtttctgatgagaacaaatctactctcatcaattttcaagaatacaatacattgttattaactgcagtcaccatatctcacagtagacctcctgaccttattcctcctatctaactgaaattttggacaaaaacttttgataccaaaaaagtgtgtctgttttcaaattctttttttctttttctttttctttttttttttttttgagaccctgggcaacagggtctcagtctgtcacccaggctggggtgcagtggagggatcagtgctcactgcagtctcgacccccggctcaagcagtcctcccacctcagtcccctgagtaactgggtctacagacatgcaccaccacactcagctaatctttgtattttttgtacagacaaggtttcactgtattgcccaggctggtctcaaactcctgggctcaagcgatctgcctgccttggcctcccaaagtgctgggaatacaggcataagccaccacacctggcctattttcaaattcttgagtctgagaagtatataggtataaatacatacatggctacatgtatgtcaatgacttgtttcacaagtggatatatccttctcattttataattcatataaatggtgcaatttgcatatgaacctgtggatttacatatgtatatagacagacacataatatgaactgaattaaagtaaggtagcttcttaaccaaatgctacaacagatagccttcaactttaaaacagattgaattaggttcgagtttggcaaaagcattaatagaagagaataaatgtaaacaatgttataaactcaatggaataaagaaatagaaacagtatttaaatcagtgcttaggttctcaggtggcctttagtagctgttagccctcatgagtagcccagaggtgataatacaaatgatactatttagtaccagtttgaaacctaaaaatgtgtaatcaggctacttgattcttcatgtctattttctggaggaaaatgaacagaatttcaacaggaaacgagatgctggaaacacagcctgtagattttattcttactatagtagtaggaggagatagttctaaaagaactttatatagcagttgcttacgttagagattttgtatcttgaacatttaccatgagctgaaattttggcttcttttctttttagatactgttatttgtgaaaaaaacacagtgattcaaaatttagatttattctcctcatgaattcagccatttcctctactgtgatattccaaaatatacacattttaagacaggaaacagtgactttgtttccaacttcttgtcatgtttaaactgaagatttcatttcttgactggttttatgcactctatattaaattacctggttttgaatgtaatctaaactatgaaaccttggtgtgtgaaggattgctgaaccccatcttaactgtggctgaaatgtgcctctgcaaaggagttagtacatgctgtagtcttagacaactcactctgctcttcatatgtgcaagtaccttgaatgaaataagcagatttttccttgttacttattaaaaagatgatatattcaatgtatattctggcattgctgtattttccaaaaccgttctaatggattgtgcattatatttcctaattctagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatgtaagttatgtatgtattttgtctgtgtgcttccatattgtcaataatgtggtaatcttcagggttttctggagatacattgagttcagacctaggataagctaaggataaaaatggctattaacattggttttttgttttttgtttttttgtttttttgtcgcccaggctggaatgcagtggcgcagtctcggctctctgcaagctccacctcccgggttcatgccattctcttacctcagcctcccaagtagctgggactacaggcgcctgccaccacgcccggctaattttttgtatttttagtagagatggggtttcaccatgttagtcaggatggtcttgatctcctggccccatgatccacctgccttggccttccaaagtgctgggattacaggcgtgagccaccatgcccggcctattttttattgataacattctttttttttggagacggagtctcgctctgtcgcccaggctggagtgcagtggtgggatcttggctcgctgcaagctccacctcccgggttcatgccattttcctgcctcagcctcctgagtagctgggactacaggcgcccgccaccacgcccggctaattttttgtatttttaggagagacagggtttcaccgcgttagccgggatggtctcgatctcctgacctcatggtccgccagcctcagcctcccaaagtgctgggattacaggcgtgagccatggcgcccggctgataaaattcttaataaacattgaggaaatcaaagctagaaagaggcatcattatggtgcataggaatttaggtcacttaaccaaagtaggaatatcaattgatactctgtttctataaaataggaacagtattgatctaacaaattgagaaacaactaaatattttgtggaaagatgttgttctataagtaggtttttaccttgtatatgacacaccagtttcaaatacacgttattagatgatgttacatttagagtagctattcttggaagctccacagaaatcaaagcactaaattttacggagaaataatgtttctagaaaatgaagttgggttcaatcaagcacattgtttgttctcctagtggtcgctgagcattatgttgataacgttgccatgttataaaattacaaaatgttggccgggtgcagtggctcacgcctgtaatcccagcactttaggaggccgaggcgggtggatcatgacgtcaggagatagagaccatcctggctaacatggtgaaaccccatctctactaaaaagtacaaaaaattaaggagggtgaggtgggagaatggcatgaacccgggaggcagagcttgcagtgagctgagatagcaccactgcactccagcctgggcgacagagcgagactccgtctcaaaataaataaataaataaataaataaaatataaaacgtgaaatctggttttttttgttttgtttttttgagacagggtctcattctgtcacccaggttgtgattctcccacctcagccctccaagtagctgggaccataggcgtgcgccaccatgcttggcagtttttaaaattgtttgtagaggtggggtcttaccaccttgtctaggctgatcttaaactcctgagcttccttcttttgagtctgtggcttgagttggtttaaatttctctaatgcatgctttattttactttttcttttttttttttttttttttgagacggagtctcgctctgtcgcccaacctggagggcagtggcgcgatctcagctcactgcaagctccgcctcccaggttcacgccattctcctgcctcagcctcccgagtagccgggactacaggtgcccgccaccacacccagctaattttttgtatttttagtagagacaggggtttcaccatgttagccaggatggtctcgatctcctgacctcgtgatctgcctgcctcggcgtcccaaagtgctgggattacaggcgtgagccaccgcacccggacttgttttacttacttatttaaaaaattttttcaggttacaaaaaatatatattatttttaaaaattcaaacaatataaaaaagtaaaaactcctgaataccgccacccacagattactagcattaacagtttggtgagcattcttatgcatacatgtgcacaagtacataaacaagattaatcgtgttattcttcatcctgcttttctcctcgtgcaatgttggtagacctcatatactttaatgaacatagatatgagccagtttttaaatggttgcatagcacagatgcacagtaatttatttaagagactgccagccgcctgttgttggatagattgttttgtttctcactgttataagcagtgctgcaatgaacattctaacgcctgaatttttgcatactcgtccaggtgaatttcttggccaacattgtcaggtcagagtacacacacttctagtttaaaatatactgacaaattgacctcaaggaagactattagtttgatattttcattaagagtatttgagaagctgggcacggtcacttcacctgtaatcccagctacttgggctgaggcaggagggtcgcttgaagccaggagtttaaggcacacctgggcaacaaaacaagaccccatctcctaaaaaaaaaaaagtatcagccgggcgctgtggctcacacctgtaatcccaacactttgggaggccaaggcaggtggatcacctgagtcatgagtttaagaccacgttggttggccagcgtggtgaaaccccgtctctactaaaaatacaaaaattagctgggcgtagtggtgggcgcctgtaatcccagctcattgggaggctgaggcaggagaatcacttgaacccaggaagcataggttgcagtaagccaagattgcgccattgcactccagcctgggggacaagaatgaaactccatctcaaaaaaaaaaaaaaagtgtctgagaacgtctgttacttcagaatcccccagcactacatactgttgattttttttgttttgcttttgccaatttgataaataaatgatattttatttttattggtgaggttgttacttatttttatgtgttttggtaatttaatttttatggcctttatccatttttcttttggactgctggtctcttctgcatttgtaggagggttttttttttaaatattaaaactattgccctttacttttttttttccatttgacattatttatgttgttgacatactgattttttatcacccattttttgtttcattttaatgtaatcagatctcttaggtttcctgtcatgtttagaaaagattttctacgctaggattatataaatgtttatctatattctgaggttttatttcatgttttagatttaagtctttgttccatttagagtttttcttggtataaagattgaaatatggatgcagttttatttttgtccttagctaaccaatcaccccaatcctgtataatggataattcatctttccctcagtcatctggaatgactgaggttatgtgtttggtgcctaagccgtgggactcgctgtttacaccatgggctgtgtactggttcgttcccgcactgccataaagagatacccaagacagtgtaacttataaaggaaagcggtttaaataactcatagttgcgcatgatgtgggagacctcaggaaacttgcaatcatggcggaagacgaaagggaggcaggcaccttcttcacaaggcggcaggagagagaaaagtaaagagcaaagtgggcagtgctccttagaaaaccatcaggtctcctgagaactcactcactgtcacaagaacagcacgggggaaaccgcccccatgatccagtcacctcccaccaggtctctccctagacacgtggggattatggggattacaattcaagatgagatttgggtggggacacagccaaatcatgtcagggtgccaggatggaggcctgccgcaggatcagctctttaaccctctttaggtaaaaatatgatgctacgaggcctttcactttatcacaccaaaaacaagagcttagccttcatatttcaaacctttttagaaatttgtgcgtagtatttaagttttcagagttaacatactgctttaatgtctttttacctgtaaattctacttttttatgttcaaaaagacattatgtgtttaaattctgtaataattaagttactagggacacataaaagtgatttgattaaaagtgcatctttcctttaattgatgtttaacttttctcaaatgccatgtaattggtaaaagcagtaataataagaagtactgaattctgctgtgatttttttcccgtcttaatgcatttcaatattaaacttaatttttgtaatcaagtaatctgacatattgaagtataattaattttctcttttcagataattagtttgttaaatgtgtttacaccacaaaaaactctagaagaatttcaagatgtgtaagtatcatttttattcagtaatgcactgtacatcaaagaatgaacatctagaaaagacagcaactgctttttatacttaggaaatgtaggtggcaatacattttgtgacatcacagataactttctctgttgcagagaaatatttagaaaatttgatagttatatttaattatttgtaccacatgggttttcatcttcataacagataaaggatgactggaaagaattcttcagagcagaccaggatcactaatgtgttttgctgaactataaaatgtttttctcaaatccctgatagccaggattttagggttcaggagtttatgagtattacttaaaatgattaagtcactaattctatttaagattctgtatttccagaatcttaagtagaatcatcttactaacagtgaaatgaagtattaatctattgagaggcataatgcccaacttcatcctgaatttattggtgtgttcagtcattaacaaatatctgattgccctctgtgtgctgggcactctctgggacttggcctacctggcttccctggagcctgtcagggaagatagacaagccacatgataaatgaggaaagcatgtagtccattagaatgtgctaggtgctgtggacaaagggtggagctgggtcaggggatcaaaagtgctgagggttggacttgaggctgcagttttaaataaggtggctggggaaagacctccatgagttggtgacattcgaagaaagccttgaaggggataaagaagttggtctggccgggtgcggtggctcacgcctataatcccagcactttgggaggccgaggcgggcggatcacgaggtcaggagatcgagaccatcctggctaacacggtgaaaccccgtctctactaaaaatacaaaaaatcagccgggcgtggtggcgggggcctgtagtcccagctactcaggaggctgaggcaggagaatggtgtgaacccgggaggtggagcttgcagtgagccaagatcgcaccactgcactccagccagggcgacagagcaagactctgtctcaaaaaaaaaaaaaaaaagaatttggtgccgcagatactttgggggcaagtagaatggagatagaaggaacagacagcgctcaggacagcagtggatgcccgcctggtgttttccaagaccatcaagaggtggcgtggctagagatgagggagcaggggaagagaagagggtgaacaccacaagcctctaggccgttgtaaggatgtcttttgctctaaggcaagtcagagtaagagtcttagcagagcagtgagctcacctgccttctgtttgaaaagcgtaactctggcatctgggttggtaacccactataaggggtgggggcatggaacatcagttactgctgttgcagcagttctgttaagggatgacggagggtccatttggcccagaggggtaataggaagggtgagaggggaagagactggatgctgaaatggttctaaagatagagccatggtattagctgatagatgagatgtgtggtatgagagagaggaattgagaatgacacctagatttttggcctgagcacctgaaggatgagggagctctcaactgagatgatgaaggctgtgagaagagcagactgggctagggatggaatcaggagttcagttctggagatggctttaagatgcctgttagacatcaaggtggaactgggaatagggaggcagaggaatgagcctggagttcaggagatatgtctgaattgaacgtaggaatttgggagctgatggcctgtaactgagatcactaagaaagtgagtgtggttacagaagagaagagggtcaaggaccagttgctgggtattttgacagcgagaagttagagacaggacagggcagggcccgctgggattataggactggccagtggatttagcagcatggaagacatcagtggcctcgaggaggacagtttcagcagaatggtggctgcacaaacctgatccaagtgggattaagaaaaaaatgggagaaggctgagtgcagtggctcatgcctgtaatcccaacactttggaaggcccgaggtgggcggatcacttgaggtcaggagttcgagaccagcctgggcaacatggcaaaaccccgtctctactaaaaatacaaaaactatccaggcatgatggctgttttttttttttaatttaattttcagttctgggagtccgaggcatgagaatggcttgaacccgggaggtggaggttgcagtgaggcgagatcacgccactgcactccagtctgggtgacagagtgagaccctgtctcaaaaaaatttaaaaaataaaaagaagggagaagaattggagatagcacatgagacacctctttggggagttttgcttgcaaagggagcaaagaatcggggcgttgctaagcggggagtggggtcaagtgtcctttttgttgttgttgtataatcacttttaaaaacgtatatattgtagagcaatttagagccacagcaaaattgagcgggaggtactgagttcctgtctgtctccagccccttacgtgcagagcctcccccgttctcagcatctcccaccagagggtacatgtgttgtgattgatgagcctgtaacagcatggtctttaggctggtacggagaatttcagccaaaaatgtaagaagtaggaaaatttgtgtttgagattctatttaccatgctataaaaggttgttgtttttttttttaatttttaacttgtaagacgttaagtttgttatttatatattctttggaaaatttttagaaagttccattataccaagttatctttttactttagccagtgcagtgattggaagtaagttacagtttcatgaaatttagtcataaaggaactttggataattttcaaataaataactgaccttttctccctcaggtatttggttatggaattaatggatgctaacttatgtcaggttattcacatggagctggatcatgaaagaatgtcctaccttctttaccagatgctttgtggtattaaacatctgcattcagctggtataattcatagagtaagtggtgatgtattaattttatttttaaaaacaatcatttggttgtcataatcctttacatacaaaataacatttaaaaaaaattgttaggcttgaaaatccaaatagatgatggaatcatatggtgttttaagagagtcattctaggaggcatctgtggagccgcctggcctgccaggctagaccagctgctgtggacacagccaggtactgcgctctcagtcagatactgcgcaagaatacattgttttaaacttttcattttaaagtaacttaaaacttagagaaaaatttcaagaataggacagagaacttccaactaccatttatctacattcacctgtttttaatatatttgccatatgtgaaatcccatttttaatgagcaaggaacttaaaggccaagtagtcagtgagacagctgcttgagaactctctttcttaaataatgacccacatatccatttctcttatcctaaaattctgccgtgccagcttccctgcatcactggtgggagtggccagaccctgcaccgcaagggttcagagcaggcctgtgggctcagcagaggccgggatttgaataacagtgtgactgtactgtcaggaaaaacatttaataagctagggagcgataatataattaatataattctctctaagctgattttacaattttttgttattattacttgtacggctgtgtaagcagactatcatgatagatttttttttttcacaatttgataccaatacttcagtagcaaagaaaatgaaataaacttcttcctgccaaaaaacagtacatttttcataaaaaagaaagatggaattgatgtaataggtgaagaacaattaaaacttgtcaaataaggccagtaagaaaaccccaacagttaacaaaatctgttttcaatgacatattacagaacaattaaaaagctacataaaaatcagtgttacctacttattagaaatacattttaattcacctgtagatccaaaaacatttagacatacagacaaaattttgtattaactgacaaaaaaacccacactacctattggattcatgttgcttaaagggtatctacagaattctcacctcaatattttcgtgttaaataaggtggaaatcaacagtccagagatggtcattagaaatgagccactgacaaacacaatatatttataacttgtataacatttcattcatgtgcatgttttgagcattgtggaatatttaatttgcatcaggctttccaaattccttaaatttataagatttgttctcagtgggagttctcagatgacttttgaaataattattaaaatgaaaatttatttgcaaactactagggtttagatacagaataccttcttgtatttaaagatccatctccagtttgcatacatcatgtctttcaatgtgccggagagaaacaaaggcatccccacgttctttacatttatagggttttttagaaatgagttcttttatgtcttcaagtagaactggaaagactgaagacactaccacattgtttacatgcatagaatttttcctcagtagtagttttgtttcgtattttcaaagggaaatggaagagttccatgtgctttttaatgtgctcagaggtaactggaacatataaaggcatcatcacattcctcatatgcatgttatgtaaattatacggttttcctccagtataatttctttcatgttttcaaagataactgaattaactgaatgttttccccaaatccttacattctcaggatttctacagagtatgagttttttcatgtttacatacaggactggaatatctaaaggctttgccacatgccttacagtcatagggtttctctccagtttgagttctttcatgtttacatagagaactggaatatctgaagacttcaccacattgcaagtctgaagacttgaccacattccttatagtcaaagggtttctctccagtatgagatttttcatgtttacctagagaactggaatgtctggagacttgaccacattccttacagtcaaagggtttctctccagtgtgaaatttttcatgtttacatagagaactggaatgtctgaagacttgaccacatcccttacagtcaaagggtttctctccagtgtgagttcttccgtgtttacatagagaactggaatgtctgaagacttgaccacattccttacagtcaaagggtttctctccagtgtgagatttttcatgtttacatagagaattggaatgtctgaagacttgaccacatcccttacggtcaaagggtttctctccagtgtgagttctttcatgtttacgtagagaactggaatgtctgaagacttgaccacattccttacagtcaaagggttcctctccagtgtgagttctttcatgtttacatagagaactggaatgtctaaagacttgaccacattccttacagtcaaagggtgcctctccagtgtgagttctttcatgtttacttagagaactgaaatgtctaaagacttgaccacattccttacagtcaaagggtttctctctggtatgagatttttcatgtgttcaaagggagctggaatgcctgaaggtgttaccacattttttttttttttttgaaacagagtcttgctctgttgcccaggctggagtgcagtggtgtgatcttggctcactgcaacctccacctcccaggttcaagcagttctcctgtctcagcctcccaagtagctgggattacaggcacctgccaccaaatttggctatttttttttttttttttttttttagtagagacaggatttcaccatgttggccaggctggtctcgaactgctgacctcatgatctgcctgcctcagcctcccaaagtgctgggattacaggtgtgagccactgcgcccagccacattttttatattcataaggtttctctccagtatgagttctctcatgtgtttggaggtaactgaaccgactgaagcctttatcccatttttgacattcattgggtttctctccagtatgagttctttcatgtcttctaagggaactgtgttgactgaaggctttgccacattttttacagttataggatttctctccaatatgtgttctttgatgtcttcacatggagcggggatgactgaaggctttgctacatttcttacatttatagggtttctctccagtattatttcttttatgtttctgaatggaactggaaagagtgagtcttttaccatatttcttaaacacatggaagatttttcacattgtgagctctttatgtctttgaaagtaactacaaaaactgaatcgtttcccacatttcctacattcacggggtttctcttcagcatgagcacctttatggttatgaaggtaaccagaatgtccaaaggctttctcacatttctgacatttataaggtttttccccactgtgagttcttttatgtttttgaaaataactgcaaaatctcaaggctttaccacctttcttccattcacagggtttttctccgttgtaaattactttgtgtctttgaagtaaatagagaaacttaaatgtcttcccacatttcttacatttatgaggcctgttaccagtgtgtgttaccatgtgtctttggacatttgtgagagaaatgaaggttttctcacattgtttacatttgtatggcttcaccccacgtttctcccatgcatgtagtttgtgtccagaatgagataagatgtgcctattaagggatgaaggacatgtgaagacttgtccacacactctgcattcacatgaatttacatcagcagaaattttcttcttcaggttcagatttggaatctggccgaatatttctccacaatgactaccttctttacattcacagagtctttctcccataggacttcataaattttttccagaattattgaaatgactttcactgttctggtcttcccatttgtttccatttcctggcttccaggattctatggcatcctgcttagggatctccaaggtcacagggtgacagtctgtggcagagccacctagggcctcctggcccgaattttttctaaaaaacaattaaaatactgagtgagactagaggcagagataatataattttatcggaaatagatattcttagcattccctggattattactatactaattttatcaacagattgccattagattttatgttccaacagcaagaggtcatctttttgctgaactgaaatctgtggggaagaagctagtgagagacaagaacagcagagcctgttactacagaaataagcagatgggttttagatggtggagtggtaataattttttcagatctcttttgccaggaaagattggttccatcacagccattgaaggcctcccttgggggtagagcccaccgacccacagagggcagggttgtctcgtctcaagcctcaggtctgtggcccaagggcagcgtcagggatagctcttgtcctcccagggctagctgacagcctcccatctgccatctagtgtactgttttttaaaatagaacctttgctgccatcagatggtcagttaaaataatatattggtgactttgctttaaaaatagtaacactaggcttctgaattaaagatctcctgatgtaccattctatttctgttcctgaagtttccacagaccttcatataatttaaggtactcttgatatctcttaaatacattttatttatgctttagaataatttcccagattattagtcttactacattaggccttattcattttataaggggaaatggtttgtctgacttgttcccccttgggccccaaggtaagtgggaaacaatggcctcctgtcactgggggctttgtgagagctgcagcgtcggcaggccttttttatggaatagccggtgcctgcagcctgagtcagatggggcccaaaggagtgtttggtttgcccagcacgaggtatagaaacctaagaagccttcagaaaatggccctgttgccatccctgcctcctgctcaccatccccacccacctggcatcttgctgtgtcctctcctccctgtcaccttgttccctgctgcttcccacatccatggccttgccaggctctccccacatctgtgtccatgtgggagagtgatgcatgctcactgtggggaagttccaaacattgcacaggtgtataaagcaaagggggaaactccctcttgccccctgcccccctgccccacccctgcccacatcccaggaagggaggagccctaagttaactgttctgtgtggactgcaccatcctttgttccatctacagtaccatgcacagagatagacacacttttaattttgcctattaaaatggtttaatacaaaacataaattttaagtatttgaaagataaagttttgcccatgatatcccaccgaagtatatactttatataattcaaaaaatgaaatgcaagtaacccagccctctgttagcacctggagatggccagtgagagcacgctggtgcatgtcctgcctcactctgcatggcacctctctgttgactgatgttaacaccagcatatctgtacttatgtccttttgaacttacatccttcaaagacaggatcaccttgcatataactgcgtagcaacttcctaaacaggtagcttggtttgtttttttaaatcaaggatcaaatatttctataaatatttatgaaaaacagatacctccacctctccctttatttctctctccctagaagcaaactccttcagttcatttagctgattattttggtctctatttccatattgaaataatatgcttagctctttcttcattgatcctttctcagtttggggcataagatgctgatttagcttcttaccaacccagccctcaccctcggccttcctcgccctcctcccaggctggtggatgtgatggtgtttggctcgttgcgtcatcgtgagcgtgtaaatgctttgcacagcagaccttcccctttcaccttttgttccctggagttaacaaacacttatactctatttgtgtgaggtttttgtttgttttggggggtagtttctgtgttcttggtggtaattcaaccctaactcttccatcaggcatctgaattttctctcagcacatgtagatgtcttgggtatttcatcagtttcatcttctcaggaacctctcccaagcctcagccctgttcccctttgcactggctgccactgcacctgctcgaaggggctgtcctggatctcccttggtgattttgtgggggtttccttcatctgcctcccatgttggattccttgcttgctgtccttgtctctcagattacccccttgttttggtgggacgcatcctccaaaagcttcctaaattgccacaggggagagaaattttttgaggcctcaaatgtctgaaactctttattctgccctctcacatgatgagtagtgtggttgtgtgtagatgtgtgtagaattcttagttacagatcagttgcgctcagaatggcggaggcagtgcctgtggtagcaaggcatctagcatggctccggagtttcttagtgccatctgatgtttttttagatggagtctcgctctgtcgcccaggctggagtgcagtggcatggtcttggctcagtgcaaactctgcctctcgggttcacgccattctcctgcctcagcctccctagtggctaggactgcaggcgtccgccaccacgcccagctaattttttgtatttttagtagagacagggtttcaccttgttacccaggatggtctcgatctcctgacctcgtgatccgcccgcctcggcctcccaaagtgctggattacaggcatgagccactgtgcctggctgatgactaaccttttttaagtgctgtggttttgggttttggtttggttttatctctggaaacttttaaactcagttatttattccttgtattctgagatgttttgatgtatgccttgatgtgggcattttttctttagttttgctgggcacttggccttcagtctggaagcacatattatagaggtctgagaaatttatatcatttctttcagaatgtcctcttaactccattctttattctttttctctgaagcacgagttaattgacactcatttgctcttaaaagttcctttttacagcattctgttcttgttgcatgtatatactatcatctctgaggataagcttttgttgaagggttttatcactccctgcattgtctttctctactgagagttccctttttagtgtgttaggtccctccctgtcacacgcaaggctttccccaaatgtctggttggatcatgtttaagattgaaacattaggccaagcacggtggctcatgccagtaatcccagcactttgggagactgaggcgggcagatcacctgaggtcaagagttcgacaccagcctggtcaacatggtgaaactctgtctctactaaaaatataaaaattagctgggcgtggtggcaggtgcctataatcccagctagtcaggagactgaggcaggagaatttcttgaacccaggaagcggaggttgcagtgagctgagatagtgccattgcactccagcctgagcaacaagatcgagacttcgtctcaaaaaaaaaaaaaaaaaaaagagattgaagcattaaaggctgactggaagtactgagtgaatgggtaaattgttaaagaatgggtgtctcttggaccacaggcagccacaggtgtcaccttctgtaggttttttctctgggcaccatttaatttctctggaaaaggccccttcagtcccttggtggagggatgtaagcctggctgctggggtacagggctgtgcttctcatgtggcagagcgcaaactcaccaggcagccctgttgcaggcaggcctcaccgtgccttccctgttggtacccacaggactgtgcatgcggcgcctgtggccctgcacctggaagctgggcatcagtttctctgcgtgaagggccagcaggagtgaggaaggagtggagcctcacttctgggatggagatggggatctgggacatctactacgtacttggactttcaataaaatgaaaacttctccaagtgctacccttgcctcttctgcctccatagcacctgcatttcacttgctgagcctttcctgggtgtcgtggccatttatagaggttggcatttccttcgctcagctagggcatttgggcggccctgcagcttcctgtccctgtagcgtggggcttttcgtgggcggcttccgcatgccacggtgggttagacaggcgagggactggccgggaggaggcctgtgcgagaaggaagggggagcagccagaggaggcagcaaatgctagctgaacgtagtgcagtcctggcccctcagaggcctggtccagactgcggtgcagctctgagggcctccggtgtcacacaggaacgggcctgcctcagcatccctgcccggtcggcccctggctgacggctctgtgggaggtgtgccctggcagggacagagggtaggtgcagacaccacactgggccatctgtcactctcactcctgtggcgggagaccaaggagtgcatttccgtggaccccacagtccaccctggccccctcagctctacttctccacataagttgggaatggctttcctgtggcgcccatggttctctcttcctcaggggaaatctggaagacagaggttagtgggacaccctgtagtccctgtcactgtggtctctctgctggctctttccctaccctttcctgttattcataccctcagctctcacattggcaggcctctgtggcttgcctggcctgtgtcccaggccttcattcctgagccgtctgtgtctggtggctctcagtgggccacagggtcccaggccacccagtggccgtctccccagtcctcagtgtgtagccggagcggaggcgcttggcaggtggagtaacgcccacacgagttccttggcctgtgagtaagagtcgtcacagtgggaaggccaaatggaaacctgaaactgcccccaagatagtaaatcaaaaacaagatcacaccctgcagggcccggggtgggtggaggagactagggccaccatggaagcctcaggggagcagagacagtggtatcttgcatcccagtctaactcgttagtccagcccttgaagaagctgcatggattctggagaatgaccccagacggccacaggcttacggcactggcagtcctggccgcagctgctgtgcatgtcaaggtgcagttgttgctggagcagattaataaggcctcaggtctggcatgttgatggggcaaatgcatcctccacactgattagaagagaggcccagacagcgcccacactgctgcaggctggacagcaatgttctctcacagccttgctctaagcctttgctaacgttcccaccctcccataacatggccgcaagagacctggcccagacttcacttatgccctgacccctgacccctgaccccacgaaccctgcaagtggaggagccctgagagtgtttggggtcttcgggtttcagtgtctacttagagctgtgtccattcatcctcaagagtgcctggctgttcttacccggtgggtggccacaggtacctgtggggaaggaccggcaaggccagacagtggacacctgtcatgatgtgctccttcctgggatacctctcaagcagtgggtctggatcccagagttgagcgggcagtgggggaggtcagcacctgccccactcatgctgcgggtgctgtgggtaccctcactgctgcccacagggtagcgttgggttccaggcattttgggagccaagccccgatccaggcgtcacttggatctgtacttggcatttgtcttctttgttctgagtgattttcaagacttgaaggggcagaactgtctttcctctgctgtcttgaaattgaagtgaggtgttgggaagctgcctcaggttgtatttcgggggtgactagagagggtcccagggtgcggggagagcacctccttagccacctccccattggccacacagagcacccacacaagcttgggactttatcaccacagtcttccagcagacggcagtaaagtgtgcttttcctgttaaattagtatgtgatgacagttttttgacagatggcagtgtcttcagatgagcgtgtttctggcgcactggggttcacagagctggcaggcagcccgtggagatggttccactgctgcgtctgtccttggtagaaccaggctgtccttgtcttccttgctcctgcggccgtgctgttagttctgggtgggctgggcttcagggcctgctggctggggaagtgtgtgcatttcacacctcagaaatcagcctcctggagagaaagtgcccactgcacaccctctgtggcctgaggaagcgcctgtttctgcttctcccgccagcaccgagtctgcttgctttccatcgctgccaagtgatagactaaaaatgggcattcattttgggtttttaaagaagatttttgtgagattgagcattattttatctgttagtaatttatgttctaaaatgcctgttcttgtcatactctttgattttaaaaaaggaaacaagaagcgaattcgttcatttggtcttagctccctgacttggtcctcacagcggagcgtccctggttgaatgtgggctgcttctccctggctttccttcatgcagggaggcagcccggtttcttcctctcaggcctttctgggaaccgggggtgtctgcacagtactctaaggtggaatggaggggctgggggcctctttttggggccaggtagagattgtgactgcatttttaaacattatatgtttatcatttaaatcttacagaatctaggaagcctagaaacaggtcacttagcagcatggcagtgtaattgtacctgttgtcaatgtcgaaatggcttcctgcttgccctgatgacagccccacagccttcactgaggcatgccgcctgcaaccccccttgtggcccatcagttggggtgtcttacaggcaggtgctaggcagtgctactgaacctgcaacttcctgggtaaagtatcctcatgccttacgccatgtcagtggcttggcagtttgacattgcaggtgcactactcttgtgaaaagaatgggtgtgggttgtttacaagtcacagtttctcaagtgagtttgcaggccgaagtccccaggcaaaagtcaaattcctaaggcctgaggaaggggctagggtggaggatcagcaggaagaaaatcccttagttatgagggaaaaggttgcagaagttgtgttaaggctttgcaagtcaggtggaatatgatgcatgtcttcattctgcagacacttcccaagtgtctgctcgcgccaggcgtgcttctgagtgctgagagctcacacagagtcagcactggggagggaagagaggtggcaaccagaacatgagcaggtgagtttttgtgccacgtacagatggagacagcagcaccagtgctggcgtgtctttgtggcgaaggtgagaagattggaggtggatgatcatggaattgctcttccaaggagagaaagagccatgggaagattccaggatcagacgattctagacctgtgctgtccagtatggcagccactaaccacaggaggctgtggagcactcaggatgtggccgtgctgcagttgtaaaatacatactggacttcaaaggctcagtactaaaaagagaatgtaaaatatctcagtatttttcttatgttgattacattttgaaatgataatattatggatatattgggttaaaaaaatatactgtatgattaaaattaatttcacctatttctgcatgctgttgagcatggctagtagaaaatgtaaattatacacatcgttcgcattatatgacattgtctgtgggacagcactgccctggactgacagacagcatgaggaccttagcaagagagagtcagagtattggggaactcaagtccaggcgtggagagcaggagggggccgtgtgtgctggactgacagcatgaggaccttagcaagagagagtcagagtattggggaactcaagtccaggcgtggagagcgggaggggggcatgtgtgctggacgtgtagatgcatggatggagggtagataggacagcctgagggcctgcgagaccacagaaagggcaaatgggggccatgaaggtttccactgggggtaaggggcaccatctgacggctttaggctgatttgttttagtttcaatttgagagtaagattttccaaagttgttcccaaatctcagagttcagttcactccctacactctcacactggcttcacgaccctcacggatgtgaagtagtttatttagcatgcttcattcattttactaatttaagccatttctttcctaggatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacggtgagtatagccggggctggaagaggctgggatgtttagaaattgctctagcggtggtctcgagttttttctctttcctttgaaccatatgatatatactgtggggactgttacacccagaatatagcatgatccagagataagaaataattaattgtgtttttccattggttaaaatcattctcttttaaaaattcacttttaaaattgttatttttgaactttttaatcagagttaagctgtctatagccaagtgtgcaaatcctgagtgtgcagctcagctgaggtgagcacacccacagcagcagcagctctggcctccccatggcccctcctcgcagcccacgaggctggccaatctcctgatctccagtaccatggatcagctttatttgttggtctgcatattgtttttttgaatttgatgtaaatagaataacacatgttttcatgtaaaattggtgtctttttacatcaaaacttagcttattctagcaatatcagagctctttgaaacttggcttttagcaaatttgttgaaaataacgaaatcacgcttacttatttttaaaaagactgaaagtttgcccgggtcatctgaaatgagttttgctacaggttcatcttgctgcgttgtagcttgtgttcccaccctgaggggcacagcttcatgtgcttcctgtggaggggagagaaaacttgatcccctgttcacttctcccctcggcccgccagcagggcacttagaggcctctgctgtctgtctgaggccccacagatgagggtgggcaccgtggaagtctgggcccctctagcagggcctcacctgcagtcctgcaagccagccagcctgtgccgccagtgagtgctgctgcctttctgacggggcagtctagaaaatgatcgctcaggaggtgtggtatcaacaacgcacagaggctcccgccggcaagctagtgacgtgtaccgggtttgtcctgggagggggtttgaagaaaaaagatgggggactctagctggtttttaatcccctggtgtttggtagtggacatctggtctgtcgggtgcatcatggcagaaatggtcctccataaagtcctgttcccgggaagagactgtatccttcacaggggacccggtacttggccatggaggctggggtgggcgtgtggccctgaaaagctttgtgttcacaggcacttcttgtttctggttttttgtttgtttgtttgtttgttttaagctataaagtattggactctttggcactaaaaccccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtagtcagcaagtcatgttagagatacagcagaaaggagaataactactctaattgttacaatagccttctttcctcatttgccattcttccatcctcagtattttttaccctaacatggttcttcacatcttccctttttcatttgtgttttaaccacttagtttttcattagtctttgactttgttttcgttatgaaagtttaaattggtctccatccttgggcagattgatggttgcttttaaggaaatcaagctccatagtcagtgttttgtatgtatcttaggaaaataatttcagattttaataattttatcaaagtggtctccttataaattcttcacagtgcaaacttaaagtgaaaatatttttatttctctcattttatttacctttctttacattttctatatcatagattatataatatgtcaagttattttatttgttctactaaattttctagcagtttccatagcctcatctcagattcacttgttgcaacctataaataaggacgtctttattttgcaagtaaacttaattaaaaagggaaaagttgaaaaattaaaagactaataatttagaaatatctacttaatgttcagtttgtctcaattcttactcattttgtgccattccttgttttattacaaaatgttttcttcaaaaagtacaaaaatgaaaaatgtgagtactttttggtgcattttagtaagtaaaattaaaattcctgctatacatatgaacattaatgtcagtaattaatagtgttatatataaggttacctaatgttattcccaaaagccacacagagtttaacatcattttctaaagaaaattttgccaactctttcaaatattagattgaaatttgggagatagaaaaaagttgcagaaatcagactgagggtctcagagatttgctttaatttgcgacccagggtagaaaaggaactcctgtccctgcggtggtctatgagaaagagaaagctttagcccggccacctcgggccccagctcagactcctccccttggcagccatgcatccttgagaaatttagggcctctctgagccttggtttccccttctgtaaaatagacctgtggtctgcctgcagcttcacgagagttagacaacagggtccactgggcttgtcggaattattgttccccttcccccgtccctctcatctgtcccccatccctcccacctgtaggatgctggggtggagtcctctcggggaatctgtgggtctcctctcacaactggtttaatttctagtcctttatcattaacccagcagatatttctctcacctgcccatttctgggtgcctagtctgactgagatgcaaagaggctcctcccagctgctgaattgagggtggatcgtcaagggcagggcagagcaggagaacagagcagaggctgccatcatccagaggagaggtggaggcccccagcaggcgggtaggggtgtggccggggagatgggcttgtactctgctttgaagctggacccttcaaggagccttgctagggtttggagatgtctgttagacagtggaatttaggggcaaggtctgggatagagagatcaaagtgggtgtcatccgtctgtcggtagccttgaagcctaggactggtagcgagcacttgcaggggaggaagagaccaggacccgggacttagcccccttgaggtggagggacaaagggaatagggaaggaaatggagaaggcactcacgtgacccctcctcctagagtgtggtgactgagggaggctcattcacatgaggagatgaggacgggggattggcccctgggccttgtgatggctgctggcagccatgatgggcacagcatttatggagtggagggaagaaagcctgatgggagtatgtttgagagaaaatgagaggctgggaattagagacacaagtgtagacagctcttttttctttccttttttttttttttttttcctttgagacagagtctcactccattgcccaggctggagggcagcgatgcgatctcagctcactgcaacctctacctcctgggttcaagcgattcttctgcctcagcctcccgagtagctgggattacaggcgcccgccaccacgcctggctaatttttgtatttttagtagggccagggtttcaccgtcttggccaggctggtcttgaacacctgaccttgtgatccacctgcctcggcctcccaaagtgccgggattacaggtgtgagccactgagcccgaccgacagctctttatggaagtttttgctgcaaataggaataagaaataaagcgataggtagggccaaaggaaagcagctactgtgttaacataggagaaaacaccatcatttaccaacgtggtggaatgtattggtagagtgcaaaatgtcgatgatgttggagaaggaagagttgagggagcttgtccttgagtcaggggggttagggtctagagctgagcaggcttagtgtagccgggagcccagatggttgctgtgtggcaaatggcacacagatgctgggtgggtgcatcctgggaagtctgtgggagtgagcaggcagaagaggtatcaaaagtataaggtgggctgggcgcagtggctcacacctataatcccagcactttgggaggccgaggcaggcagatcacttgaggccaggaattccagaccagcctggccaacatggcgaaaccccatctctactaaaaataacaaaaattagccgaccgttatggcaggtgcctgtagtcccagctacttgggaggctgaggcacgagaattacttgagcccgggaggtggaggttgcagtcagccgagatcatgccactgcactccagcctgggcgacagagcgagactctgtctttatttatatatgtatatatggcagaaggaaaaggtgtgagacagttttcacattttggctaaataggtaaataaaatgtgggcataattctgatttgacaatatgtatgaaccaggagtaggaaggagaatttgctagtgaattgaatgccagaaacacatttcctgagcgggtcttttggaagtataacattttggaagaactgagttcatgtaccagttccctaggttatttcatggtgatgtaagttcatttttctaagacatgcctcagtgagcacttttttaagctgctgttgatgctatttttttctcacttgcattctcttgtatagcgagtacagtttcagtgtcactttcccacatgtaatcctaattatcccaagcctaacaagcaccctgtggaataggcaaagctggtaatgtctgcattgaacaaataaggaaacagaccccaaggaagcctgactttcctgacacactgagtgtttaatgcagagttgagtctgaaacccaggtcacgcactttgaaaggaaataaaatgcattacctagggatcgcagtgatggttgggaagagtcagttccaagtaaaatagagcatcatttgaaagctgtcgctgggctcagtctaagcccagttgcttggttcccagctgtaaactgaggaggtcagataggtctctccacaggtcccttgagatcctctgttctttagagagctgtgaatgaatctaaggtagcattagtatgaaaactgatttcaatttgcttatgtaatgtttatctaatttcgtgtttaatcatttttgctataggtattcttagttataagataaactttattttgaactagagtgggaaggtgtgtagacttcattgtgttgatttaataaactgtgatcatagtttatgaagatgcagagtgtgagagttttaaaaaatagtgtaacttggaaacccaaaccttatttgaatattatttcaaaattccgctgctgatccagtggggtggcctagtcgataggtttaaatattattcaagtgatgctgccgcatgtactgtgaatacaaggtacttcagttgtattttcctcaagaaactccttagatattgatcagtggaataaagttattgagcagctgggaacaccatcagcagagttcatgaagaaacttcagccaactgtgaggaattatgtcgaaaacagaccaaagtatcctggaatcaaatttgaagaactctttccagattggatattcccatcagaatctgagcgagacaaaataaaaagtaagatatcctttttttcttatacttgtgttttgtaattcaggtggtgctttcactctttcatgtttgtattctaaaaacctgtgttttgggagagaaagtcattttaggcctgaagtctgaggtacgaaggcactgaggagagaaagcttaaaggtctagaagctttatcctctataagacggcttaattgaagcctttggccaaaataaaaataatcaaatcagtctgaaagaatcttatgttacagttacagcaactggaattcaaaaagttttcaggtaagaagaacacttaatgcagattctagagtcagaagcgatgtgacagttgttcgatgaaaaaggtccttcctccccaccttctcctgcaccctttactacagtgtgattgtttaaggaaaaagaaaagatttgattctgtccgcatgaaggtaaactgtgccttaatcagaaaagccccagtctttgcttattcaggttgtgaactttaattgacaaaacctaggtgagccttatatttaactaagttattgaacttgtttttctttttcctaaataccaatctgtagattaaaaaaaaaagtgtaagttgccagcactgtatacagctaggccagccagaagcatctgtgagtgttttatcctgtgggaatgtgagattgttgtgtggtttgaaaagtctgttctaatttcatttcgatgtgacttagagaaaaatactcccccgtgcctcatgcccacactctgggcagtgccacccgcagctcggcaattgccaccttccttgctgtggtttcccagccttgggccctgcccagacattggtctgaggctgcctggtgctcttccccaccaccctgggagcccaggtttctcttccccttgcagatccagaggcgtaaaactacatttggaaacctggtttgtcatgaaagtggacatttgactttttcttaaaaatgtttgggttatggctgggtgcggcggctcacgcctgtaatcccagcactttgggaggctgaggcaggcggatcacgaggtcaagagatcgagaccatcctgcctaacacagtgaaaccctgtctctactaaaaaaatacaaaaaattatccgggcatggtggcagacgcctgtagtcccagctgcttgggaggctgaggtaggagaatggcgtgaacccgggaggtggaacttgcagtgagccaagattgcgccactgcattgggcgacagagcgagactccgtctccgaaaaaaaaaaaaaaaattttgggttatattcatcttgaacctatcaaacatttctcaaaattaatatatctttgttctatctgtgttgtcatatttagttctttattgtatgattctgtttgtttcatattaacagcattaatttaatatttgttgtcaccctagcaagtcaagccagagatctgttatcaaaaatgttagtgattgatcctgacaagcggatctctgtagacgaagctctgcgtcacccatacatcactgtttggtatgaccccgccgaagcagaagccgtgagtatctgttttgaaaagatttatatagagaggccaggcttatatttccttggatcttgtctgtccgtccagagtggctacatatgggtagcaagttctccatttgggggctcccagttacagaaaggccaagtgttgtctgagacctgggtcgcttgctcttttgctgctggagccccagctcagagtacctcgggaatgaacttccgctttggtgctaccagtctccattttgcaaatgctgctgtgagctcatagtttattaagcatctattctgtgccattggctttggttacatcctcttgtttaggccacttaaccagagaggctgagcaacttgctgaaaaatcacacgtctgtttatccttccctaaaggcattgtagctcctggttcccccgctggaggagctccactctgagtttggtgctcacgtgcgtgtttctgtgtcagcactggtgtgagtgagctttagctgtgagggaaatcactgcgtagtggcaggcttccttcatgccatgagtgaaatacatgtttatgtcatggcctgtggttttgccatcagtttaaacattgttttatataaaaagaatccaatttataagcagacttttataacagtccatttatgagttggacattggatttgggagttctcccatgaagaaaatgtaaaatttgttctaagaaacaacagtaccttccatagctgccagcacagtgccttgtccataatgggtctctgggaaacagcctgtgatgatgagtttctaatgacatctgggcagatgtctgcgttttgaggtcaggtgattattaagaggaacataataactcttctttggttaactttttcataattattttgattctaaagttgatataatatcacatgacaaatctttattaaaccacgtgttgaattaaactaaatccatatcataaatagactagaagtcttccaagcaattttaccttttttagtgcctcatttttttttgaggcattactgttgactttacatatgatttaatttttagccaccacctcaaatttatgatgcccagttggaagaaagagaacatgcaattgaagaatggaaaggtaaagatggagcttattttgatccttccttttgacatttcttccaatcctgtagagcagaggcttttcattttgtgacatttcccttcaggaaggggcaagaaaccctgcgacccacttagcctctttctccccagtttccagtagaaaatgaacttgaagagaacagagttagagaggaacatttatgaatttcttatcatttgcttcaagagggaaaaataatatttttttcatggcttttcacatattgatttataaactgagcttagtaattgtatcatacttatattgattgatatgtttttaagccatgtagttgtacatatgttttaaaatctagtttgggggaaattgcagattgaaaatatgcaaataggtattattaccactataagattaaccaaacaacccacaacaaactatacctgtaatgaagaggttgaactaacaatttttcattaagaagcaggatcagtagtaactgagaaccacagtcagagtcagtcaacactgatgagggtcatgccccagggccatcctggggtgtgggagtgccggttacctgtgtgtgcccgtgctcagcagtgcatgcacacagcgtgctcactggcctcagtcaatgctcactggcctcagcgaatgcttgcaacgtgctaatgttggtttatgaatactgacattttaggaatccctcatcacttacttcgtaggtaattagtttttcttacagatgaaagttgaggaaaaccgaagttgaaattaagaaaagacttaggcctgtggattcatttctggccagtgtggggggctcctagcccacatgtgggtgctggttacctttggagaaccccaagtaaccacatagagaaacatattcaaatgggtgtgagaatatccaatcccctacagtgttctgtgggagccactccacttcataaagcccccttatggatccagaaccaccctacatgttttgctgccttactagttgcattgaaaaagatgtaatgtagtccaggcgcagtggctcacacctgtaatcccaggactttgggaggccaagtggggcagatggcttgaggccaggaattcaagacaagcctagccaacatagcgaaaccctgtctctacaaaaactacaaaagttagccaggcatggtggtgaacacctgtaatcccagcaatttggatggctgaggcatgagaatcacttgaatccaggaggtggaggtttcagtgagtcaagaccatgccactgtactccagcctggatgacagcatgagactgtctcaaaaaaaaaaaaaaaaaaaagaagaagaagaaaagaaaagatataatgtatcaaaatatgaatattttggtccaggtagactatattactgaattgactctgtcttacaattaaaaataacaaatcgcaatgcctttgttccagttgatttggaagcagagtttagagatacagtgaaactgtttagaaactgattaagcattttaacttgtatttttattaaagagctaatttacaaagaagtcatggattgggaagaaagaagcaagaatggtgttgtaaaagatcagccttcaggttagtgattgctttaattgattgtatgatatttttctttccctattcaactttttttttttgagacagagtttcgttctgtcgcccaggctggagagcagcggcgcgatctctgctcactgcaacctccgcctcctgggttcaagcaattctcctgcctcagcctcccgagtagctgggactacaggcacgcgccaccatgccctgctaatttttgtatttttagtagagacggggtttcaccatattggccaagctggtctcgatctcctgaccttgtgatctgcccgcctcagcctcccaaagtggtgggattacaggcacgcaccaccatgcctggctaatttttgtatttttagtagagacggggtttcagcatattggccaagctggtctcgatctcctgacctcgtgatccacccgcctcagcctcccaaagtggtggggttacaggcgtgagccaccgcacctggcgtctttcccgattcaacttttataaatggcagcaacatgtgaaatgccagcctggctagcatcagatttaaaaaccgctgtatgaatagccagcctttttggcttgtcatagtggtggtggtggtggatgacattttactgatgtgccaggcactgaactttgttataagcatttctctttcatctttgcaataactgctgtcacctccatttacagatgaagaaattgaatttaaagccttttcaatgttgataaccctttgtactggtcccacccaaaatgccaatctaagtaaaatggagtatggtattctttttgagaaaattgttgatatcattttcccatttttctgcttgatctactgatcttcatagtggtggaagcctctaatgaccaggtagttgtatgatcatgagactctgatatgagtcgtgttcacttacgtctgaaggattcttcctgtttactaaatgaaacgctcacgttatatcattgtctctctcccactcccactgggaagcatgcacacacatgtgtgcggatgtgcagagagcacagcttactttttattcttgaattttatgttcaacatgacgtatgtgtcaagcatctagagattatataacttcagcaagaacttaggtgcttgttaactgagcacacacgtatgactgcagacgtcgatctcagagagtgcatgttgtgtttttattcaaaccagactaaaatatggatagtaggaagtaggatagtttcatttgctttaaaagattaaaatgtcagttttctggagttataaaaccataaaatatacaaggccactaatttttttcctttttctggtatatagtctttatttattgcaaaagatttctttgaaagttgatgctttttttcctgtagatttagtgtttatgttataaattgttacaattcaagtgtctggtgacactggaatcctagtcaggcttaagcttttgtgatactgcattttcagataaatatagctgtgtccttttgatgtctgcttgaaagcagcaggtattttttaagtagctaacatgattatacatggccacatatatgtttagctactgagaaaaaaagaagaatcttgcaaggaaagacataggaatatgggactcttggcccaaagaaagactcaaggaaaagttcagaaagtccagctgactgacttcttgtctatactcatagttaggattgggaaactgcaaaaggacagagccgagaaatggcctgcagtctcgctgcctggatttgcagcaatgtcgtgcctcagattttattatatttggttttcttagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttc

SEQ ID NO: 36368 - DNA, 2500 bp, Homo sapiens
acccctcgtggcggtcccgcccgtccccgcgcaggcgcgctcgggctgccgctggctcttcgcacgcggccatggccgactccgagctgcagctggttgagcagcggatccgcagcttccccgacttccccaccccaggcgtggtattcaggtgcacgcacaggccgccctcgtggcgccccgacctgcgggcctacggatgggagcgcgtggcccgcgacctccgggcgggcggggcgggaaccctcgtctttcgcccccggggccctgccctccttcggccccggcgtcaccaggcctgtccttgggtccagggacatctcgcccgtcctgaaggaccccgcctccttccgcgccgccatcggcctcctggcgcgacacctgaaggcgacccacgggggccgcatcgactacatcgcaggcgagtgcccagtggccgcatctagggcgcttccgcctctgcgcgcgccgagggcagcacgtgggctctgcgcgtctgcttgggggagggcctttggggtgcttcagggggcgccgggacgggcgccgtgcttgggtcgcccgggaagggttgtgagattgagcccccgaggccgccgcgctgtgcaggcgtccttcccgcaggttccgggtccccagcccaggacaggcgtgaccgagttgccgggtcagttggtctccctggagtgcccaagctgaatccacagggcccagctgccttgcttcttgttccttctgcgagctggtattgagcgcctgccacgagccaggccttccctggtgaagatcacggaatgcccacccagggaagggaggcctggaggcctccgggagagcccaagaggtggcccagggagaacagagtgttcctggccgtcttgcctctcctagggtgtgacagcccactccctggacactgccctgaggaaagcgccagctcttgctggagccacaacactgccagagctcccttctcacctcctgcaggaagccctccctgacctcctgccaggccggggcagggtttccctgagcgtcccccaaccatcacagctcaggccacctcgagagactccctttttagacagaagccctggtgcagagctgcctttgagagtaagctgaggcctgtcaggtttctaccagcccagttacagatgggctgctcagctcagagagaggggtggtgactcccctaggaacacacagctaagaagtggtcccttaaaagacagacccaggtctgcactctgacctggaagcagctccgggtaggtgatgggtaacattccttaaatggtgcatgtcactggcctttcagctgggagccaaccaggtaccccttgccaccggccaaccctggcccctggggattcccatgctgccgagtcactcctgtcacttaccctgacaggcctagactcccgaggcttcctctttggcccctccctggcccaggagcttggactgggctgcgtgctcatccgaaagcgggggaagctgccaggccccactctgtgggcctcctattccctggagtacgggaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggccgacaccttcctctccccatgccttcccctccccaacccaggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccac

SEQ ID NO: 36369 - DNA, 5539 bp, Homo sapiens
cgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctggtgagcgttcccacctgggatattgaggagtccgggggcgcggggggtggctcaggagaacggctggttcgtgccactctcactacctgattgggaaactgagggcagttgaggaggcgctgcctaagggagcagggcggggcgggccctggagcgtgcatgccattgactccctctcgcgcgctcccgcagcaccatcggttcgtggctgacagcaaagataaggaacccgaagtcgtcttcatcggggactccttggtccagctcatgcaccagtgcgaggtgagggcagtccctctccccctgccccatccagccctgtgtccatgctgacacatctggaccagaacccaggccaggtgaggtattatgagagtacccagattggcctcaggcagcccgaggctctgagaatcttggtgtaaggtgcaacattctattgagaaagaaatgtatgccttggttttatcagattggatttgtgtataatgtactaagacctaaaatgaggctttcctgccataggcttgcctaaagtgaggctctttcttgtttgctttaagtagtgcgcagccctgttgggtttacacaaagctatagtcactttacaggaagcgaagggcaactctaatggcactccacaaagaggactcaatcataataatatctttccacaaagcatgtccaactgtaatgggtttcatcaaaataagtttcaactgtaatgccattgattcaatgcatggctcaagcagactggattttcatgaagtgagtcttgcttctatggggcttggtttgttttgttggttggttggttggttggttggtttttgagacagggtcttgctctgtcacccaggctggcgtgcagtggtatgatctctgttcactgcaacctctgcctcctgggctcaagtgatcctcccaccttagtctccgagtagctgggactacaggtgcacatcaccatgcacctggctaatttttgtaatttttgtagagatggggttttgccctgttgcgcaggttggtcttgaactcctgggctcaagcagtccgcccacctcagcatgagcaacagagcctggggcttggtttaaagtgagagactctaggcagggtgtggtggcttacgcctgtaatcccagcactttgggaggccaaggcaggcggatgacctgaggccaggagttcgagaccaccctggccaacatggcgaaatcctgtctctactaaaaatacaaaaattagctgggcatggtggcacatgcctatagtcccagctacttggcaggctgaggcaggagaatcgccagaacctgggaagcagagattgcaatgagccgagatcgcactactgcactccagcctgggcaacaagagcaaaactccgtctcaaaaaataaataggctgggcaccatgggctcacgcctgtaatcccaccactttgggaggccgaggcaggtggatcacctgaggtcaggagttcgagaccagtctggcccacatggtgaaaccccatctctactaaaaatacaaaaaattagctggacgtggtggcgtacacctgtagtcccagctactcaggaggctgagacatgagaatcacttgaactagggaggcggaggttgcagtgagccgagatagtgccagtgcactccagcctgggtgacagagtgagactctgtctcaaaaataaaataactctgtctcaaaaatataaaataaaataaaataagtgagagactctaatagatttctataaagtgaggttcagccatgctggagtttgctccaggtaaaattttaagactgcttccatgaagtaaggttcttccataatggcatttggttaacacctggacagagggggatggtccatgcggacagtgcccttgtgcccctaccacttcttgcccacaccacttcttgcccacagatctggcgcgagctcttctctcctctgcatgcacttaactttggcattggtggtgacggcacacagcatgtactgtggcggctggagaatggggagctggaacacatccggcccaaggtgagcggggcttgggtggggctctaaaacatcttttggctgccccctcaccgctgcttcatgtctctttttccacagattgtggtggtctgggtgggcaccaacaaccacggacacacagcagagcaggtgactggtggcatcaaggccattgtgcaactggtgaatgagcgacagccccaggcccgggttgtggtgctggtgagaggctgggagagtgggaaaggaagaatggcagtggtctgggaccccctcagatatagccacagttggcacagttctaggcagcttgacatagagcagtggcttttaggcagaatctcacgttggagcttgctatacccttcagagtggctgtggttgagaatatgctccgagaccaattagccttttttgcccagggatggcttaagactttgggggtattgaaaaactaaaaaacgggccaggcacggtggctcacgcctgtaatcccagcactttgggagaccgaggcaggtggatcacgaggtcaggagatcaagaccatcctggctaacacggtgaaaccccatttctactaaaaatacaaaaaaaaattagccgggcgtggtggcgggcacctgtagtcccagctaacttggcaggctgaggcaggagaatggcatgaacctgggaggcggagcttgcagtaagctgatactgtgccactgcactccagcctgggcgacagagcgagactccgtctcaaaaaaaaaaaaattagttgggcatgggctgggcgcagtggctcatgcctgtaatcccagcactttgggaggccgaggcaagcagatcacctgaggtcgggagttcaagaccagcctgaccacacgtggagaaactccatctctactaaaaatacaaaattagctgggcgtggtggcacatgcctataatcccagctacttgggaggctaaggcaggagaatcgcttgaacccaggaggtggaggttggggtgagccaagattgcaccattgcactccagcctgggcaacaggagcgaaactctgtctcaaaaaaaaaaaaaagccgggtgcggtggctcacgcctgtaaacttgtaatcccagcactttgggaggctgaagagggtggatcacaaagtcaggagatcgagaccatcctggctaacaaggtgaaaccccgtttctactaaaaatacaaaaaattagccgggcgtggtggcaggcgtctgtagtcccagctacttgggaggctgaggcaggagaatggcatgaacccggggggcggagcttgcagtgagccgagattgtgccactgcactccagcctgggcaacagagcaagactccatctcaaaaaaaaaaagaattagctgggtatgatggtgcgcaaaacctgtaaccccagctacttgggaggctaaaggagaaggatcacttgagcccaggaattcaaggtaacagtgagctgtgatcatgctactgcactctcgcccgggtgacagagaccctgtctcaccagaaaacaaaagaaaaaccctcaaaaaaccttgaataggccaaaagttgtcaggcattcctggggtaaatctaggctccatcacttgtaggtagctaggatatttcctcttctgaaaacggattgatcccttggcatgagccatgatgttgatatcttttatttatttatttattttgggacagagtcttgctctgttgccaggccagagtgcagtgacgcaatctggcctcactgcaacctcctcctcctgggttcaagtgattctcctgcctcagccttcacagtagctgagactgcaggcgcgtgccaccacacctggctaatttttgtatttttagtagagatggcatttcaccatgttggccgggctggcctcaaactcctgacctcaagtgatccacccgtctcagcctcccaaagtgctgggattacaggcgtgagcaacctcccttggcctatttattttttgagacaggatctggctctgttgcccaggctggagtgcggtggcatgatctcagctcactgcaacttctgcttccagggctcaagtgattctcccacgtcagcctcccgagtagctgggactacaggcacacgccatcatgtcccactaatttttgtgtatttttgttagagatggggtttcaccatgttgcccaggttggtctcgaactcctgggctcaagcgacctatccagctctgcctcccatcatgctgggattacaggcgtgagccactgaacctagccaatgtcaacatttttctaagtgatacttggaaagaggctaggccgcgcatggtggctcacgcctgtaatcccagcactttgggaggccgaggcgggcggatcatgaagtcaggagatcgagaccatcctggctaacacggtgaaaccccgtctctaataaaaatacaaaaaattagccgggcatgatggtgggtgcccgtagtcccagctacttgggaggctgaggcaggagaatggcgtgaacctgggaggcggagcttgcagtgagtcgagatcgcgccactgcactccagtctgggcgacagagcaagactctgtctcaaaaaaaaaaaaaaaagaaaacgaaagagggtaaaacccagaagtctcttgctaaatgagggctaggatgtgatatttaggaactaccctcccaccctccccacttgcccatccctagtgttttctgcagctggaaacttcatggtggtgggtggaggacaggttggcacagagaacaagatactcaaatgcttgtttccttactacgcctcgtgttcctgctcagggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtg

SEQ ID NO: 36370 - DNA, 50848 bp, Homo sapiens
ccccgcgcggcgcgggccagggaagggccacccaggggtcccccacttcccgcttgggcgcccggacggcgaatggagcaggggcgcgcaggtaggatccggggcccgcgcgcggatcgggttgcgaaggtatcgcccgggcacgccggctgagggcgttcgggaagggctcggccgccggcggggaccacggggaccaccccgactccgagcggggcccgagcccgcgactctcggtgcgcgcggagcagcgcccggttccgtccttgccgccgaacggcagcggaggcgcgaggcccggggtacgtggacacccagcgctccccaaagccggtgctggcagtgagacctccgccgggacggcctgcgggggtggggggcttggggttaggctgtcggaggccacgcagcccctcttctccgggcagtggcgcccagccctgcgctcaggaagtcagtgaggacttcggagagagaaagggtggggaaagttctgagaactgtaaatttgagtagtaggtcagtgaatcggggcggtctccgcctccgaatatcagatggacccaataatcgcgatcattgactgggacttgttttactgaaaggatgccaagtgaaacctcccactaacttctctgtggccggtgctgtgcgtcatggacattgtacagatgaggtcaccaagaccccagccgctttagtaacttgccctaaggtgccgcccacttgggagtccgtggggcagcaggactagagcccaggcaatcccacgccagagccagctgctctccatctctcaatcacgtttgaggagcccccacaataaccagaatctccgggagatttgcttaaaatgcagattcccaggtccttgccctgagattcagattcagtaaacccaggaatctgatctttattttatttttaaaaatttattttataaagatggtgtctcactatgttgtccaggctggcctcaagtgatcctcccacctcggcctcccaaaatgctgggatgacaggtgtgagccactgagccctgattttttttttaaacaaaatctggatttcttagacttaagcaagataggggaccactagtttgtctgcttctggggttcaaggaatgcccccaggccagcgctaaccctgctccagttctagtctctccccttccccagccctctgggaggcatgacccactgcacttccctgcccccagtagcctatgaggagcccaaggcatttgctgggacctcagtgcctttatcaaaatcccaaagtccaatggggaaacaggctcaggtgtaggtttggccagggtgtcctgcacattagggcattccagggtcctgcaggggtttcttagaactcggctagcccagcccatgaatgggaggtgacctgctaagccactcattcactcactagcactcattcagctcctgcgaggccctgggtggtgttctgggcactggtgcttgcctcaaggagcaccccctctgcaggaagacagacgtgagggctgggagggtgcggatgcaccagcggctgcaggaccacaagccagaggggatcagctcttcaaaggtcactgggccaggcttcccagcacccagggaccctgagctagccttgtgagtagagcaggggagtctggcaggtagaggatgggaggtaaagggaggcacagagtgggcggaggctgggaagtgtgaaagggcactgtgtacagaacctagggagtaagcagaagccagagatggatggaaagttgggctgggctgcattgtggaaagccttgaatgccatgccaaggaacttgggccagtgtattcaccttggcttgagttgtaaaagcaacaatgcagattcctgggccccaccctgggcctctggatctgaatctggagggagacgctggggaggcagcagggaggaaaacctgcagtcactcaccccatttacaacacatgcagttaccggcaggtccgagataacctaagggtttccaaatgctaggaagtgactcaatgactgatatgtttaatacaatacaatcccggttgcaaaatgcccagggcaagggtgggggtgttcagttttctaatgctcccagttcaaaaaggagctgaaatgaattgtcaaagaagtgacaagctgggcgcagtgactcacacctgtaatcccagcactttgggaggctgagagaggatcgcttgaacccaggagtttgagaccagcctgggcaacatagtgagatcctgttcctacaaaaaaaatttaaaaacttagccaggcgtggtagcaggtgcctctagccccagctatttgggaggctgaggtgggaggatggcttgagcccaggtggtcaaggctgcagtgaactatgattgtgccactgcactgtagcctgggtgacagagcgagactctgtctcaaaataaacaaatacataaatacatgagaagagagaaccttttctacctcccccatctccctgccctcttccacccaccccatctgggacgatggaggagagcgtttgggattagatgccccacctctcgactgccctcactggtacctgggagtgaggccaggacagaagccgcctaagtactgttcttcctcacatttgtaaaagtgaactttcttgagggttgatgacatgttttataagctacttcacacaatgtccaacacccagtgggtccacaatcaatgtatatgtctgttgttacctgtcaaaacgtatagctggggagtgacagtatggacttgagccagatcacccagtgcaaatgctggctttgctgcttactgtgtaactgacttcccagagcctcagtttctgcatttatgagattatagtgactatgccattgtagtgatgactaaatgagttaatatatgtcaagcatacaaaacagtacctggtatgtagtacaaactatgtatttgttaaatgaataccttttttttttttttagagccatggtctctctctatttcccaggctggagcacagtggcacaatcatagctcactgtagcatccaatacctgggttcaagtaatccttccacctcagcctcctgagtagctgggactacaggtgtgtgccaccacggctggctaattgtttttatatttttagagacaggatcttgctatgttgcctaggctagtcttgaactgctggtctcaagcagtcctcctgcctcagcctcctaaagtgttggatttatagatgcgagcaaacgtgcctggcctaaatgaataaatctttactgttgcctcctttgagctttattggttgggatttagtccactcattttgcaggtgagaactgagacccggagatgaatgcagtagccttgcctcaggtccacatctgagggacagactccatcctacttttcttcccatgtattctttcctgcttgtaccagttcactggggtgaccaagaaagacatttctgagttttcctcctggctggcacagtggagacatgcccagccacgtttagctagacttaccatggctgggctagaagagaggccaggagcttgtctggaggttgcacagacctgcccttggtgaatgtggatcggagcgccccggcagaggcttgaggtgctacagaggctgggggatccactgtcagaccgggtgcatcaccactgttttatgatatccagcaaattgctctgcgtctctgagcttaaggcagagagaagggcctgagcttgaagaggggatcccaggtttaaatcggagctggctacttcccagctctccactgtgtaatctggaggaagttgtttaacctctctgagcctccctttgttttgtcatgggtgtttgcagggagagcattcatgagatagtttgtatagacattttgcccttggaaggcgctcagtgattgctgtttttctctgcattttggaccgagtcccttctgcgtatccagcacctggcttcctcctgcatttcttcctcaggaatttattgagcacctatatgtgccagagcatcggaccaagtcctttgctctcctggggtttagattctagttgagcatacaggcaatgtacaaccaatacatatgttcagatcggcagctttatctgttattctgaaatccacgatttctgaaaaccgaaagtttttcataactcattttgaagctaaacttgaggctttttagagtcttcatcctcttcggtgtgatgctcagatgtctttctgcagagatattagtgcaattgatctttgggtgctttcccgccctgcatgatgggcatgtcggtgggtattttatacaaggtgacctttctacagcctgagtcatcctgaattctgaactatgtctggcccccaggattttacaggagagaacatggacctgcaatatcctatcaggtggagactgtgctaggaaggaaagcaaagctgggtgcaagtggaatcagggagggcttccctgaggaggtgacatttgagagggatgaggaagagagggccaggtggagggactcacagaggacggaagactccacttcctgactggcctgtgcttacccctcattctgcatgcacagttctgtctaaatgcgtccgttcttgcctttccaagaagtgctgatgtctcttacgtttcaagtctagctctgactgactcattctctctttaggtgcccccacaggcctcctcacctcttctcgtttgcttaagaaatctgaggtctgcgctaaagccagcctgggtgctgtaacctctcggccgaggatggtgcccagctgggcttgcatctggagttggaggaagtgggtcccgggaggggaagaggagccgtggggccttccaagggtttggtggaattgagttcctggtggggaggggctgtgttctgggtcttagagcctctcgcctgcaaagcaaagttgaacgtaacacgcgctcacatatctcgagtgccagcccggggctaggtgcttaacgcttgcttagccaaagtgccaggggctggggacacgggaatgagtgacccagaaatgagggccctcatggagctgaaagcattctgggcttggtgactttgaggaagtggcttttgaactgagacctgaaataccaaggcatgtggatatctggggaaagagtgatcctggcagtgggaacagagagtgcaaaggcccagaggcatgaatgagcttggtgtgtttgacccacagcaaggaagctggtgtggttggatggaaccaaacaagaaagaggtctaggagcagaggtcagggagggagctggggccagatacctgcattgtctcatttaacttgtgtaataaccctaccagataggagctactctcatgcaaatgttacagatgaagtaacagaggcacagagaggttcagtgacttgtccagggtcacacacctgaaggtggcagagcagggctgtgaacctagaagctccagagtcctcagtcctcaccatggtgtttaaacacaataaaatctatgcctgagtgctgaagacacacctgccatttagatcgatccacttttttacattgtcggtgtactccctgccatccatctgcccagaaatactgtgaatgtgggcagcgcaggactggttcctccaagccccattttacagacagtccaatcattttacatattattttatgaatgagcaccttcctcagtgtctcagaccaggggtccccacacagcagggccacacagcaggaggtgagtggcgggtgagtgagcgaagttttatctgtatttacagctgctccccatcgctcgcattaccacccaagctcggccacctgtcaggtcagctgaggcattagatgattctcacaggagcacaaacccttttgtgaactgcacatgtgagggatctgggttgcgtactttttcttttttttttaagacggagtttcgctcttgtcgcccagactggagtgcaatggtgcgatcttggctcactgcaatctccacctccccatgttcaagtgattctcctgcctcagcctggtggctgggattacaggcctgtgctatcacacccagctaatttttgtatttttagtagagacagggtttcactgtgttggccaggctggtgtcgaactcctggcctcaggtgatccacctgcctcagtctcccaaagtgctgggattacaggcatgagccactgcacgcggccctgggtgcgtgcttcttatgagactctaatgcctgatgatctgtcactgtctcccatcgcccttggatgggaccatctaattgcaggaaaataagctcagggctcccactgattctgcattatggtgagttgtataattatttcattatatgttaccatataataataatagaaataaagtacgtaatacatgtaatgtgcttgaatcatcccgaagccatggccccaaccacggcctctggcagtggaggctggagtccacatcacgctctgtgctgggtgcaggaatggagatgagtgggtgtcctgctcatttccctgaggaggaacctgaggctcaggctagagacttacctgggtgacacggctcctaagtggcagagtccagattcaaacccagggctacagacccagaagcctgtgcatttaaccacggttctgagctatccagcccaaagaggagagtttaaaaggattacatttcttcgttggaaatcagtgagcatagtcgcccagaaccatttttgaaaaactcagagaaggcctatgttttcctgaagcggccagggaagtattctgcctttttaaaagggaagactgaattctagggaggagaggcaccagctctctgggctgggcaggtctccaagctggcagggccacagcctcccgacggtcttgcctctagcatatttcttccagaagccacatttccacaggtgggcagctctaactgggagaaaatcttcctgagatttagccaaattagctttctttctttctttttttttttttgagatggagtctcactctgctgcccaggctggagtgcagtggcgcaatctcagctcactgcaatctctgcctcccgggttcaagtgattctcctgcctcaacctcccgagtagctgggatttcaggcacacaccaccacgcctggctaatttttgtatttttattagcaatggggtttcaccatgctggccagactggtctcaaactcctgacctagggtgatccgcccacctcagcctcccaaagtgctggtattacaggtgtgagccaccgtgcccagcccaaattagctttctaggagcttccactttctgagtctgtttctgcctcttggaggtagtgaccatctccctccaaactcggatacttctcttattcagactacacaactgtagttatttcaggtattctccctgactcaggaaattataagtttggcctgccttggcacatgagtcaactggttggagtcccacgcaaagactgtttgtttggtcaaagaggaaggagactattacctccttggatctagagcttatacttctgttgatgcaacctggaatcatactgtgtagcagccatatcccacttggagtgcatattgggcttgtcagctaaaatctccatgtttctcttctatatgagctgctgttaatccaagtttcttctattctgagagtccttgtctaaagctaagaggttccagtttttcatgctctctaataaatctacttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatttggtcatcatggttgttgtggtcaatatatgtggttcctataatatcagtggtagagaatttgctgagatctttataggattttctggtcatttttttcctcttgtgtttgaaaagaatgtatattttctgttgggtataaggttctagaaatgtatctatttgatcaagctagctattatattatctatatttgttatgtcactatgtggtttttttttttttacctgatttacctcccaccgtaatacaattacaattcaccataatagaggctttgttaagttctccttttgagtctgtcagttttttgctttatttttgaagctatgttgttaagtgcatagccatatgagtagaataagggttcaggatttttatacctttttggtgaattgttgcattttcccgagtagctgggactacagatgtgcactaccacgcctagctgatgtttgtgttttttgtagagatgggatttcgctatgtttcccgggccagtctcaaactcctaggttcaagcagtctgcccacctcagcctcccaaagtgctgggattacaggcatgagccaccgcagctggctgaattgttcctttaatcagtataaaagagccaacttccagcctgggcagcatagtgagaccccatctctaccaaaaactaaaaattagctgggtgtggtggcgtgcacctgtagttccagctacttgggagggcgaggtgggagaatcacttgagaccaggaattcaaggccgcagtgagctatgattgctccactgcactccagtctaggtgacagagtgagacattctcaaaaaaacaaaaacaaaaaaaccatccaccttctctcttctaatacttactcaagacatcattgtcatgaattctattttattgatgtcagtactcctgtactaataagccagatgagttaaaaacaacagcagccttgcaaccagccatgaagcaagtgatcttattctcatttcacagatgaggagactgaggctctgagtggactccagcctgccacggtctcccaccgagtcaggttggagcctgcacttaggcccagagttatgcttctgtgtctcagatgcttgggggtccctgcccacaaaggtggcccccatgtctgtgtgtccccacccatccaggaatggtatggggtgagacaacaggaagagctccatgggtagtccccacccactgccttccatatgccagtctgcaagcagaaaatgaacgggaagctcttacctgtgcccatgtgttgtcctggctttgggtttgcccagggggcaaagtcctggtcattgttgagacaagttcactgctgctgagggccgagcaaatggtgacaaaggccagattctaaattcctacctggttacttcctgctccgtcaccatcacctcgggcaaattctgaacctccctcagcctcattcctccatctgtgcttgcagggagaatattttactgtatcttccatagtgagctttccaggagaagcaaaaaagagtggtgtataaaaaagcaagtttatgactgcttctgtgccaggcactgtgctgtgcactccagagccaaaggcctgggttcaaatcccagcccactcactagctgtgcatccttaggcaggttcctgaccctctctgggcctcggcttctccatctctgcaatggagatgatattaattgtatctgcaatgctccttggattgggtccatggttaagtgagtgagtgaggctcaagggcttctttttttttttttagagatagggtctcactctgttgcccaggctggagtgcagtggcatgatcacagttcactgcagctgcgacctcgtgggctcaagccatcctcctgcctcatctcccttagtagctgggactacaggcatgtgccaccatgcctggcaatttttttttgtatttttggtagagacggggtcttgccatgttacccaggctggtcttgaactcctggactcaagtgatctacctgcctcagcctcccaaatggctgtgattacaggtaggagccaccgcgcccagccttcaagtgcttttttttgttagtgagactggtacaaccaatgccaaggctggtgagcaaagttgcacccagttggggaggggcgaaaccaagggcagaagggcccagggcatggcctctcatggctgaaggaagaggggacacgtggccagtcacagtgacctctgcagacctcaagaaggaggccagctaggagccatagctgtcactaagacagtcaaaatctaatcagcaccctggcgccaagaggccattgtccgctgctcaggacagtgagtgatagtcgataaccagctctctggaggtcagggccccgaggtggctgagatctgtgcctgcattaggacatttaaggggactccaagccaggatttgctagtgtttgcccagcagggagaggtggaaaattggggatgaccaaccaggcctccctgctcacagccaggggaattcatcctgtcgttcttccattcagcaaatattcatggagcacctgctgtgtgccaggcaccgtgctaggctctggggagatggctgtgagcgggatcgacactggccttgtgtgagctggccttgcagtaggggatatgagcaccaaacacataaggcccgagtgtgcaatatgccacaaagattgcagagaaataaagcaagataacaggttgcagaaagatggaggccaggctggctgctgttcctgggtaggtggcttctggacacagtttcctcaggctctgtttcctcctttgggcctctggaatcttctgaagacaggcctggcttccaggatcccggatggagttgcctgttgactgtgtggactcaaagtgtccacagtgcgccggagcgcgtggtcttccccagcaaatctgcttctcttctcggctctccatcgtgggaagggtccctgggatcctccccaccaccccagcctgaggccactttccctctgtccccgctctccccagcctgctttccccaccaagcgccaccaagtccctgctgcctcctcctcccaaacaggctcaaacctgccccctcttcgccagctctcagctcagcccgctcctctcctgcttaagagccttcactggctccccactgccctagagacagagtttgagtctactgccatggcttggcagacggtgttgtccccggcctgccaaccttccagctgccatcccagccagtccttctcccccttgctccagccaagggccccgcttgtagggtgggaagtgggccgtgccctccctcctgcctgcctattcgctgggtcttccctcattccctccctcaccccgccctctcataagaaccttcagaatctgccagacgcagtggctcacgcctgtaatcccagcactttgggaggctgaggtgggtggatcacctgaggtcaggagtttgagaccagcttggccaacatggcaaaaccctgtgtctgctaaaaatacaaaaaaattagctgggcgttgttgtgggcacctgtagtcccagctactcgggagactgaggcaggagaactacttgaacctgggagacagaggttgcagtgaactgagatcccaccattgcactccagcctggactacacagtgagactctgtctcaaaaaaaaaaaaagaaccttcagaatcataaaatgggtttaataattatacttatctcatagggagggcttaaagcacctaggccagtgtctggcaccaaggaaacactgtatacctgttaaaataagaataaaataaaatacacatgctcacttattgagtgcctgctgtatgtcgggcccctccccgagagaactctggtgcatccccgataaagaaacctgaccctctaggatgagggagggtcttccctgagcgcctgctaacagcctcctctgctaatctgaagtcctgcagcttgcccagcaggctggcttgtcacacgggctacccccacaggccgccatcttggaaaaggccaatggctgtggaatcattcttgactcctattagccttcctgttctctctcccgccccacagcatccatcctgtcagcaaatcctgtgggctctgtcttcaacacagatctagaattcagccccttctcaacctccccatctccgcagcctggtgtgagccctggcacctctctctggggccagtgtggtagcctcctcactgctacccacttctacccgtgcccccaccacccaagcaagagaggtcttttttaaagtctcatcatgtcacttctttgctcaaaacgctctggcaacttcttccttgctcaaatatttgttaaaagaagaaaggaatgaatgaatgaatggcctgtttgcatctgtaatagccagcacataggcagtacttggaaaacacccacagcaagaataaatgaggagatggctggacacggcagctcatgcctgtagcatgttggaaggccgaggcaggaggtttgcttgaggccaggagtttgaggttgcagtgagctatgattgtgccatagcactccagcttgggccacagagagagatccccatctctacaaaaatttaaaaattattcgagcatggtggtgtgtgcctgtagtcacaactacttgggaggctaaggcaggaggatcacttgagcccaggagttcaaggctgcactgagccgtgacggtgcgactgcattctagccacagaatgagaccctgtctctaaagcaaaaaagagaaggagaataagtgaggtacttgagcaagtgggtgaggatggttgagccacagcaggcccacagggaggctggtgggtgctgttggtggagggggccgatttgtgttcctggtggctgcagagccagtctgttgcctcccctccctcccactggctgggctggggacggagccaaccaggcagatcccgggccattctggggccctggcctggcctgccttactatcccagtggggccaccgacgtggctgccatttctggaaaccccagttctaggtaggttactgtcccaggaagaagtgcatgcctagcttcctgccagcccagcccagctgtcccagaagccagaggaagctctgggctggtttcttataagtagcatgactaactgattgcgccacaggagctgaggtttcaggccagtttctgtcgtggagtttcaggggtcagcggctccaaagccccagcccccacccgaggcccctgctgtccctggattcctctccacatgccacctgtcacagaggtgcttgcatcctgtctgcagaaccagcccctcctccaagccaggtttcctgcccagagggaagaagagcagaaggcctgtaccgccccctgtgcgcccccagtcctccgccccctgcccccctgccacccgctgtgggttcgggaagagtcctgctgggtcgcttccaggctgctgctggcttctgacatttcaaggcttaatcacttaatctcccccgagttttttaaaaaaagtgagtcaagtgtgttctcctggtggcgggcgtgttttcccaggcccatgcttctgctcatttcctggctgcggccttcactgactttgctgcttcctaactctgtgaccttggccttgtcacttgctgtctctgggtctcaggccaatgggtctcaggccagtggggctccccggacaaagttccagggttttggggactgcatttcaagggtcagcaaccacagtccttaaacacgtggattttggagtgacaatgcctaggttatggttctgtgaccaccagcaagtgctctagcctttttgtgcctcagtcttctcatcagtaaaatgggaatgttaatggcacctacctcatagggtcgttgggagaaccaaattgattaatatattgtaagtacttagaacagggccaggcacaaaataagtactgcatatacagttaactatggacaaaagcttgggacctggttcatgtttaaaaatgattattgaggccaggtgcggtagctcatgcctgtaatcccagcactatgggaggctgaggcaggcggatcaggaggtcaagagatcgagaccatcctggccaacatggtgaaatcccgtttctactaaaaatacaaaaattagccaggtgtgatggcgtgctcctgtagtcccagctactcaggaggctgaggcaggagaatcacttgaacccacgcggaggttgcagtgagctgatatcgtgccactgcactccagactggtgacaaagctaggctccatctcaaaaaaaaaaaaaaaaaagattgttgaatttattattgctgaatttttttttttttgagacagaactttgctctattgcccgggctggagtgcaatggtgtgatctcaactcattgcagcctctgcctcttgggttcaagcgattctcctgcctcagcctctcagcctcccgagtagctgggaatacaggcacccaccatcatgcccggctaatttttgtatttttgtagagatgtggtttcaccatgttggtgaactcctgacctcaggtgatccacctgcctcggcctcccaaagtgctgggattacaggcgtgagccactgtgcccagcctattattgctgacttttaaaccattcattcatttaatatatgtttattgtacacatgctatgcctgtgtcaggcactgtttcaggcactggggataaagcagtgagcacagcagacataaagctctgccctcatggggcttgtggtctctcagagggaggcaaacaatgcatttatagacaaatacataatttaaatttgaggttacctattatactcccaacttgaaaaactagcagtatattgaggtggctatttcacatctgatggaggaatatgtcttttgtgaaccatttatgttctttgcctatttttcttaaagggatgtttgtcttattgatttgtaagaactcttcatatattaaggccattaaccgttcataatgtagattgctacctttttctagtcttttgcttgctgatatagttgggatgtcatcctctctaaatctcttgttgaaatgtgatccccagtgttggaggtgggtcctggtgggagatgttgggtcatggggacgggtccctcatggtttggttctgtccttgccatagtgagtgagttctcacaagatctggttgtttagaagtgtgcggcacctccctcctctctcttgccctggctgtcaccatgtacgcctgctcccctcttgccttccccgtgaataaaagctccctgaggcctccccagaagccaagtagatacgggtgctatgcttcctgtacagcctgcagagccataagccaattaaacctcttttctttgtaaattactcagtctcagatatttctttatagcaatgcaaaaatggactaacacacttgagttctgtctttttcttatggcatattttaatctaggccagacacagtggctcatgcctgtaatcccagcactttggaggccaaggcgggtggatcacttgaggtcaggagtttaagaccagcctggccaacatggggaaaccctgtctctactaaaaacacaaaaaattagttgggtgtggtggcacacacctgtaattccagctactcgagaggctgagacacaagaatcgcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgattagagatagtgataagtactgggacagacataaacagggtgctgtgataagaagtcacagggagggcccgcattagttgaggggggtcagagaaggcttctgaagtgtttctggtgcaaatgcttggaaaagggagagctgggagtgtatcccagggctgaggccaatggaggattgcagaagagggagaggggataggaggggaatgttagagggataagcaggggaattggctcttttcttcattttcttaaattaaactttttattttcagataattaaagatttacacacagctggaagaaatcatagagaagccgggcgtggtggctcatgcctataatcccagcacttttggaggctgaggcgggcagatcacttgagatcaggagttcgagaccagcctggtcagtatgatgaaaccccatctctactaaaaatacaaaaattagttgggcatggtggcttgcctgtagtcccagctactggggaggctgaggcaggagaatcacttgagcctaggaggtagaggttgcagtgagccgagatcacaccactgcactccagcctgggcaacagagtgagactccatctcaaaaaaaaaaaaaagaaaagaaaaagaaaaagaaatcacagagagacccctgcttctatgctgttccccccgagggcaagattgtagaaatctgtaatacagtatcacagctgggatactgacactgatataagctactgaccttattgggatttcccgatttacttgtactcatttttgtgtttgcgtacgcatgtgtggtttagtgctatgcaattttatcacggcataggtttgtgtatgcagccaggatccagcacagttctatcatcacaaggatggctcaaattctccttttatagccacatccaactcccttcctgacccaccccctcagcccctggcacccactgatgtgttttccatttccatggttatgtgatttcaagtatgttacataaatggagtcacggggtgtgtactctgggaactggcttttttcactctagggcttggattttattctaagtcagagatgcttctctaatgagctgtgaaccccctggggatctgtggcccctgtgaagaagccctttaggagccagggggcattggatgtgtgagctggccctggtctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggattctgtgaacccctaaaatggaatgcagaattaagtgtatgcaccttgccagaaacagggtttggggtttacattagatgctcagataggtcattgatccccaaaacactaaggtctctgacttctagacagatagtagttaagaaccaaagctttggagcttgagtgctggatttaagacccatgactgtcacagctgtgcaacctcagacaaatcactcagcctttctgtgccttggtttcctcatctgaaaatggagaaaataatattacctatttcatagattattaaatgcattcttgtatgtaaaagatgtaaaagaaaacttggcatgtggtaaactctgtgtgtttaagtgaatggtgaggctgcccagtataggagggcagagctttccaggtaaagactttctaggcctcctgggattatcaggccctctctgtgttggttgttgtcatacatgacagcagtattccttccaaagggatgccaagttgtggttgcacactgcacttagatccagttgattgacagcactgttcaagtcaactgtgtccttactgatttctgcctgctggatctgtcgattaccaaaagagttgaagtaatagtaataatactattattatccaataatagtattattcagaataatcacacagatttctctatttctccttgctgctctcagtttttgccttacatattttgaccctttgttgttagttgcctacacattaaggattgttatttacatcttcttggagaattaactcccgaatcattatatagtgccacttttttttaatttaaaaattttattttttattttttgagacaggatctttctctgttgcccaggctggagttcagtggcatgaacacagcccactgcagccttaacctcctgggctcaagtgatcctcctgcctcagccttcccagtagctggggctacaggcatgtgccacctctaataacttttctttaatttacaatagtattagtttgttctcatgctgctctaaggacatgcccaagactgggtaatttataaaggaaagaggtttgactcacagttctgcagggctggggaggcttcaggaaacatattatcatggcggaaagggaagcaaagacatcctttttcacatgacgtcaggaaggagacacgccaaggaaagggggggaaagccctttataaaaccatcagatctcaggagaactcactcactgtcacgaaaacagcatgggggaactgctcccgtaatctaatcacctcccatgaggtccttcccccaacacgtggggattacaattcatattacaattcaaggtgagatttgggtggggacacagagccaggccatatcacattattattaattagtgccttctctctcatttttttgattcgcctaggtagagatttatcaatttcattgatcttttcgaagaaccaatttttgatttcattgattttcctcgattaattttctatttttaatttcattgatgtatgctccaattttgtatttttttcttctgcttgttttagacatatattgcttttctgtttctagtactctagatggaaacagattattgattttagaactttctttctaagatatacattcaataatataaatttccctctaagcactgcttttgctacgtctcaccgattttgataggctatattttcatttttatttagttaaaaatatttttagtttctcttgtgatttcttctttgatccatatgttattcggaagtgtgtttttaaatctccaaatacttggaaattttctggctttcttcctgctagtgacttctaatttgaatccattgtggcctaagagcatatgttgtgtgatttctaatgttttcaatctcttaaggttgttttatgtcccagaatgtggtctgtcttggtgattattccacatgaacctgaggagaatgtatattctgctgttgtgagatgtaacagtctataaatggatacctctgttaatatgacctcgggtgactctttttttttttttaagttgctgcttcaccattggcttttggagattttgcagatgataaaatcctcaggacttttctgctgctcagtcagattttcttatcctacacttgcggaactgttgtttgaaattgacaagcaggatggccaactctgcccggctcattttatttcatcttattgggttcagcctgcagttttaggagatgagattgaaggaactggtatactggaatccacggtgggctcggaagcaaacaaacgtgggttctgattctagctctgaccttttaccagctgtgggacctggtggatgggttatttggcctctctggcctcagtttccttagctagacagttgggataacagcctacctttcaggattcttgtgtggattcggtgaggtaatacttctaaagcacctagcaaagtgtcaagtacaaggtaagtgctgggcaagcagggattttgttcacacaaagccttgactcaacataaggaggctgtttccaatggctctgcttaactgagacctgagagtgattgctccatctgtggtggcatatgggctgaaactgcctagcagcatgtcagaagtggggtgttcgcaggacatccttgtccaggttggcagttgagcttggcaggtgaccgctgagaccccttccaactccaccacttcaggaatctcttttttttttttctgagacagtcttgctctgtcacccaggctggagtgcagtggctcaatcttggctcactgcaagctccgcctcccgggttcaagccattctcctgcctcagcctcctgagtagctgggactacaggcacccgccaccacgcccagctaattttttgtatttttagtagagactgagtttcaccatgttagccaggatggtctcgatctcctgacctcatgatctgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttgtgagagtaaaagttactaggacttgccaaggaaatcagtgtcaggaacccaccaccccattcccgcccctcctttacttgagactttacttttgtaactctcagcaaggaagacgagttcaacctttgagccgatacagagccttcccctagagagagctttgcagcctcatgctgagccagttaggggccccacatcatgtccaaaatgaatttaatcaacaaacagttactgaacacgtcctatgtgccaggcaccgttgtagatactggggactcggcagtgaatgggacagaccctggctgtcaggatgacagacaatttaaaaagggacagatgtcccacgctggcttgtcctttgcacccctggcacttcgtgaggagcagcggccagttcttgtatatagactggcccttggtgtacatttgtctgacgtttccaaatgatgtatgcatccttggcaggaacccaggaaaagacatgctgtgctcttctcaggaattgtttcagggaggtgatgttggggatttgtcccattcttgttggtgagtttagatcacttggtgaaggtggtgtctgccaggtttctgtattgtaacgttcattgatatgtattttcactcattagttaatatacaatacaagttttgcagggagttactttgaggctgtcatagtaaaatagagctttcccttcttccctgtttatttatttattagagatgaagtctgactctgttgcccaggctggagtgcggtggtgcgatcatagctcactgcagcctccaactcccaggctcaagccatcctcctgcctcagcctcccaagaagttgggattacaggcacacaccacactgcacccggcctcctccatttattgatctatgtcaatacagactcctggactttaactccaagggttacaagtggataccataatattcattttgatgctcaaaatgtgcctgttttgtccaggtcaggctagctgctgagtacttccttattgtctggcacaagaattccaagcctatctggtacttttccttctcctggaatcagctatttctctaaggcgctctggttcctttcagtacagaatagtatttagaagccaagacctggtcactaggaaggcatgataatcaaatgtgatgaatgatcttggattgcatcctggacgtataaagggcattattgaggcaattagcaaaacataaataggggccgtggatgagatagtggtgatgcatcactgttaatttcctgatttcgatggttgtattgtgattatgcagagaatgtccttgtttttctgacatgcacactgaggtattggggtaatttattcattatggagatatgtgagtgtgtttatgtgtctcatacacagatgtttcttaatgatggggttttgtccccataaactcatcataagttgaaaatattattaagtcagaaatgtacttcatactcctaacctactgaacgttatagcttaacttagctcggaacacttgcattagcctacagttgggcaaagtcatctaacacaaagcctgttttgttataaagtgttgaatagcttgtgtagtttatggaatactgagagtgaaaaacagaatggtcgtatgggtgctccaagtactgcttctactgaacacccattgattttgcaccatcataaattaggggaagagaggaaaagcacgcgtaagggaggaagggccgggtacagtggctcacgcctgtaatcccagcactttgggagaccaaggtgggcagatcgcttgaactcaggagttcgagaccagcctgggcaacataatgagaccccatctctatcaaaaatacaaacacttagccaggcctcatggtgcacatctgtggtcccagctactcaggaggctgaggtgggaagattgcttgagcccgggaggtggaggttgcagggagtcgaggttgtgccactacactctagcttgggtaacagagtaaactctgtctcaaaaaaaaaaaaaaaaaaaaggaaagggaggaagggaaggtccctccaggtggaggggacagagagagaaaaggcatggaggtgggactgagtttggtgtgtttaagaagtgcaggtggcagccgggctcagtggctcacgcctgtaatcccagcactttgggaggctgaggcaggcggatcacctggggtcgggagttcaagaccagcctgaccagcatggagaaaccctgtctctactaaaaatacaaaattagttgggtgtgtggcccatgcctgtaatcccagctactcagaaggctgaggcaggagaatcgcttgaacctgggaggcggaggttgcagtgagccgagatcgcgccattgcactccagcctgggcaacaagagtgaaactctgtctcaaaaaaataaaatgaaataaaataaaataaaatgttaaaaaacaaaaaagaagaagtgtaggtggcaggcgtaggatgcatgggtgctgggcccaggtggagagggaggtggagccctgctggggggagggccttcaagtgtgcccaagtcactcggagagcatccagcaggggcctagagctcctgaggtggccttaagttcttatgatgccccagacactgcacacagtgcttcagaggcaacacctccgttcctgtttgctgcaagcctgtgaggttagccttggaaccattcctgtgccacagaaacacagccagagcaccaaaagagaaatgctgttaatggcaaagaactactcactagcagaacaaagcctgggagctgcttttttgaataagatcccaggagagagacccaagcgggaagtgaaggatgggcacttgaaatgttgcagggaatataacccagcgcgtgctgttttctttttttctttttcttttttttttttttctctttttgcaacagggtctcactgtgtcgcccagcctagagtgcagtggtgccatctcggctcaccacaacctccacctcctaggctcaagcgattttcctgcctcagcctcctgagtagctgggactacaggcacgcgccactaccgcccggctaatttttttttgtatttttggtagagacaggtttcaccatgttggccaggctggttgtgaactcctaaagtgctgggattacagatgtgagccaccacgcccggccccagtacacactttttggagggtatttgacgttatgtaccaggagtgctggggaaaagtacacacttgactccgtgagattctgcttcttagcatttttttcttttcctttttttttttttttgagacagagtctcactctgtcacccaggctggagtgcaatggcatggtctcggctcgctgcaacctccgcctcctgggttcaagcaattctcccacctcggcctcccgtgtagctgggactacaggtgtgcgccaccacacttggctaatttttgtatttttagtagagacagggtttcactatgttggccaggctggtctcaaactcctgacctcgtgatccgcccacctcagcctcccaaactttctgttttcttttcttttcttttttttttatgacagggtcttgctggagtgcagtggtacggtcttggcttactgcagccttgacatcccaggctcaaacgatcttcccacctcaacctcccaagtagctaggattacaggcatgcaccaccgtgcctggctgattttgtttaatttttgtagagataaggtctcactctgttgcccaggctggtcttgaactcctgggctcaagccatcctccctccttagcctcccaaagtgctgggattacaggtgtgagccaccacacctggcttctgaacatttttttcttaatgataatagctggtgctatgggctgaatgtgttcccccaaattcatatgttgaaacttcatcccattgtagtcatattaagagatggggcctttggagaagtgattaagtcatgagggctctgtggttggtcatgaatggggttagtgccctcatgaacgggctgaaggaagtgtgtttgccccttctgtcatatgaagacacagcagcatggcatcgtccgtgaggaatgggctctcaccagatctggatctcctagtgtcgtgatcttggacttcccagtctccagaactatgcattagaaaatttatttatttattatttatttattttgagatggagtcttgctcttgtcgcccaggctggagtacaatgacgcgatctcgactcactgcaacctctgcctaccccagttcaagcgattctcctgcctcagcctccagagtagctggaattacaggtgcccgccaccacactcggctagtttttgtatttttagtacagacggggtttctccatgttggccaggctgatctcgaactcctgacctcaggtgatccacccaccttggctccccaaagtgctggaaatacaggtgtgagctactgtgtctggcctgaataataaaatttaaaacaatttttcaaaaattcaccatgaggtctcactatattccctaggctggtctcaaacccctggactccaagtgatccaccccaccttcccgagtagctgggactagagatgcacaccattgcacccaatagagcaatacgtttctgttctttgtaaattacctgctctaaggtatttttgttatagcagcctatatggactaagctgacttgtaacgttacttgagactttaaagtgttccggtcactgttggagggctctgtctgtgttagctcatttaatccccacaacacctcaatcagatggggctattcttagtcccactttatagataaggaaactgaggcatggaagcacagcttgctcaaggttcacatctagtcagtgacagagcaggtatttaaacctcaggaaataatcagagaaacatgtgtagagggttgtccaaggaaggccacatccagaagcatctcccaggacagttgttgtgtagctcaccctctggactttgtgggtctgggtgttgtttcatgattatagagagagctctgtgaacgtggaggacctgttgtcggcagagacacaaatggccagggcatggctgggcagccgcagtggctcaggcctgtaatcccagcacttcgagaagaccagaggggcagatcatgaggtcagaagttcaagaccagcctggccaacatggtgaaaccccgtctctactaaaaatacaaaaattagccaggtgtggtggtgggcacctgtaatcccagctactcgggaggctgaggcagaagaatcgcttgaacccgggaggtggaggttgcagtgagctgagattgcaccactgcactccagccttggagacagagcgagactctgtctcggaaaaacaaacaaacaagcaaacaaacaaacaaataaatggccagggcaggggagggttgcatattgaataagatgagctctgctggaagcacaggtcagcactaacctgcttcctctctctctgcaggtgccttggcatctcccaatggggtggctttgctctgggctcctgttccctgtgagctgcctggtcctgctgcaggtggcaagctctggtaagtcaccacttctcaatcattcatttgttggctattaatggcgtgccagggtcctgcagtatgtcacctggccttatggagattacactgcagtgggaggggacagccaatgacaagtggccctgattatcagtaaattctaaagattgttagaaagtgatgggagccgggtgcagtggctcacacctgtaatcccagcacttcaggaggccgaggcaggaggatcgcttgagcccaggagttcgaggtcagcttgggcaacatagggagaccttgtctctacaaataataaaatattagccaggtgtggcagtgcacgcctgtagccccagctactcaggaggccgaggtgggaggatcccttgaactcaggaggtcaaggctgcagtgaactgtgatcgcgccactccactccagcctgcgtgagaaagtgagaccctgtcaaaaaaaaagagaaggtgatggggaaagaacacagaacagcataagagggggttggggaagctgggtggagtgggggggattgcagttgaaagtagggaagtcagggaaggcctcattgagctgacttggaggaagcgggaaccgtgcagatgtctggggaaggctcattcttggcagagaggccctgcactgagcctggcgggagggttgagcacaggagggaatgtggtggaggagagtgagcagcaggagggagcagtgaaggtcagcaaggtgacagagtggctgaatcaaaaaagaccttgcagtgtttgagcagaggatccatatcatccattatgttccaaaggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaaggtactttggggaggggcgggaatcaggagttagttttggacatgagataagcttggaatatttatttgctatctaagacagctccttaacatggtaagcccttatgcaagttgttgtcagctgagatgggcgtggcactgagcatgggagcatggaggcgcctgagtggtctcatgctcaggtggtttagcaaactcagtgtacatcctgccaattccagtcctgccatggccactgacaagctaggagggcgctgaaaggagaaggaccccgatgtctcctccagcccatccatctcctctctcccattggccaaacccaaccggaaactaaaggccaagggtacccggtgatgaagactgtggtatcagcctcctgagcacagagagggcagaaaggggtggagacaaagaggggcgcagatagtgggcaaatggggaagtggcacttcccctagctcgagggcagaggcttggtgtgatggaatggcactccttaaactgctacatattttccctttaatttggccaagaacaagttgtcaagtttgtgtgagataaaggtgcacttggttcgttcttgtctaatggcccccgcacccatgggtatttcttcagcttccacagtcatcccgacactagctgggaagctccagcagccctggtcctggccccagctctgtgggcgctggccctcaactttgcctgcactgtgcttttgtgctattccccttggtcctgtttgggtgcaagtccccctcacgcattgagttcctgggccgctcaggctgctcctgtgtctccccagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgagtaagcctgcgctggagctggaggtttggggaggttgtgcccaaagggtttgccccaagagtgagctgggtccaggtggtgcgctggagtgcaggatgctgagtatggtttgctgctgtttatatggtgttagaggggaggtcccatctccagggacatgttatgtaagatacagtggagcgcatggtgggagtgttggtccacgtggcacatggatacggctggaatactggactagaccagcagttctcacactttttggtctcaggaccctttttcacacttaaaaatgagtgaggacccaaagggctttggtgtaggtaacacatcattctatgtttacctaattagaacttgcaatgaagaaatggtgtaatttttaaaaaattaaaacaattaaaaattttttttcttactgaaatggaggtctcactgtgttgcccaggctgctctcaaactcctgggctccagtgatcctcctgcctccgcctcccaaagtgctgggattacaagcgtgagccgctgtatccggcccaaaatggagaaattttaagtcccaacaacatgcaagcccgcattcaacaaatcttcagatcaattacatgatcacaggtcatgtagcctctagaaaattccactgtacgccagtgagagagagtgaaaaggcaaataacgtccctgtattatgatgaaaagagttttacctggtgggcccagaccacactttgagaaccactggactagacccttgattgaggagtacggtgttgagagtggagtcctctgtgatggtggatggaccaggacacatggcataggagtcaggtggttccctgggctactccatggtgcacaggatgcttcgttacactggtgcccaggacataatcacgtacacaagacacacagttacggggcagactggggatatacggcacaccagcatgcagcgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcagtggcacaatctcggctcactgcaacctctgcctcccgggttcaagcgattctcctgtctcagcctcccgagtagttgggattaatggtgcctgccaccacacccggctaatttttcgtatttttagtagagaccggttttcatcatgttggccaagctggtctcgaactcctgaactcaggtgatccacccgcctcagcgtcccaaagtgctgggattacaggcatgagccactgagcccggcctcctcctttatcttaattgaaataattcagaaatggaaagtcaaatactgcatgttctcacttataagtaagagttaaataatgtgtacacatgggcattattccatgtaccatggaataacagacattgaagacttgggagggtgggagaggggtgaaggaagagaagttacttaatgggcatagtgtacaccatttgggtgacggacccaccagaaccccagacttcaccactaggcagcatatccagtgagaacagatctgaggcttgccatcaaaattgcacttgtaaggccgggcactgtggtggctcgcggctgtaatcccagccctttgggaggccgaggtgggcagatcacttgaggtcaggagttcgagaccggcctggccaacatggtgaagctccatctctactaaaaatacaacaattaactgggtgtagtggcgcacacctgtaatcccagctactagggaggctgaggcgggagaattgcttgagcccaggaggtggaggttgcagtgagccgagatcacatcactgtactctagcctgggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggctgttaaggtggaacattggaattatcttacgatggccaaactgtgcgatgcagagcttatgttgttctaaattaattagtgccaccggttcttccctttcatgggctttcaggaacaagctaagtcccaggaccagggccggcagctaggcaggtgtgaggagcatccttggtgcatgtggtaagaggctgtggccagcaagagaggcaaccctagtcggctgccccagcacaccctggccgctcccaagcccccagatctgtcctcacatccgtgatcgggaagctggaagagtctgatgcggttcctggaggcatgtcccggacacagctgtggggcccagccagcctacaggtgaccagcctaacccagcccctgtgtctgcagagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatggtgagcagggcggagtgcggcaggggtggctgggtgtgttcccacagctgcctgggctgagggtggggtgggcaggggaggaggtggggtcatagcaacagcaggaggaagccgcctgtattttcccaaatctgatgggattcctgcccctgcctgggcctcagtcctcccacctttgaaacggagctggtcgcagtagaccaccaagcccccttcagcccagctgtttccacccctgaacttaagtgcccaggaaggcgtattgagatgaggtgtgcttgctggaaggcatgcctgctgctgattgaaaaccgaactgggaacattccttccattctgtgtccactggtcagctgctgcggctttggatggtcttgaccgtggaaggctgaccttcttctggtacccggagtccctgcaggaatcccccttgagcttgctgggctgtggtgacaggagtttaaaacatgcgttgtattccagtgatgcatgatatgacatgcatcacaggaataaaaacctgaggtctcatggatatgattgcttcaaaggagaccaagttttaaaacagatgaatcaaaataaagaaaaatactcagtaaatcatcataaagtacagagatgtggccaaaggtgtgaaggatgcagctgtaaaagctgaagtttgaggccgggtgtggtggttcatgcctataatcccagcactttgggaggccgagcccagcggatcaccggaggtcaggagttcgagaccagcctggacaacatggtaaaaccccgtctctactaaaaatacaaaaaattagtctggcatggtggcaggcgcctgtaatcccagctacttgggaggctgaggtaggagaatggcttgaacccaggagaaggaggttgcagtgagcttagatcatgctactgccctccagcctgggcgacagagtgagattacgtctcaaaaaaataaaaataaataaaaataaaaagattttttaaaaggctgaagtttgggttactttggctcatacactttgccttcactgtagaaaggtggttagtaaagaccaggcgcggtggctcatgcctggaatcccagcactttgggagcccagcgcaggcagatcacttgagccctgggctattgaggctgcagtgagctgggattgtgccactgcactccagcctgggcaacagagtgggaccctgtctcaaaaaagaagaaaaaaagggtaattaataaacactaaagttctatgtagaattttagcaacattattgttattataatcttctttgctatggctctgaatctgtgtggtgctccagaagtatgctatggaggttttgtcgaccaaaaatctgggtggtggctgtggtttgtaggccggggctgggctgggtgatgggggagtcactgcatagatcctcacatagaggccgcttctcccgcagtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatgtgagtgggcatgctttgacgtttttctgtgacctctggggaacagggtgggtgaccagcagaggcccagtccctggagccaggagcctgggaggcaagccctggggctggatagcaaatcccaggagctagagacctggcttctcacctggctctgcactaggcaagtccctttgcttcctggccccccacccctcacatcagagaaggggagttatctctgcatgccgctcctcctctgtaaaggtagggctgtgggccacatctgtgtttcccagtttgggggacacaagtgatcgtaggtggcacattgacagctcacttgaataaccctattattgaagagaataatactgactcaagagacagtgacccgtgtcagttcccttttgaggccaacgggttaaggaggaagtccccatacagctgactcgtttactaattcctcttaatgaagagagcagaggccacaccccaggcttagactttcccaagaaaacaagatcagtttgttggttgttccccatggaagctggtcctgacattcccttcacagtagtgttggtggagtttttgttgttgtttgttttgagacagagtctcactctgtcacccagggtggaacacagtggcgtgatcttggctcactgcaacctccgcctcctgggttctagcgattctcctgcctcagcctcctgagcagccgggactacaggcacctgccaccgtgcccagctaatttttgtatatttagtagagatggggtttcactgcgttggccaggctggtctcaaactcctgacctcagatgatccactcgccttggcctcccaaagtgctgggattacaggtgtgagccaccgcacctggccagtggagttccttcttaagtacatgtattgacatctttaaaaagggcgagaggatttacaggaaactatcaggtcagtaatggcaggggccgtccacagtgggtggctgagtccccctatttttctgctggtgtgcagggaggtcatttcctgccacccatgtttccccaccctgaatccaccttcctcacattcccattggagggacaatctctggacatatgggacctggggtcccacagggctgcaatccaatgcctgctgtgccactcgccagctgtgtgatgttgggcatatcccataacctctttgtgcctcagtttcctcatctgtaacacaggagtgacaagagcacccgcccacagggctatgacagtacaaggtgtgtgatacagatgagctcccctgtttggcccacatgtgtcctaaaagccatgtgccctttctcttgagtgccccaggccacagagatccccatctgcccgctgtcccacacactggtctgtcatttgttccttgaggtttgtgagggccggctctgtgcatcccaggggcccaggctgggcctggttggctctcagggagcaggcacccgccaccttaagctcccatgctggtgtctgtcactgcttcctctcaatctggccaagccaggggtgtcgatttatatctctcaggtctggtttcccctttggcactgggccaggtatggggaaagagcaggaatggggcagttggctcacacagcagaggctcagaaagcggggggcatggggggaaggagtgcacagatgctagagagtggggcaagttttgtttggtcaataaatctccttctcatgccccaggcctgtgcaagacctacagagagtcccaaggatgggctggggggaagagaaaggtaccaccttcagagtccaaagatatgttatttaatattttcatatttctagatctgccttcaggcatggctggatccagcttctaggaacctgtccagctctgcgccctgctttattctgtactggcttcgtttttaggcaggctcttccctcatgtagtggcagatatgcctactagttgctccaggcctacatcccaaagccacagtgggaaaagggttttttttcttgacggttctaataagagtcctaaggctgctgctcagtggcctggcttcgatgctgtgccagcctctgaaccaatcactggctgtgggtggagagagggtgctggtggagggccctgcttgtccagggaggagtcacatacctgcctctagggctgcaggtgggctcagctccatccaaaccagatgaactgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgaggcagaagaatgaagtccagcttctcttgtgggtggaacagtggcaactgagataccccatctctcccttcccaagaacagagctgaacataaagaatttagtgattggccagagcttggccacatgctcccctctgatgaatgataggccaggtgatgggattggcacaattggcttagactaatgagggttggccctggagttgcaggcagtggagttctgtcctaagcagtgggcacctaaacccgatggcataaaagctgggcgggtgtccacctgcatctgccacagcactataggcaccaactgtggctcatactgagtgggataaattccagaaagaaacattaggaacttactatagaattttggggctagagctactcattcattcccctagataatttctaggcaaggttccatagtggagggggagttttggcttgggcattgaaggatgcataggagttttctagatggggaaagaagggaacggtagaccaggcagagggaactgcatgataaaaggtttatgggtgtgaaaattcatggaatgtttgaggattatggggttgggggatgtgggaatatgtgtagcgataaagcaccaaacaaagccaaaagtttagttagagccctgaatgcctgcctcataatggtttccatattttatatgcctactatgtgccaggcacattgctcagggtcacacagctggaaatggcagggctgagtttttgttgttgttgttgttgttgagacagagtctcactctatcacccaggctggaatgcaggggcgtgatcatggctcactgcatccttgacttcctgggatcaggtgattctcccacctctgcctcccaggtagctgggactacaggcacaggccaccacgccaggctaattttttgtatttttagtagcgacagggtctcgccatgttgtccgggctggtctggatctcctggcttcaagtgatccccctggctcagcctcccaaggtgctgggattacaggcttgagccaccgcatccagcccagatctgagatttgcacccagtatttgaactcccaagcctgtgctctttttcctcccatggacatttctctcagagatggtctcccaaacacctgtccttcttgttaaaaaacagacaaaccgcaagtagttctttggaagctcagatttctcttttgtttcttagtaaaacatttcccagttcccagctcccttccagggtgtaagatttcttcggtaacttacatctagctgttgcttcttgtttgctcatgtttagaaagaaagacaaaagagagtgagaattttctctcccttccccagtctccccacaactcacaccccaccctcagctccctctgtaataggaaaatctctgaactctctgtagttgctccagcaatcttttggaactttgcttctttcttgtgaaaaaacctccccttggctcactttgcaccaggtttccccaaatgtgcttccaaccacaagcagaaatggagctgccagtaaccaggaagaaactgccgggggctgaggaagaggagagggaggtgcatagccctggatctcgcagggagaggggtgacaggatgagaactcaggttgctcacttgccatcagggtcagtcatgaatatagcgttcatgtatcactttttaaagcttttttggagggtaaaagtaatagttacacaaaataaaaatacaaatggtacaaaaggacttagaatggaaacatgtttctctcccgactccagcctcctgtttttcttcccagagactgaccactgctgtctgtctcttgccagaagggaaagggaggcaaggttagggcaggcagagggcatgtgcatcctttagagagagcttatgtctatacaagcaaatgtgtgtgttcagtcatcgctgtcttagttttctattgctgcataataatggtactaccagcttcacagctttaaacaacacccatttattatctcatagtttctgtggttgggagtctggacatagcttagccaggttctctgctttagagtctcgtgaggctataatcaaggtgtgggatggggctgcagtttcatctgaggctcaattggggaagggtcacttctaagctcatacaatattggtgacattcagtccctggcaggctgttgaactgagagcctcagtttcgtgctggctgttggttgtagttaaccctgaattccttcccatgtgccctttgcaaagccatcaaggcagagagacttgcctagcaagtaggatattacagtcttctgtaatataatcacatccatgaaatcctctatatatcccatcacctttaccatattctgtgggttagaaacaagtagcaggtcctgcccacactcgagaagaccagatgacacaaagatgtgattcaaagtggggatcatcggggccatcttaggtttgtctgcagtgatcactgtgccatctctctctctctctttttttttttttttttttccgagacgaagtcgtcactctgtcacccaggctggagtgcagtggcatgatctcagcttaccacaatctctgcctcccaggttcaaatgattcttctgcctcagcctcctgagtagctgggattacaggtgcccgccaccacacccagctaatttttgtatttttagtagagacagagtttcaccatgttggccaggctggtcttgaactcctcacctcaagtgatccacccacttcggcctcccaaagtgctgggattacaggcatgagccaccatgcccagccccatctctctttaaaaaacaaacaaacaaacaaaaaacataaaaagaagcagagaacacatacacatctgcatcttcccttgtttacttaacaatagatcttggaagtcacttctcagtagaggctaggttgggcagagcattggattctaggccagtgagtttggacttgaccatggagacactaggaagcccatgaaggacagagagagatgcctcgaccctgccagtcctttagaaagatcacccagtgctttttgtataccaaaccctatttgaaatacttacgtatattaacccatttccttatcaccacaaccctgcgggaagggagataggcacttttattatcttcattttgcagatgaggacattgaggtccagagaggttatgtcacttacttaaggtcacacagccaggaagtggtagtagggactcttacccttgttttacagatgagattgaattatctcacgaaaactcagaaaggttaaacaacttgcctaagtaacatacagctaattagtcgaggagcctgacgcatgttgctgtagcctggtcacagttacagaggtggcaagcaatggcctgaacaggacgaacaaccaaatacccaggctggtggctcttaaacatggtggggtcagctaacgacagcaaccagggtgggcactggtgcccctcgcccccggctggtgccctaacatctcccttttctctaccagttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactgtgagtatcaagaggcctaagcaatggtaatctccactctccattcttcccctgtggccagacacttcccctggctgagtctctgggcttttatatcataggatgcctctaatggcaatcctgccattagatacacctgccgtggtgtatctgccaggtaggcaggctaggctgcagtaacaaacaagcccacaatttccatggcttaacactatgggaatatatttcttgctcacgtaacaagctaacgtgaatgttgctggtttgtaggtggtttccctccctgtagaaatctggggagtgaggttctttccatcttgtggtgccgtcattctccaggacaaagattcttacctacttttgtgtcctggtttcctttggcagcctggtgaagcctatggacctcatttcagaatatttttaaatacataaaatcccagcctgggcaatatagtgaaacccccatctgtacaaaaattagccaggcatggtggcatgcacctgtagtcccaggtactgggaaggctgaggtgggaggatcacttgagcccaggagtttgaggctgcagtgagccgtgatcgtaccactttactcccacctgggtgacagagcaagagcccatctctaaaaataaataaatacaatgaaataaaataaaataaatagaactacagaggaaactaattgtattgaaatgcagttataaaacatttaaacacatttttaatctagagatatatgtgcttctttattaagatctataaataataagttctaggggtagctcgcataaatactgtaatttcaaagtagataagcataaataatactttatgatactgaaattgtgatgtgatatgagaatagctgtgagttttgttttgctggggacaggatcagtgatgctgtcattactggggtctcttccctccattctttttttaaaattgtattttattttatttttaaaattttaaaataaatagagacagggtatcactatgttgcccaggctgcttttgacctcctgggctccagtgatcttcccatcttggcttcccaaagtgctgggattacaagtgggagccagtgttcctggccccttcctccattcttaatggaaggagatgctaggtgtgagaggttagggaaagtaaagatgtaatttctttcccatccaagttctcagacccctgaattctacctgcagccatgttggtccatcaaccccaagtgaagaatccctgctctagggccccaccattgtctgtatccagccagcagaagaggcgtgattatggagatcacatctgcttcttgaaagcagacagcccggaagtgggccgcatcacttcctctcaaattctattggtgaaaatggtcacatgactacacatagccacaaaggaggctgggaactttctcacttggaacctacatcccagaaacaactcttttcagtgaggtatcccacaggtctttcgcagtagaaatattgattatctcacataaaatgaagtcttacaaatggacctactgggttttgtacagcagccaagtgatatctcttcccttctgctgtcttcccttctgccatccttcacatggtggcattgtatccttagacttgccacccatgccctcaggttggccgttgcacactgtcttacataaagcaggaaggaaaggaaaggctgctacgagagagtgtaccttgtgcatctcttttttaatcaggaagcaaacatctttctagaagcttccctagcaaaattccccttacatctcattggccaagactgttacatgttacatggttactgttattacttgctcattgcaaggaagactgggaactcaaatgcctggaaaaaggaacaggataatcgtgattggctcaagccttagggtgggcatggctccctgacaagggagagaggaaaaagctgttgagtgaagaagactgcttcagtttccccatctgtataatgggaggagtaagggctgtcgtaaaaactcaatgaaagaagattcttcaacgtggtaggtgcagtggcagctggcagtaccctgaccctgccaccgcacagccctctcagcattgctcatcctgcactgtggatatcagttgagccacgtgtctcctgccctgggctgtgagctccataggcagggtctccatggctgtatctccagaacccagcacagaaccaggtgcttgggaaagttttgaattgattctcatctgccattggcatggggaagggaactagcttgtatgaaacagataacaatgtatgggaccctcattcattatttcagcaaatatttgctgagttcctcctacatggctagccctgtgctagacactggggaatcggcgatgaacaaagcagatagaaatccccactcttgtggagctgacattctggagggagagacaaaaagcaaacatataaagaaagaaagaaatcacatggatctggatgacagtgagtgctgggaagaaaataaaagcagaggaaggggatggagcgatgggcagggggcaacggtagggagggtgtcggggaaaactttttggagaatgtgacgatgaaagtgaacaaggagaagtcaaccgtgttgagatgatggcagctaatgatgtggacaggccactctgttctgagtgcattatctattgattcatcatgtcatcctcgcaacagccctgcacgatcaattctgtcattaaccccatagtacagatgaggatgcggaggcacagagaagataagggacttgtcctgtgtcacacagcaaggagccatccggctcctaagttggtgcatttgacttctgtgcttccggaaagaaagagcagcaagtttaagatctggaggtggcactgagctttggaggagcagggggcaatgaggtggccggtgtgacgaggactcaatgtgcaagagggagagtggtggggagatgaggtggaggggtggtcggcggtcagatcgtggagggtctcggacgagggtcctgaccctgggtctccagtcctgggaagtggagcccaggctgtaccatggctgacctcagctcatggcttcccctcccacttccagcctacagggagcccttcgagcagcacctcctgctgggcgtcagcgtttcctgcattgtcatcctggccgtctgcctgttgtgctatgtcagcatcaccaagtgagtcctgggcccagtgctgccgagcagtccctctggagtgcagggtggcagggacttgcccctctagtctgcccctttgcagtcctctcagtcaataatacgcatttactgagcagctactacacaccttgagagtagagctgagaacatatcgacaaggaccccacttttttctttttttttttttttttttttttttgagacggagtctcactctgtcacccaggctggagtatagtggcacaatcttgcctaacagtaacctccgcctcccgggttcaagcaattcttctgcctcagcctccagagtagctgggattacaggcgcatgccactatgcccggctaattttttgtatttttggtagagatggggtttcaccatgttggtcaggctggtctcgaactcctgacctcatgatctgcctgcctcagcctcccaaagtgctgggattacaggtgtgagccactgcacccaaccaggactccacatttctaaaaccggcatcctactggggagactgaaaatacatatcaatcacaaacaggtggttttccatagtgacccactctctgaatgcactagaccagggtgcaggccagagatcttctggggtgctttttgcaagggggaccaggataaggctctccaaggagggaaaatttgaggggggccctgactggggagaatgagctggccagggataagcaagatggagtcatcccacatccccttacaacgctgggtgcctgggcaactgggggcatctgggggcatgtggtaggagccagaggaatttgcgacgattgccctgatggagtcaggagacctgggtttgaatcctggccttggagcttggtagctggcggccgacaagttgctgaaacccctgagcctggggttcctgctttgcagagtgacagtgatggtgagaacatatttcatcagccagaagaggccaaatcacagtaaaggctgagggaggagatgagtggcgagtggctgggaggtggtggaaggagcctcgtttccagagagctcttgccagcccttggaatcatggtgtctcagagcctcagtcctcccatctctgaaatgggactagcaagctcaacctcactaagtcaggattagaggtggctaaggattattaacatgattgatgaaagtgcccactcttggcccagcacacactaggtaggcagggaatgcaaattcccctccatatcttgtcactgatgcctccgagcaaccttggactgatcgccttgctctgagcctcagtttccccatcacctgtacctcttcccactccccatcactatatcccagcatgccagcctctttgctgttctttgtctttggtttcttgttttgttctgttttttagacagggtctcactctgttagccaggctgaagtgcagtggcgcggttacggctcactgcagcctccaattcctgggctaaagagatcctcccatttcaacttccagagcagctgggacaacaggcgcttgccaccacacctggctaattttcttattttaatttaatttaattttattttttgggacagagtggagtctcaaaaaccaagctggagtgcagtggtgcgatctcgactcactgcaatctctgcctcccgggttcaagcgattctcctgccttagcctcccgactagctgggattacaggcgtgtgccacgacacccagctaatttttgtatttttagtagagatggggtttcaccatgttggccaggatggtcttgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcatttctttcgtttttttttttttttctttgagatggagtctcatgttgtcccccaggctggagtgcagtggcgcgatctcagctcactgcaacctccgccttccgggttcaagcgattctcctgcctcagcctcctgagtagctgggattgcaggcgcctgccaccatgcctggctaagttttgcatttttagtagagacggtgtttcaccatattggccaggctggtctcgaacttctgacctcaggtgatacacctgccttggcctcccaaagtgctgggattacaggcgtgagccaccatgcctggcctcatataagcatttctgtctccatttatcatccatctttccctcttgaaggtcagtttcaccaaggcaggcatctttgtctcgttcactgttgtggcctcagggccaggcacagtgagtcaaacatagaaggtgctcaataaatatgtgtttatttattgaaaccatgggcagaggctaattcagaagcggtctgaggaccttacctcccagtgatgatgcaccatggccccaggcaggccaggaagagagaagggttgtgtttctccgtaggtcccccagcttcccaggccatcccaggccattccctggtcatttgccctcagctgctctgaaaaagggattgttgaggggaacctagaatcctctctctgcagtttgagtctttcctaatcccctggggtctcattcccactgaggacataggtggcctcctcaggaactctgtgctgggtaacagaatgcgggagtgtgaacctggctctgccacctaccagctgtcactccacctccttgggcctcactctcctcatctgtagaatagggttagcaatagaatccatgtcaccaggttagaatgatgagtcagtggtttgacctccagaaactaatcagcctgatctctgatgccaaataagtattggtgataacgaccacttttatgggaggagcgttcacctgtcaataattcagagatcaacaccttttccttttgtttttcaggattaagaaagaatggtgggatcagattcccaacccagcccgcagccgcctcgtggctataataatccaggatgctcaggtaggagtaggcgtggatgaggacatgtgggactgtgtacatgaagaagtgtggttcagaacacctgggctgttaaggaccttcactggcttctggaatggcaaatagacagtcaggagggttgcaggggagacagagacagaagccgaatgaggtcattagcagaccagaggctttcccgcccttccccttggcaatcccagcctggggtgggcttctctggggttggtttcctgtttttttccctccccttgggagaatgacccttgggtcatcatcactgtgtcattccctggggaggtgccagtaccagggctagaggccagaaggagtggaggaaggagagggtgacaggctttctgtgtcttcttcttaagcataggaaactgcccccgaagcactagcaaatcccttccgggttctcattggcctgaaatgtatcccacccctaagccaggggtggagtcagcttccccaaggcgatggtcctgtgggtgagtgggtggggtttgcctgagcaagatgagagttctctaggtaggagaaagggggattataggtcctgtctagaagagaaggtctgagggtccttgcttttccagggactctggaatctagtggtgttggctttgaatcctgactctgccactcactggcagtgtggacttgagcaagttgcttaattctctgagcctcagtttcctcttgtgggttataacagtgtttacctggtaggacagatattggaatttattgagacaatacatataaagtgcatattccagcctcttgcaaataccaagtgccatttatgtatcagttagtgtttgctgtgtaacaaacgaccccgaaatgtagagggttacaacaactttatttagcttatgcttctgcaggctggcatttggggctgggctcagcagtgagggtggcgggggaggctgggctgggctgggctgggcagatctgaattgagctgacccgtccccgtagcctccctccgtgtctgacagttggctttttttttttttttctttttctgagacggagttttgctcttattgcccaggagtgcaatggcgtgatcttggctcactgcaacctctgcttcctgggttcaagcaattttcttgcctcagcctcccaagtagctgggattacaggcatgtgccaccacgccaggctaattttgtatttttaatagagatggggtttcttcatgtcggtcaggctggtctggaactcctaatatcaggtgatccacccacttcagcctcccaaagtgctgggattacaggcgtgagccactgcacccagcctagttggctgacttttacctgggacagtgcaggtgcctgagccatgtgcctctcactctccagcaggccggcccaggcttgtttacagagtggctcagttttcaagggtgggaagtcccaaggcttcttgaggcctaggcgcagcactggcatgatatcacttccatcacattctatgggcccaagcaagtcccagggccagtgtagattcaagggatgggaggagattcagagcactcctctgtggccacttttgccatcgaccacagtccctgtaaatattaggacaatgtaattaattcccaggaatctgaagctcagaaagcgtaagtgacctgttggacttctgatctgtgtgatgtcgaggcttgtaccccttcctgagcattgccgtactccaggccgggctgcaaggccactctgctctttcattggctgtctctgtattttaggggtcacagtgggagaagcggtcccgaggccaggaaccagccaagtgcccgtatgtatctgaacttaggtcacagcctgcatgcattgggaaggtgatagaattggagaggcaagcccctagctccatgtctgccttctcttccctgcattcggtaattgccctgtgacattagccttcaagggacggcaggaggaggggtgttctggaaacgtggactgctggccaagccccctgagtttcactggtgtgtcaggtacatggtgataccccttgggagtgctgttatagttaacaaccagagcagccgtgcctgttgttaaaatcttgacctaattgtatacttgtcggcaaatagccactatcctgaacactcccctccttttttttaatatacaggatctcactctgtggcccaggctggtgtgcagtggtgcgatcatagctcactgcaccttcaaactcctgagctcaagtgatcctcccatcttagcctcccgagtagctgatactacagatgtgcattaccacgcctggctattttaaaaggtttttgcctgtaattccagctactcaggaggctgaggcatgagaatcacttgaacccgggaggcagaggttgcagtgagcgcagattgtgccactgcactccagcctgggcgacagagtgagactcttgtctcaaaaaaaataataccaaaaaaagtttttgtaaagacaagctctcgctgtgttgccccgccactgtggcctccttagcttcttccctggggcctgctggacctttccatactccagaaactaaagggggtccaggaccctgcttcaaccctaggatcccgcatcttttttttttttttttttttttggacgcagggtcttgctgtgtccctcaggctggagtgcagtgattcactgcagcctcaaactcgtgggctcaagtgattctctagcctcagccttctaagtagctgggactacagtcatacaccaacatgcccagctaattttccttttttttaattcttgtagagatgtttgagacggcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctcttt

SEQ ID NO: 36371 - DNA, 327420 bp, Homo sapiens
gccagcggcggcaacggcggcagcggcggcagcggcggcggctactgtctgggctgagcagtagtgcctctcgggtggcgggtttctaggctgcaggggcttggtaggtggtggcaagggggcggcggcggatgccggaagagtgcccgccccgccgcttggcggcccctggatcgagatgagcgcctccgcgtcggtcgggggccccgtcccccagccacccccgggcccggccgctgctctgcctcccggttctgccgcgcgggccctgcatgtggagctgccgtctcagcaggtaagcccgcgcggctcgcagcactcgggagggacccgggcaggcccgcgtggagagcttgctggctccgggctgaccccgcgagccgggacacccagagcagggacccggagggctcgcgggactgaggaagactgtcaggaggtttgtgcggggaggggtccagtgatggccgaacctccgggagatcccggagtcctaggagaatcccgttacaggagatgggcttgttaagggacaagcagccagccagctcaagtccctggggccccggcccgaggccgcctcccccaacgcagggagccggggattgccccgcgcagaccctctccctcgttccgcccaggaagggacccggggaaccccctgtgtcccacgggccatagtgaaagcacttttcctttctttccccacctggccatccccgcttacggagaaaccagtttgtactcttcgtgcaagagccctggaggagactttagggtgtctaccatttgctttaatctcccctgattattaagtattcggcctctttagagaaatgtattcaagacttgggggtttccttcctaattctccgagtcccaaggaacgcatcttaataattaggaggactttttccttcttcattcccttcagtgagtctctgtggaaggaggatttgatgtatatattcatgtgttcctccatcctttaggaagggctttgaggacttcttggctctgcgttgtaggaagataagaagggggaaacactgactttggagatgtgacaaaactctttgtttcactcacatatctgtagagtacttccctccttatatcggttgccttccttctgtcccccaaggggagattttgcaggaatcttagcattaaagagacctaaagaatacctttcaccctctccctttattcctcctgccaagaagaggatctagagaaactgtcatttactgagaacttaccgtgttggatttgtgcaaagggctcagtggccattagttcactgaattttcacaactctgtgagatagctgtttttattacccccatttggcagttgaggaaactgaggcttgtccagagccttccagttagtaagtggtggggctgggttgcagaatccagtgtctgactctgcagccatgcacgtgcttgagacttgggcagccttcctccaccacctttacacaggacagagtgagttctttcatacacccctccaactttccatcagctaccagtgggacttaggaaggattcagaaagaggaagggagaggttgtaggggagagagtggttgaaaagtgaaatggatttgagtgcagtaaaggaggcgggggctaaagggaagagaagagttggagataataaccactgtggttgcctttgaataggcaggcagaagagcttacagtagcaacggctttttgtgtgactactaccgaagaggattgaaaagataccatgtgccctggttttgtgatgctgttggcagggaatttctgaatagtgggagtttgagggtagtgggggtttggattgtgttgtgagatacagggagagggtagaagtctggctagggagggagacacgtctctggagtgagcattaatgtgagtttttgtatgtgtgggaggtagagtgtgagagtggttactgggagagggaatagggagcaccgttagaaacaccctggagaagtcctaaggagttcaggggccaagaaggttttagtttgggggagcttcgagagtgtgtgggattaggaaagagaaagcatcatttacttcatggagcctattctctgataacagttcacagtttaacactgggaaaactaatgcaaacaaactgttgatggaataatttcagcctcatttgttagtgtttgtgaaatttttggattggtgccgagggatatatagtggcttaagtgtacagctgaatgctatatgagtgccgagtatgctatttacatctttctgggggtgtcaaccttgaattcttggaaggcagcctatataacaaagcacttttacttttgcagttgacatcaatttatcttttggggtcaaaatgctcagatttttagtgtataaataatatcaataaaattttgttgaagttttatctgtatatagtaaagtacacagattatcagtattcagtggatgaattgtcaccaagggaacagttatgtaagtactacccagattaagagatacaaaattttggctgggcgcagtggctcacacctgtaatcctagcacttttggaggctgaggtggggggatcacttgaggccagaagttcaagaccagcctggccaacatgctgaaaccctgtctctactaaaagtacaaaaaaaagaaaaaaaaaaaaaaagccagatgtggtggcgcacatttgtaatcccagctacttgggaggctgaggcaagagaattgcttgaacctgggaggcgcaggttgcagtaagccgagattgcgccactgcactccagcctgggtgacagagtgagactctatctaaaaacaaacaaacaaacaaacaaacaaaaaaccccccaaaaaccccaaaattattaacatcctggaagtcctcctatgttctcttccatctctgtttttcctttttctctaaaggaaccacttttctgatttctaatgtaaaagatcagtttttgcctgttcttgagctttatataaatggagttgtgcaaaatgtatttttttgtgtctggtttcttttactcagtattgtttgtgagagtcatggagtatctgtgtatgtctaatgttttttttttaagtattactttgttgcctttttttgcttttacaaaatttcaaatatttagataaattggaatgtcagttgttaactttcctttaaataatactttcaaaaccatacattttaatacatcccgtactagttggcaaggtatcaatttttttttttttttgagatggagtctagctctgttgcccaggctggagtgcagtggcgcgatcttggcttattgcaacctctgcctcctgggttcaagcgattctcctgcctcaccctcccaaatagctgggattacaagcacctgccaccacgcccagctaatttttgtatttttagtagagacggggtttcattgtgttggccaggctggtctggaacccctgtccttgtgatcctcccacctcggcctcccaaagtgctagaattacaagtgtgagccattgcgcccggctggtatcaatatttctaaacaaataaacaagcccggttggtttaggatttttatgatcaagttatctcaaaacatagattcagtggctcccaaccttcttctaagatggggtttgtcaaccttgggactgttgacattttggagtgaagatgggctgttacatgtttagccacatcccaagatatcagcagcacctccccagtcctgacaatcaaaaatgagttcagacatggccaaatgtttcttagggggcaaaattacccctagttgagaaccaccttactaaggtgtattttcattttaggatagagagtatccttgttattattgactcatttatttcaatcttcattaagtcctgttgattctagaagtggctgtaatgtttaaaaagttaacactgcaaacacctgaacttttccatgtatgagtactaactatagtccatatcagccccttgactgtgtcagatgggactactacttaattttgtctccttttgcttctatgtgatcttactttactgtaatttgagcaagaactagtgacacattttttttacactttttttttgttttgtttttgatttttgagacagttttactctggtcacccaggctggaatgcagtggtgcaatctcctctcactgcaacctgcccctcccgggttcaagcaatcctcccacctcagccttccgcatagctgggatcacaggctgtgccaccatgcccagctaatttttgtatttttggtagagatggggtttcaccatgttggcaggctggtcttgaactcctggcctcaggtgatccgcctgccttggcctcccaaagtgctgggactacaggtgtgaaccaccgtgcccggcccaaaaacaaactattttttagaaagttttatttctatttttggccgagcacggtggctcatgcctctaataccagcactttgggaggccgaggcaggctgatcacttgaggtcaggagtttgagatcagcctggccaacatggtgaaaccctgtctctactaaaaatagaaaaattagccaggtgtggtggcaggtgcctgtaatcccagctatttggaggctgaggcaggagaattgcttgaacctgggaggcagaggttgcagtgagctgagatggcgccattgtactccaacctgggcgacaagagcgaaactgtctaaaaaaaattatttcgttcttttatttttattttttttagagacaagatcttgctctgttgcccagcctggagtgcagttggctcactgaggcctcaacctcctgggatcaagtgattatcttgcctcagcctccctagtatctaggactacaggcatgtgccaccataccagttaatttttttaagtttttcatagagatggggtcttgctgtgttgcccaggctagtctcaaactcctggcctcaagatatcctcccgccttgacctcccaaagtgttgggattataggcataagccactacgcccagccagaaaattttatacttatagaaaaattgagaagatagtacagaaagttcccatatactctatacctagtttcacttattctttttttttttttttgagacggagtctcactctgtcacccaagctggagtggagtggtgcgatctccgctcaccgcaacctccgcctttcaggttcaagcgattctcctgcctcagcctcctgagtagctgggattacaggcatgcaccactgttcctggctaatttttgtatttttggtagagatgaggttttgccatgttggccaggctggtcttgaactcctgagctcaggtgatccacctgccttggcctcccaaagtgctgggattacaggcatgagccaccgcacccggcctcacttattcttaacatctgccttgacatatggtacatttgttagaattaatgaatcaatatttatatattattgactaaaaaagtccatagttcatttagattttcttagttctgaacaactgtggccaggcctggtgagtcatgcctgtaaccccagcactttgggagggtgaggcaggaggattgcttgaggcaggaggattgatgtcaaggctgcagtgagccctgattgcaccactgcactccagcctggaagactgtgattaaatgtgattaactatatgtacaacataaaatttgctgtttaaataatttttaagtatacaatatagtggcattaaaaacatacttaatgttatacaaccatcatcactgtatatttccagaatgtttacatcatcccaaacagaaaacaactccccattctcgcctcctaccagcccctggtaaattctgttctactttctgtctctatgaacttcactattctgggtacctcatataagtggcattatacagtatttgtccttttatgtttggcttatttcactttgcaatgttttcaaggttcatccatgttgcagggtatgttagaatttcattccttttttaaggcagatggtattccgttgtatgtatatactacattttgtttattcattcatctcttgatgggtcctttgtttgtttgctaatttgttttgagacggggtctcactctgttgcccaggctaaagtgcagtggcatgatcatggctcactgcagccttgacttcctggggtcaagtgatcctcccacctcagcacccccgcaagtagctgagactacaatggcatgtgcctccacgcccagctaatttgaaaatttttcgtagaaatgagtctcactctggtctcaaactcttgggctcaagagatcctcctgccttggccaaccaaagcagtgttgagattacagcatgagccaccacacccagccaacccttagtttttacctgatgtccttcttccgtgccaggatcctgtctggataccacattgtatttagttgtcctgtctcttgcctcctcttagctgtggcagttcctcagactttccttgtttttgatggccttgacagttttgagtattggtcaggtgttttgtaggatgccactcttctggaattagtctgatgttttttcttatgattagactagggtggtggtgttttgggagcaagacttaagaggtaaagtgccattttcatatattacgtacatattattaacatgatttatcactgttttttttttttttttttttgagacagagtttcgctcttgttgcccaggctggagtgcaatggcacaatgtcagctcactgcaacctctacctctcaggttcaagcaattcttctgcctcaacctcctgagtagctgggattacaggcacccgccaccatgcccagctaattcttctattttcagtaggacggggtttcaccatgttggccaggctggtcttgaactcctgacctcaggtgatccacccaccttggcctcccaaagtgctggtattacaggcatgagccaccatgcctggctgatttatcactgttgattctaacttttatcatcaccagctgtggtagcatatgataggaaaggcaaactagctgttttctcctattacactgttatactatcagcataacccttctgacattagatgtgtggggctttttccccacacaccaagcgatcctccagtgaacaccaatatggtgtcctatgattcaattcaattctgccacaatctccttagagttagtatcatattccacaagttaaaggctcagacccataaaactgtcccctacttcacatgccagacgtaagtctgggtctctggaacttcttaccgactggctataaattgggggttcctatgttcccctcctcaggctcagtcatttactagagcagctcacggaactcaagaaagcaccttgcttgcacttactgttttttttttttttttaaataaacaatattacacaggatacagacgagcagccagatggaagatatcatagggaacagtatgggggaagtggcccagagctttcatgccctctcatggcagctccaccctccacatgttcagcaacccagaaactctccaaaacctgtagttctgtgatttgtatggaggcttcatcatgtaggcatgatcaattattaagtcagtcttcagcccctctccccttcctggaggatggggagtggggctgaaagttccaagcttctgatcatggcctggtctttctggtgaccattctccttctaggagctcaccaagagttgtctcattagaacaaaggatgttcctcacctaggaaacgctgagggactaggcgttgtgtctggaactggggtcaaagaccaaatatgaaaagtaaagattctcctagtacccctatggcacccagggaatgacagaggttttaagagctctgcaccaggaactgtgtacaaagaccaaagtatatatttattattgtaaattgaagggccacaggtagtgtttgtcaggtttctctgctataaggttactcttcctccccttccctctatactgtagtctttggaaggaagtcactatgtgtagtccacacttgagtgagatctgtgctcccccttcttgagggtagagtatctacataaattatttggaatttttctgtatgggagattaaatcatggctcatttcagcctctaactcctggactcaaattatgtgcctcagcctcccaagtagctgggaccacaggtgcacaccaccatgcctggttcattttttaattttaatttttgtagagacagagtcttgctatattgcccaggctggtctctacctcctggcttcgagcaatcctcccgccttggcctcccaaagcattggtattacaggcatgagcgactgcactgggccggtaacttaaagtcacacagagtgtcaacaaagggactacaatctaggtgtttcctgtttgccctagacacccattctttgcagggttctggtgaaaagttttaagtacctcagagtttgggaccatcaggctttatattttatttcctacagcacttgtgcctaacactgtgctgatgatttagtaggaactcatgtacagtttttttgtttatgagtctttcccttgaagaactttacagcctaaagagaacaaggaaagattggattcagtggtattgaaacccatgcaaaaaaacatgatagaagcagaaaagtagatctaaagcttgattttgctgtataggataaatattttccctttctgtgtttatgtttatttggataccctacttttgctaatctaatttaatcatttttctattactaaaaaaaaaatcagctttattggcaaggccgttcatcttatcaggaacatgtgcctcacgcaatgcactaccatgccgtgtacattcattccttctgcaaatatttactaagccccttgtaactcgaagaaaaaatgtaatatatagttgagtatctaaaaagtaaaatgatggcaattttttgtgctggtttggctcttataaataaaatgatatgaggaagcctcagaaacttaagatatcagcatcttgaaatcattatttttatgtgacaaaatgctattaggaatttatgttttttgtttgtttctctttttcctgtgaaaatgagtttttttttttttgaaaggaaaagctatgtttatttagtgtttactttaaaatgtctctacaggatcacaattctttgtggtagaaaattcagaagtgaaactgactagaaatagagcacaagcagaattgaaactaataagttgggcctgaagtgaaacgtatggtagaatgaaaaaaaattagattttcatagtttccaaatgtgtatttttgataagctgtgtatttttacctgtcagacatgttactgctggggagaaaaagaagtttgtcattttttttttttttttttttttgaggcggagtctcactctgtcgcccaggctggagtgcagtggcacgatctcggctcactgcaagctccgcctcccgggttcacgccattctcctgcctcagcctccctagtagctgggactacaggcgcctgccaccacgcccggctaattttttgtatttttagtagagatggggtttcaccgtgttagccaggatggtctcgatctcctgacttcatgatacgcctgcctcggcctcccaatgtgctgggattacaggcgtgagccagcgcgcccggccaagtttgtcattttcaacgtactggaatgtgtacagctacaaactgaaggtgttttagaaaaagacatctgtcttatgagagaggttgaaacattttaggtttatgctttgttttaggtttaatgacataagtaatgtcttttttttttttttgagacagcgttaccctgttgtcgcccagaatggagtgcaatggcacgatctcagctcactgcaacctctgcctcccaggttcaagtaattctcctgcctcagcctcccgagtagcctcccgagtagctggggtgcccaccaccccacctggctaatttttgtatttttagtagagacgggtttcaccacattggccagactgatctcgaactcctgacctcaggtgatccacctgcctcgacctcccaaagtgctgggattgcaggcatgagccactgtgcctggccagtaaagtcttatattgttaaattttttcaatgccttgtacagtattttagcagttgcctccttagattataaaagtagacgagtacacacagaatggaaacttgacattggaattttacaattcatagtataccttcttgatttagtatcacataaccttgttttccatcttattttaagatggaaacatgaattttgaatcatggaattttgcagatgcaaaacctgaagccctctgaggtgaagctatttgcctggccacagacttgttctagctatttattcttgccctggagtatttagtaaagagtattagtttaacagatctgtcttgtgtcttgttcctgcttgtggcagagaaataaacagaacctgggtcttgtgaacagttccactgttcttggctgggtgtgttgagaagttgtttcttttttttttttgagatggagttttgctcttgtcacccaggctggagtacagtggtgtgatctcggctcactgcaacctccacctcctgggttcaagcgattctcctgtctcagcctccttagtagttgggattacaggcgcctgccagcacgctcggctaatttttgtaattttagtagagatggggtttcatcacgttggccaggctggtctcgaactcctgaccttaggtgatccacccaccttggcctcccaaagtgctgggattacaggcgtgagccactgtgcctggccaagaacttgtttcgttttctttcctttttttttcttttaagacggagtcttgctctgtcgctaggctggagtgcagtggcacgatcttggctcactgcaacctctgtctcctgggttcaagtgattctcctgcctcagcctccagagtagctgatattacaggtgcccaccaccacacccacctaattttttgtatctttagtagagacggggttttaccatgttggccaggctggtctcaaactcctgacctcgtgatccacccgcctctgcctcctaaagtgctgggattacaggcgtgagcctggccgagaacttgtttcttaaacttcactcggtcctttggcaacattagcctcacagctttggggattttaggctagaactgaaatggaggagaggctgtattttaacgttctctttaagggcagagcactcagagtccaccctcccacgtcccttttatggtgtgaattagagtgaaactttggaatgtccctctggagcttaaatgatcagtcttcctgttttgtccctgggtacttaccatgcctatctttttttttttttttttttaaatgttctacttaagaacttctgttctctgcctctttaagtttctgaaagagtaaccatctggttttttgatggttttattctgtgtaatatttggtgttgattgctgtagaccctatgtggtagtaatgttattaggcattttacttatccattctttgtgaaaactccagtatagtgtgcttattgattgagaggctgagactgataatgctgaagttgagcatcagaacttaccactttggagtctcactttgttggtccattgaaatagctggcgttttttcctactgtggtttttataatgtccaaaagatgcagtcagacatttttgaaaataatgaggaacaccaggaagctgaaactagcagcaacctttggcttttgtcagtagactcctgggaaagaaaaaagggaagacataaaagtaaaagtgagaatcagacttaatagatcataaaagtaaacatgagaatcaggcttatgatctgttttttttttttctccaggaaaaattttatactctttaacatgagtgtagcttttgtgattaagggtttaacagtgaatacaagtaattcgtgtgttcatattagcgtatgttaaaactaattctgggcggggcgcggtggctcatacctgtaatcccagcactgggaggctgaggcaggtggatcacctgaggttaggagttcgagactagcctgcccaacatggcgaaaccccatctctactaaaaatacaaaaaattagctgggcgtggtggcgggcacctgtaatcccagctactcaggaggctgaggcgggagaattgcttgaacccaggaggcggaggttgcagtgagccgagatcacgccactgcactccagcctgggcgacaagagcaaaactccgtctcaaaaacaaacaaacaaacaaacaaaaaactaattctgagtgcaggataggaaaaactgagagccatttattcaatagatacttttaaagtgccttgtttgaattgttaggcacaggattcggaactgtatgtcttgtgtctgccagcctacttacatctttcaggggatatgaactatttccttccttaattccaatcattcttttgtatgagagctaatccagaaaactaaacttttaaacaatacaaaataaaaataatcttgcttaggattttgaaaaacctttttttttttaacgttgtctccttttaatgaaaataagactgtcctcaagaaaatcagtattgctttcatccactaagatgttaatatctaagtatacatgagaagtagcaacatgaagaaagctttctggttttttattctgaaaatagattatgaagcaaggttggcaggtaggctgtggggtgctcattacaggtctaggataatttacaggactatactcattacaggatagaattggtaccattatagaattatatatgtatagtagatatttcagacttgttttcatgaattgacttattggagtttattctacatggagtgtgtttaatataaatataaaaataaagagtagctgcccaggtgctctggagtgattggttgactggtgatagtcatacacttctatcaaaaacgtcagtataaattgggtgccgtgctatgcacctgtaatcctagcctacctgggaggctgaggtgggaggattgcttgaggccaggagtttgattccagcctaggcaatatagtgagacccccatctctaaaaaaaaaaaaaaaaaagacaccagtctgatgatgatgataatgattaattaattttcggagacaaggttgcccaggttggaatgcagtggcgcaatcatggttcacctgcaatcttgacctccctgggcttaggtgatcctcctgccttagcctcctgagtagctgagactacaggcacgcaccaccatgcctggctaatttatatgaatataaataaatatataaatatatacacatatacatgtgtgtgtatatatatatatgtgtatatatatgtgtgtgtgtatatatatatatatacacacacatatatatatatatatatatacacacatatatatatatatatatatatatatttttttttttttgtagagacagggttttgctgctgggactacaggtgcgcatggtgcgcgccaccatgtctgactaatttttgtagttttttttggtagagatagggttttgccatgttgcccaggctggtctcaaactcctgagctcaagcaatccgcccaccttggcctcccaaagtgttggggttacaggtgtgagccactatgcccagccagtctggttattagatgaggacactgtagagttgcagaatttctttttggtttctttttttgagacactgggtctcattatattgcccaacgtcaggctgaagcatagcggctattcacaggtaatgcactacaacctcgaactcctgggttcaaatggatccttctgccttagcctctggagtagctgggactatagatgtgtgcgactgtacccagctaaattgcagaatttcttaactgcaaattagtgcattttttaatattatacaactacccaaaaactactaaaaaattagaaagctgcttctcatgtatacccagacattaacattttagcaaatgaaagcaataccacttgtctcagtgacattcttctcttcattaaggtatcctgtaaagatcagtgtaattgaaagactttcttaactatgacccattttgtttggcttcttaaagttcatttgagtaattcctcacttacttaaagttgcacaaatgtgaatgcttgtaaatgccagagactgtttaggtgctggaagtaaaacagcaagcaagacagagacactgccttcatggacctaaccttctggtgcatgagagacaaggtggttagcaagcttttctgtgaaggaccagatagtgaacatgtttctgtctcagcgggccttctagggtcttagtagcaagtactcaactggttgctgtagtgcagaaacagccctatactatatgtaaacaactgagtgtggttgtattccagtaaaagtttaaggatactgaaattattaattttcatgccatgaaatatttgtcttctttttctttttacttttttgagacgaagtctcactctgttgcccagtctggagtgcagtggcacaatctcggctcactgcagcctccacctgctgggtttaagcaattctcgtgcctcggcctcccacgtagctgggactacaggtgcgtgccaccatgcctggctaagttttgtatttttattagagatggggttttgacatgtttgccaggttggtctccagctcctaacctcaagtgatctgcctgcctcgtcttcccaaagtgctgggattacagatgtgagccactgtgcctggccaattaattggtattaaattccttctgggtatcagatactgcattatactctagtgtacttctttctccaacttctgttattcttggaatgccagaatatctttgaatatggttttgaggcttcttacagcaagtaagtattcttttttttttgagacagtctcgctttcggccaggctggagtgcagtggcgtgatcttggctcactgcaacctctgcctctcgggttcaagcgattctcctgcctcagcctgccgagtagctgggactacaggcgcatgccaccatgcccggctaactttttttgtatttttagtagagactgggttttaccatgttagccaggatggtgtccatctcctgaccttgtgatccacccgcctccgcctcccaaagtgttgggattacaggtgtgagccactgcgcccggccgtaagtattctttaatatggtgtcataagaagacttgttataaggctggtcctgggtataactaaggtaactttggaaaaagtgctttgttctagtcctcaggttcttaagctttacagtgagaagactaggttatctgtagctctgtgcacatttttaacctctgtgtgcctccatttcctcaattgccaaatgcttttgtctcgaatactttcattctacaaatactgtgttcagctctgttctacaacattattaattcaacagttaatttttgagtttctaccatgtatcccacagtggttaagaatatggacactagagcctgactgcttgtgttcaaatcctggtccagctattttctacgtgcctaaactaagttaggcaacctagaagttatttaatctctgtgtgcctcagggagactcaggtaaaatgggcataataatagcctaccttgtagggttgttgagaggattaagtgtgtcataaatttccctaaaaaggtgcttggtttatagtaagtgttcaaaaaatgttagctgttgctactgtcattgctattcccatttgtcaggcactgaagatacaggataagcgtgtccttgccctggagggactcataatctagtgggtggccgggaacggtggctcacacctgtaatcccagcactttgggaggctgaggcgggcagatcacgaggtcaagagagtgagaccatcctggtcaacatggtgaaacccagtctctactaaaaatacaaaaaattagccgggtgtggtggcaggcgcctgtaatcccagctacttgggaggccgaggcaggagaatcacttgaacccgggaggcggagattgcagttagccaagatcgcaccattgcactacagtctgggcaaaaagagtgaaactccttctcaaaaaacaaacaaacaaaaaaaaaaaacaaaactagtgggtaagacaaatatgtcactaggccattttagtgtaatataagagatgattcgaaaaaagtactgagatgggaaagatgggaaatgcatgctagcagagggaccagcttgagcaaaatggtaagaaggtgtaaaaaggaatggcagataattgaggccagagtttaaggagcttagaggaggacggtggaaacaaggagctggagagtacaaatgccttttgatttatgatggggttatgtcctgatgaacccactgtaaattgaaaatatcgctaagtcaaaagtgcatttaatacacctaacctctcgaacaccgtagcttagcctagcctgtgttctcagacactttccattagcctatagttgggcaaaatcgtctgacacaaagctgatttttaaaaaagcattgaatatctcatgtaatttactcatgtaatttattgaatgctgacctgaaggtgaaaaacaggatggctgtatgggcactccatgtacgatttctactgaatgcatattactttcacaccatcataaagtaaaaacatcattaagtcaaaccgtcctaagtcagggactgtctgtacctaggacagtctgtgctgttccacttacaacacttctgacaacaaatatgttgggttttccccccaacatcaaccaattcttttacaccagctgggtatccttgtgttcagttcaattctgatgctatttacccggagttatgacctacaagttaagggcccagtcccacaaggctgctcccacagacgtcagtcccaagtcccggtcgcaggcctcctgtacttctcagctatcagctataaactgaaggttaccatgaccttctccttgtgttcagtaatttgttagaatggctcacagaactcaagaaaacattttatgtattattataggtttaggataaaggatacaacctgggaacagccaatggaagagataaatagggcaaggtatgggggaagggacgtggagcttccatgccctctctgggtgtgccagcctcctagcacttcaatgtatccaccatttcagaagctctccaagctctgtttagggtttcagggaggttctattaggtagccatgattgattatatcattggctgttggtgattaacacaatctccagcctgtctcccctccctggaggtcagggggtagagctaaaagttttaaccctctaatcatgcctcagtgtttctgccctgaagctctctgagggactcccagccaccagttatctcattagcatgcaaaagacacttatcactccagagattccaagggtcttagaaactcttgtgtcaggaactggaaactaccaattattacattataacaaaagatgcttctgtccccctataccaagggttttaggagctgtgtgctagaaaccagggctgaagacatacatttcttatcataccagtgtcacagagaagttgtactaatagtttggagttagattgtaaagggtcacgtatgccgtgatttggaatttggaatttggacattatcctgtaggtagagagaacagtctttattttatttatttttatttttatttggaaagaatttcaagcttatggaaaaatggcaccttttattttataaatttctgtttttcagaacacctgtatacctgttacttagatttgtctgttaacattttgtgttcaaatcctggtccagccatttcctatgtgcctaaactaagttaggcaatctggaagttatttatctctgtatgcttcagggagactcaggtaaaatgggcataataatagcccattttgctacatttgcaagcttgctctctttctctctttctgaatatgtgtagataaggatatataattttatgtgaatcatttaaagttgttacatacatcatgaccctttacccttaaatacttgagtatgtatttcccggaatagggatattctatttcatatccatagcatagttatctgccgagaccagctcggtcagggagaccctaacccagcggcgctagaggaattaaagacacacacatagagaaatatagaggtgtggagctggaaatcaggggtctcacagccttcagagctgggagcctcggaacagagatttacccacgtatttattaacagcaagccagtgataagcattgtttctatagattatagattaactaaaagtattccttacgggaaacaaagggatgggccaaaataaagggatggattgggctagttatctgcagcaggagcatgtccttaaggcacagatcgctcatgttattgtttgtggtttaagaacgtctttaagtggttttccaccctgggtgggccaggtgttccttgccttcattccagtaaacctacaaccttccagcatgggcatcatggccatcacgaacatgtcactagtgctgcagagattttgtttatggccagttttggggccagttaatggccagattttggggggcctgttcccaacagttatcaacatcagtaaatttaacatcgatactttaatctaaggttcatcagttgattctataatgtcctttatagaaattttcctcctccagttcaggatatagtctagggtaggtattacatttagccgttgtgtctctaatgtagaacatttccaaagcttttctttgtcttatttttaaatgtcactagcataatacagaccctgctcccttaaaaaaaaaataggacattcctcattttctgtttatctgatgtttcctcatgattagattcagattacacattttcagttggaatattgcatgggtggtaatatgtccttcataaggtatcacttctggatgttcatttgtccctcattggtaatgttaattttggtcacccggtcaaggtgtcgtctgatttttcaactctaattctttgtgtgtgtgtacatgcatgcccttgcaactaatagtctatagggaaacactttaagaccatgcatggggccgggcgcagtggctcacacctgcaatcccagcactttggtaggccgaggcgggtggatcatgaggtcaggagatcgagactgtcctggctaacatggtgaaaccctgtctgtactaaaaatacaaaaaattagccgggtgtggtggcacgtgcctgtagtcctggttacttgagaggctgaggcaggagaattgcttgaacctgggaggtggaggttgtggtgagccgggattgtgccactgcattccagcttgggcaacagagtgagactctgtctcaaaaaaaacaaaaaacaaaccaacaaaaaaaccaaaaatactttttgtagcaaagggtctcactatgttgcccagcctggtctggaactcctggcctcaagatatcttccctcctcagcctcttaaattgctgggattatgtgagccaccatgcccgacctcatttgtgtttaatagggaaaaaaagaatatgtaattattggagagccataaactataactgataacactggttgccccaggggaaaggaaatgggtatttggggcacacagtagtacggagactgttcactatatcctcttatatactgtgccttttgaattgtgaatcatatgaatttttgtgtgtatcatgtgtatttttaaaaataacattaaggatactttttacttcttattttttaagactagtcaagtgtagtagtgagaagcgggaaagagttgagcaaatttgatctgtaactgactgtgaacactaaattgagaaaactcattacctttggatcagcttaagtttatatttcaaaaaaaacagagatggcaaccaacctttaaacacaggtatgcagatgacaatttcccgaagcaatgtgacacagtgggaagaactcaagttagagcttcagctcaactctaggtggttctaccactcattagtgagcaagccacttactgtttctgagcctgtttccccttccataaaatggagatatttccacctgcctacttctgtgggttactgcaatgatcaaatgaaataatggatatagaagctctctaaaaaagtgtaaagtactttataatatatatttaaatataaagtattacaaaaatagagatgtcaagagaggaatgtggttatcagtgaaagatgatgaatttaggccattcttatttgaagtaaagagacacagatttagaattcatctctctaaatagaggtaattataagtcacaaaagtataacagatctctgaaggataaacattcaacaaataggccgggcatggtggctcacgcctgtaatcccagcactttgggaggcggtggtgggcagatcacaaggtcaggagatggagaccatcctggccaacatggtgaaaccctgtctctacttaaaaaaaatatatacaaaaaattaactgggcgtggtggtgtgcgcctgtagtcccagctacttgggaggctgaggcaggagaatcgcttgaacccgggaggcggaggttgcagtgagcctagatcatgccactgcactccagcctggagacagtgagactctgtcttaaaaaaaaaaacaaaaaaacccaccttcaacaaatagaagtataatactgcagaaccagaaaggaccttgaaggtcatctaagcctttgctactctgcatcacttgtagtgaaaatgctgagaatctcaggtcccaccatagacctagtcaatcagaattgtacttcaacaagattccctaggtaattcatatagacattttaagtttaagaagcactgatctaggccatcttccttatttttcagataataaaactgaggccctaagtaaagggatttacccatgttcacattgttaataagtagcaaaatcaagatttggacacaggcttgatctcctgggctgggtacaccatgtattcgcttcccagacaccctgtttcaaaacctttgagacatctttgcatttcaaacttcccatgttctcacccccatttcttattggccatctagatccatcaattctttcttcacaatttctttggcatacgctgcttcttttccacccacttcattcactgccctaaagctactgttcataccacgaaaaagcagcttccctctcctgtgcatgtatcaacttcctcttctgcaaacaagagtgcactttcaaatagtaagctctatataattccttaagaaggtgcaagtcattaaaaagcattaaactttaacatgctaacttcaggcagaatttgtatttgaaacccaccaagattagcagctataactgtaattctaactcaaaatcttcatgtcttcacttccattatttctttcctattacctccttttctttgccctagaactagcttttatgtaacaaggccctcccattctaatcaagcttttctaaaatatagttcatcatccctcagtatcctcaggtgattcactccaggaacagccaccaccctaatcccccaccaccacagataaaaaaatctgctggccaggagcggtggctcacgcctgtaatcccagcactttgggaggccaaggtgggtggatcctgaggtcaggagatcaagaccatcctggctaacagggtgaaaccccatccactaaaaatacaaaaaattagccgagcgtggtggcaggcacctgtagtcccagctactcaggaggctgaggcaggagaatcgtgtgacctcgggagtcagagcttgcagtgagctgagatcacgccactgcactccggcctgggcgacagagtgagactctgtctcaaaaaaaaaaaaaaaaaaaaaagtctgcagatgctcaagtccctgatataaaatggcatagtatgcatataacccatgcaacatcttcctgtagactttaaatcatctctagattacttataatatctaatgcaaggtaaatgctatgtaaatagttgttacgctgtattgagtttttttgtactttttaaaaattgttttgttttggtttgtttttttcaggctagtcaagtgaggaactgggagtggagaaggaacaaagaaatctctaactggttctgatcaactagttgtgaacacaactgcatttggactagcctattgagattttttttttctgaatattttctatctgtaattggttgaatccagaatcctcagatgcagagggcctgctgtagattcaaagtatcatcttctgaatttatagctcttaccatctacattctcatgcctttataattctctcctatatattccattctaagaaaccaaattatttcagcatttcttgaatacctattaaaaagttttaaaaaattaggcaggcatggtggcattggcctggagtcctagttactttggaggctgaagcaggagggttgcttgagcctgagagtttgaggctgcagtgggctgtgattgtgccaccactcgccagcctgggtgatagagtgagaccttgtctctacataccaccaccgctgcaatccaagaaaagccacaaatgctaaacacactgactgtataaactgtacttaaaaaaaaaccctacaaactaatagtagatcttggaaattattccatatcagtgatcaaagagctgccatgttatgtattctttatggtcacatagcatttcactgtaggatatatcataatttagtcccctattgatgtacatttcagttatttctagttctttttgctaataagcaacactctattacttacatcatattgctgaatcaaagaatatgtgcatttgtaatttttttaaattttagggttttttttgtttttgtttttgagacagaatcttaccctgctgcccaggctggagtgcagtggcttgatcatggctcactgaagcctcaacctcctgggctcaatcgatcctcccacctcagcctcccaagtaggtgggtctacaggcatgcaccaccacacccagctaatttctaagtttttcatagagactctctctctatatatagagtcttcctatgttgcccaggctggtcttgaactcctgggctcaagtgatcctcccacattggcctcccaaagtgctgggattacaggtatgggccaccgtacccagcctgcatttgtaattttgatagatgttgtcagattgccatctgttatggatgtctgtttgaatatctgttggaatatttgtcctctccaaaactcatgttgaaatttagtccccagtatggcagtattgagaggtagggtctttaagaggtgataccatgataccatacctctgccctgatgagtggattaatccatttatgtattaacgggttaatgggttagtgggttaaggggttatcatgggggaagaactggtggctttataagaacagaggcctgagctagcaccttagtgctcagctcccttgccatgcgataccctgcaagtcctcaccagcaaaaaggctctcaccagaggctgcccctcggcctgtgttatcagattttttggtctgtgccaattttagtgtagttttaacttgcatttctcttatgagtgagattgagaatcttttcatgtttaagagctatttgtgtttatttttctgtgaattatctgttaatgttctttgccatttttttctgttgggttgttggacttttgatttctaggaattctttatgttttagtgaaattgtcttttttatattaattaaaattttttcttaggttttttcctttgactctgcataaggtagtttttgccatgcctaattttaaagtgttttatgtagtaatttttttcttttatagcttctgaatatcatttttagacctttgtgtttataaaataattgttcatggtttctttgggtactttctgctttatgtacattaaatatttttaagccttctggaatttaatgtaaggcataggatgtgtgtgtgtgtgtatttttgatggctaccctattgccctaacacctttattgattagttctcttttccctagaggttatctttgacttgtttgtctcttttttcaattttctcttcatccctaaccacatccattatctaattagttatcccagtaagctcagtttttctttaggctcctatatgttcttatattttctttctgttcctattgataatactttaaaccatttttattgtggaaatttcaatgtctattgaaatgtatattttatatatgaatatattcatcagtatatcaatgtatattgaaatgcaagtagtgtatgtgtgtgtgtttttgtgtgtgtgtgtatatatatatatacacacccccacacatatatatatagagagagagagagagagaaagagattgagagaggaatataatgaactcccaggtacctgttaccccacttcaataactattaactcatgttggatcttgtttgatctatatgcctacctccttgtcctcctttcctccctccaattattttgaagcaaatcacaggcatgctattactcaacatctggacctctgtcagctattttctgtcttcaatttttatcttctgtaggtcatcctgggtaactgtgtgtttcttcattggtcttatatttctttttttttaaattttgatcttatgtttctaaatgctgaaatttacctgaaaatttaccagaaatttgcccttttcatgtgtacaaactctagttctttagtaagatcatatactctgaaattaggtagtaattcctaataatagtctgtaaaggcaatactaagctagaatagaagaaagaaggaaatgaggggtgggggaaagagacacttacagagggcggtagcggatctacctgtttcttagagtaacactacctggcagaagaatggggcgggggaaggcaagttttggggcctttcaccaagtttgggggtaaatagggtagaaataagaaacccacagccaaaatgtataagaaatgtagaaagttcagagtcgcagtttgttttttcctgttgagaagcctgttttataatttagtgcttagtaaatgactgcattaaattcagactgatttgaacttggtgggagagcagagttaatttcagaataaaggctttagttccaaggttgtgtaatttgtgccagagaaagctctcaattagcgaccagaactatgaagtgtttcatgagagattagggttgttgggttgtttgtttaaatctgtaacttggttggcaccatttgcttatagccagtagccccaggcactagttttaaagcattcttgtgttctttcaaaattttcatagtgaggctttcaggttggatcaaaggattaggaaaatataggtgattgagagtgctataatatagagagctcctttctgttttttgtttttttgtttttaaactgacttgaatttatcaagcttaaattcttagttcagtagttgagtatctttaccttctgtggaaatgtggaaaaccagtttcccacaggtttatatttgttacctctcaaaaagttataacaaagtaacagtaatataaatttgcccgaaataatctgggccttaattcttgcctgccattgagcctggtctcaggctgagaggaaatgtctgacctgagaaagaaatggaaccaggagttgagagtgggaatgaaataaggtgtacaggacaagcttgactacatttccaaaggcaaatactattttaagaaattatctcataatatctgtgtttatctaaatcaggggtcagcaaactgtgactaactggctggtttttgtaacaaccaataagctaagaatggttattatattgttaaaagattgttaactaaaaaagaagagtatgtagacagacagggtgtgcactgaaaagcgtaaaagatttactccctgatctacattattcaaggtatatagtaatatttctttacgtaaacattaaacatttcttgctcttttgtttgttttatatcatcattttcaatgacctttaaaaaaaaactggtaatatggttttccattgcatttttacattgtaccacaatgtaagagtgttactcagtttttgcttttatagcaatactggaataaacatatttgaacacaattttatgacttgtgaaatgcttggtaaaattttatatgaactttaaaatttgataattttttgctaaattgcccttgctccaaagcagaccagttttatgttttccccactttgttgtccttacccgtgtcaaccccagtagagactaaaatggttagactctttaatcagataggtccctttaattatctattactccataacaaacaaaacctgagtggcttaaaataacatcatcatcattaattttgctcagaaatctgcagtttggtctgagcttggtgggaacaacttgtctctgcttattatcttgatgtcatttctggaggctccgagcctcaggacatggtcacttacatgtctggctgcctgctggaatctcagctggggctgtggagaacacctatgaagcccatgtgactggttggcttcctcacagtatagtcactgggttccaaggaagaatatcccaaaaggaccaggtggaagccatgtcacctttcatgatttagcctcagaagtcacatagcttcatatctgcccacatttaagggggaggagacatagacctcacttcttaatggatgacaggggtggcagcattacactgtaagagagcatgtcagatgggatgtattggggcaaccaagtttggaaactgcagtcggtcacaaggtggaatatttattttgatgtgcgtattttaaaattgtgggtgtgattatacatcttttcacatgttcattgactagttccattacttttccttttactgtgacctgccttttctttctttttttttttttttttgagacggagtctcaccctgtcacccaggctggagtgcaatggcgtgatcacggctcactgcaacctccccctcctgggttcaaacgattctcctgcctcagcctcccgagtacttgggattacaggcgcccgccatcattcccagctaatttttgtatttttagtagagacagggtttcaccatgttgcccaggctggtcttgaactcctgaccttgtgatctgctcgcctcagcctcccaaagtgccgggattaccggcatgagccaccgtacctggcctgacctgccttttcatatcctttgcccctttttcgttggtctctaggttattgattattggttacattattgatgtgtaataactcttatagattaagcaaatcaaactcaaactcgatttagaagttacttccttgtggccctgggagttgtgaaagttgtgtgtgggatggtttagtttggtgatggtggggatttatggagtaattattttaagaaccatactacttttgttttttaagcaagtgatccagcaagggagggtgaatgggagccatttccttgtctttggttatcagcctctctgaatcactctctaatgcttgatgcagaacaagattaagggcacatcagttctctttggtcattaatatacctcagaagccagagaattttagatgcatgcaagggaaaggtaaaatatttcactactgaaaatggctttgagttctgtcagttctggtgtgtgatctgaccgggttttttaagacttgctttccgctgtattaaggttcaaaactgtatcaacaaatatagattgaccctacagaaatgatcattttctaaaatacgggtatgtttaataaagtgaaacatttcttttatcttgccactaagttagaatgttactcttcatctactaacctgccatgggataaatccttaataaaccttacagtataagttctttccctagttgtaatctttgacagttttaaagggatgggctgatgtttgtcatcatagtactcattttaagtatagtttgatccaggcttggactgtgtcagcaggatctgaatcccacatctcttgactctgctctcttccttgttggtttcattccctggtttcactgtgatagaaagatggctgacaggatctctagccctatgtccttctaggttcagggccagtaggggcaaaaaagaactcatggccggctcagtggctcatgcctgtaatcccagcactttgggaggccgaggtgggtggatcatttgaggtcaggagtacgagaccagcctggccaaaatggcaaaaccccgtctatacaaaagatacaaaaattacctgggtgtggtggcaggcgcctgtagttccagcaactcaggaggctgaggcaggagaatctcttgagcccaggaggcagaggttgcagtgagctgagattgcgccactgcactccagcctgggtgacagagcaagacgccatctaaaaaaaaaaaaaaaaaaagaactctcaacagtttaatttctgggtctttcgttagccctaattggatcatatgttatgatcgggagaatataatgtgctgattgattggcctgagctgaattgtgtgaacatccctgatgctgcaggtagagttaactctactgaactgtggatctacaaggccataaacaaaacaaacaaaaatataaaaacaaaataaaaaagttgtttgtattctaccgttaagttttaaagcagatttctttttctttttttcttttttttttgaggcagagtctcactctgtcgcccaggctggagtgcagtggcactatctcggctcactgcaagttccgcctcctgggttcacgccattctcctgcctcagcctcccagtagctgggactacaggtgcccgccaccacgcctggctaattttttgtatttttagtagagatggggtttcactgtgttagccagatggtcttgatctcctgacctcgtgatctgcctgcctcggcctcccaaaatgctgggattacaggggtgagccaccgtgcccggcctaaagcagctttctaagaaaattactggtattaagaagaaaaacagctattctgggttttttggaagcactggtttacagtcatactaatgagtatgattgtgatactaatatttttatttttttactaaagcagatgtttctcttttcttttcttttttttttttgagacaaggcctcactgtgttgcccagtctggagtacagtggtgccatcatggctcactgcagccttggctcatttgggctcgggtgattcttgcacctcagcctcctgggtagctggaactacattcatgtgccaccatgcccaactaatttttgtggagatggagttttgccatgttgcccaggctggtcttaaaactcctgggctcaagcgatgtgccctccttggcctcccaaagtgctgggattgcaggtgtaaaccatcatgaccagccagatgtttcaaatttactatgcataccacttaagtcttgcgttagaatttgtatttgaaagatttataaaaagttaaggaatttagggtcatattgctcttttgcccactcccaacatttcaggtagttgaattgtgccctataatctgtctgtctcccagatgaaagctgaataggttttgattttgtatgttagtgaatgtttttaacctttatataaggatgtgataggtagtgtttcaaatattttaaagccatgttaatttaaaaattaaaatcccctattcagctctggggatggatattactagagcacaactcagccacctgaagctaccactgtagtataatgcacaaagagcattttataactgtgaaagtataaagtagagcatttgaggaagtttctggagattgcttgaccacatgactattcacaatagcaaagacatggaatcaacctagatgcccatcaatggtggactggttaaagaaaatgtgatacatatacaccatggaatactacacagccagaaaaaagaatgagatcatggcctttgcagcaacatggttggagctggattctattatcctaagtgaattaatgcaggagcagaaaaccaaaaacttcatgttctcccttataagtaggagcagaaaaccaaaaacctcatgttctcctttataagtacacatggacacaaagaagggaacagtagatactggggcctatttgaggggtggagcatgggaagagggtgaggatttaaaaactagctattgggcattatgctgattacctgggtgagaaaattatctgtaccccaaaccctgagacatgcagtttacccatataacaaaacctgtatatgtacctcttgagcctaaaggttgcccaaaaaaaaaaagttagcagatcttaggaagttatgtcacagacatgaaagaaaaagaaaactgcatagaatgttatcttaaagagtgattccaaagtttgtgtaaattttaatttttttgtgtaaatttacattttaattactccgaatgtttttactttcctgagatatttgaaccgatttagatcataaaaatgtttggcttaaatatctgtagctggaccattaattctaaacagaccagtaattctgtttagaaaagatcaaagcattgatatttatgctagatggtgcctctaggatgtgaagtaccactagaccttatactcgagagcagttgaaggatgagccttgaggatttccaataggctaaaagtgttattaagacttaccgcgtttcagtcattagacaagttcttagatgtgaagtgcgctgtgttctccatctggtgggtgggcatcagaatcaggtaagggtttcagaccactcagaaccattgcaaagcctaagaaaaaccaagttttaaattttaattaagtcccatttatcagtttcatcttttatgaattatgcctttggtgttgtatctagaaagtcctcacaaacccaagatcaccaaaattttttcctatgttatcttctaggacttttatagttttgcattttcactgaggtctccgattcattttaagttaatttttgtgaaaagtataaatctgtgtctacattcatttttttttttttgcatgtgaatgtccactttcagcaccatttgttgaaaagacttggctgttgtctttgaattgtgtttgagcctttatcaaagaatagttgactgtatttgtgtaagtgtatttctaggctctctattctgttctcgtctgtttgtctcttcttttgccaataccatcctgccttgattactgtagctttatagtaatgtcagttctctgactttgttctttcattttttttttttgagacggagtcttgctctgtcgcataggctatagtgcagtgacatgatctcagctcactgcaacctctgcctcccttgttcaggcgattctcctgccttagcctcctgagtagctgtgattacaggtgtgtgccaccacgcccggctaattttttgtatttttagtagagatggggttttgccatgttagccaggctactctcgaactcctgacctcaggtgatccacccacctcggcctcccaaaatgctgggattacaggtatgggccaccgtgcctggcctgttcttttgttttcttgagatggagtctcactcattctgttacccaggctggagtgcagtggcgtgatctcggcttactgcaacgtccaactccggggttcaagtgagtctcctgcctcagcctgtcaagtagctgagattacaggtgtgtgccaccacgcctggctaacttttgtatctttagtagagacgggtttcaccatattggccaggctggtcttgaactcttgacctcaaatgatccacccgcctcggcctcccaaagtgctagtattacaggtatgagccactgtgcccagcccagctaatttatttttattttttctagagatagggtctcactatgttgttgcctaggctgatcttgaactcctgggctcaagtgatcctcttgctttggcctcccaaagtgctgggattacagttatgagccactgtgcctggctctggaatgaacgttattaaaaaagaaggccagacctagggcacaagagggtttacatgtacacttactgccttttaccaagattgcatcagtaatttacccataaagagtttattagcgactgggcacggtggctcacgcctgtaatcccagcacttttgggaggctgaggtgggcggatcacgaggtcaggagatcgagaccatcctggccaacatggtgaaaccccgtctccactaaaatacaaaaaattagctgggtgtggtggtatgcgcctacagtcccagctactcaggaggctgaggctggggaaatgcttgaacccgggaggcggagattgcagtgagccgagatcgcaccactgcactccagcctggcaacagagtgagactgtgtctcaaaaaaaaaaaaaagaaaaaaggatttattagcacgggcaacatagggagactctgtctctaaaaaaaaaaaaaaaaatttagctgggcatggtggcatatgcctgtggtcccagctacttgggagactgaggtgggaggattgcttgagcctgggaggttgaggctgcagtgagctacgatctaccactgtactccagcctgggggacagagagagaccctgtctcaaaaaaaaaaaaaaagtttctttcctttgtccattccagttgctggaagtatcttggattttaattaattatggtataatgagaatacttaccctaatgcttttgaaataagtaaaataaaggaaaagggcaaaaagtcatacagcccacagtcagtgctttaattatagttggtcagtttatggagtttgttttttgtaaacctttttataaaatggtctgaatgtggtttgttctgtttattcgcattaatggattacactggtaatcacccagatgaaaatcatagagtttagaatcagaaggtatcttggaggtggtcgtgctaatttcccacagttgctacataatgcagagatctctttgataataatatccatgcatctattatagattcgatctccgtccaagccctgcacactgctttgtaaggcagtcaattccatggtaattgcatgtgtcataaagttattcttttgagttgaagaattggttatttccttgtgttctgtagtaataaaggagtatgaagacaaattatatcttttaggtatatgtagtatttagatggagatacatatccacgtatataggatgtaatccttggctttctttctgcattctttccttcttttgagatatctcctgtcatttattattttctttgttttatatttggttacttagaaatgtaagactaggctgggtgtggtggctcacaactgtaatctcagcactttggggagctgaggcaggtcgatcacctgaggtcaggagttcgagaccagcctggccaacatggtgaaaccctgtctttactaaaaatacaaaattagccaagtgtggtggcacatgcctgtagtcgcagctacttgggagcgtgagacaggagaatcacttgaacccaggatgcggaggctgcagtgagccgacatggcgccattgcactccagcctgggcgagacagagcgagactccctctcaaaagaaaaaaaaaatgttgagataaagaaatgaataatgatggacgggcgggtggtggctcacacctgtaatcccagcactttgggaggccaaggcgggcggatcacgaggtcagaagattgagaccatcctggctaacacagtgaaaccccctctctactaaaaatacaaaaaaattagccgggtgcctgtagtcccagctacttgggaggctgaggcaggagaatggcatgaacctgggaggcggagcttgcagagagccgagattgcgccactgcactccagcctgggcgacagagcgagactccatctcaaaaaaaaaaaaaaattaatgataatgagtaatagttaaccttgtagggttgttatgagaattaaatgttcacatgtatgaagcacatatttagcacagtacatgacacaaggtaaacatttaataaatgctgacagtacagtgatggttgtggtttctatcaagccttttaatgctagattaatagggaagataacggtaaacaattaactataataaaggccgaacaaaataagtgctatagtagagatagaagcaaagttcttacttgtcctaataagggagcaactaattttgttactggtagcgggtcttgactgaaagttctccaggttctaggtgttttgaacaaagaattggacaaaattaacagcaaagcaagcaaagagtgaagcaatgaaagcagagatttattgagaatgaaagtacattcagcaaggtgggagtgggccttgcagcccctggagagcccccttacagaatcttctaggacccacatacccccagaggtttcccattggccacttggtgttcacaccatgcaaatgaagtggtggcctgcaatcagtctgattggttgcagaaagcagccaatcagaggctgaagttacaaagttacactcctatgcaagcatctgattggttatggaaagcacccagccagaatggggagtttgcaaagggtgtagcctttggtccttttgttatttaggcatggaaagttggggttttcctttagatttagttctagggttgccttaggtccctggagaccctattctcctgcctcaatttcaattggaaaatcaggaagggcaggaatcttctttcctaaactttgaaatatgcataggatctccttaaagagcgggatggcattgaggtctaccatcagcaaatgcatggagctaggaaagttcatggtctttttgatggactttaagcagtcatgtgtgactgaggggttgggtatgtggaagagctggtgggaagtaaggatggtatatagagaagttagactgtagagggctttgaacacaatgatgggatgtttttgtacattatcctagatattccagatgttttcaggtctttgaacagaggagcaggattgtaatcttatagcaaaatagatgtgattattgtatgcagataattagtggttcctgtttttaaagttttgactgaaagggctaatgaaaagtgtgtagcaggagaaaattgttgctgtaatccagggtgtgaaatggaaaccattggcagattgtggaaaaatgagtcttttagagtaagcccaggaaactttttgtaaatacatttgaggcttttcatacttagaggattaaacaaatttattagacaataaccttctctctcaaagaatcttaatctctagattgggagaaaggattgggttggtatgtgcacgggaaaaagacctgggctcttttggctgactgtgcctgtaattgaaagtggacttacctcaggagagtgaactggctttcagcctgcgggagagctttaagcacattttaagtgtgagcacttggtttctatttttaagtctctgaagataatgatctgacatagggaactagcttttggggatgaatctgctgtgcccagacttcagcgttgccaacattctctttttgatatatgagttgatttggctatcccttaagcttattttgtatttttgttgatttctactattgcttatgaagcttttccatttctaaacttatgatttcaaatcattaaagagtctggttggagaaattgttaggaaggaggcctgattatgaaattgagactggtgaaatgagaatcgaatggaagctcacagcagttgctttattggctggatggggtggatggagtgaccagtgagtcactatttttattttttggctgtggccttgttttcctgcttgtatagataatctggcatctagactgaactagcatcaggggtgagtgtatgtgttaactggtgattatctgttggtatgagatggattttatatgtctatcagaatccctctgtggagaaaaccaaattactacttagtttatgttccagggaatactaatgctattatgcgggtatatagcacttacataacgttggtccttttcaaaaatatttcatgtctgttgtcacttcattctccaaccaccttgtaaatgagatagggcaggtataattcctgtttgacagaggggatgctgaggcataaataagagactgggttatggtttctggctcaataaataaatgactgagacaacttattacatttcatttttgaactgcaacttccagaaaattttataggaggaaaaatctgaatgccttctcttttttgttgttatttttcagcggcgtcttcgacatcttcggaacattgctgcccggaacattgttaatagaaatggccatcagctccttgatacctactttacacttcacttgtgtagtactgaaaagatatataaaggtaaggggatctgtggccttactacccacagattgttatatttttattttttttgtaacacaagtgattctcagtgcctcctgcttttgtggcttctcggaaacctaaattgttatgctgtctgaaaatatctcatgagcagttgggatgtatactaaagaaagatggcagttggatagttctttcagataactgagccttacattgatacgtttatcattcctttatgaatgttagctattaatggtctagcagctagcatttcaagtagattgaatccagtatcctgtagtaattttacttttataaaaatgtaataaatttcttttctttaatattatggtaaaatagggacctagtttatatcttctcgtatctgtaattccctgtatatatgggatctttttcagaagaatggcatggttttctctaattcagttttatatattgtactgtggattcttctgtaagtgaaaaattctaagagtagaccaaatatttgattaaaaatggcaaccaccttcagaatgcatattagatgagaggcactgagacataatccgttggcttaggtgggatggtgtaagagaggaagcatggtaaaatgataggaatgttggattatgatggaaaatacttccgtactagttctagcccagctactcactagcttcgtgacttttgataaagatcacggtttttggaacttcactctccccatttgtaaagtagagataatgatgtcttatgaagtaggcaagacagatttttatgaggatcataaaaatctcagtaagatgtgattaaagatctatttatgctaacaaaaggtgacatcattttaacaaaaggtactgagacttatttgaatcttgtcctgtggcaaagatgaaaaattcaagtgatatttatttatttatttattttcgagataggatctcaccctgtcagccaggctagagtacagtggcacaatcatggctcactgcagctttgacctcacagactcaaatgatcctcctgcctccatctcccaagtagctgggactacaggtgtgagacgccactccaggctaactttgaaaaaatttttgtagaaatggggtcctactatgttttttgggctggtctccaactcctggactcaagctatgctcctcccccagcctcccaaagtgctgggattataggtatgagccactgtccctaacctctttttagttttaatgattatttaaagcagtgattgtttaacaactttttttaatgtcaattccagtatctgctcattaaaaaattgagtcaagaaatatacagtgaagaaaccccttcagagtaaatagccttaaaataattcccgcccaccccaccctgagacggagtttcgctgtgtcacccagccagcctggagtgcaatggcgtgatctcagctcactgcaacctccgcctccctggattctagtgattctgctgcctcagcctcccaattagctgggattacgggcacatgccaccacgcctggctaacttttgtatttttggtagagatggggtttcaccatgttggccaggctggtctcgaactcctgacctctgcctgccttggccttccaaagtgctgggattacaggtgtgagccactgtgcctggcaataatttttaaggatgggaaaaggactctaaattccactatcctcatgtaattttatttcattctcacttttcagtctaaccattgcatggatttatttatttatttgtttatttatttatttatttatttattttttgaggcagagtctcgctccgttgcccaggctggtgtgcagtggtgcaatcttggctcattgcaacctctgcctcctgggttcaagcaattctcctgcctcagcctcctgagtagctgggattacaggtgcctgccaccacgtccagctgatatttgtatttttagtagagacagggtttcgtcatgttggccaggctggtcttgaactcctgacctcaggtgatcccacacctgcctcagcctcccaacgtgctgggattacaggtgtgagctactgtgcccagtccattccatatttttgaaacaattgtattcatctgaatgattaatgctagctattgtaacaaataccacaactcttagtggcttaccataatacatgtcttatactaagtccagtgtaggtgttctttatcaggttctgtcttggcagctgtcctttaagtgatgactcaggtatgcaggttccttctagtttgggctgctggtgtcctcaatacatggcctctggcatggccagagatagaaggattacttgtgggagatttttaaatggaaatggtccatatcaatttcattacattctattggccataaatcagttacattgtcctttttattttttattttatttatttatttttgagatggagtctcagtctgtttgcccaggctggagtgcagtggtgccatctcggttcactgcaacctccgcctcccacgttcaagcgattctcctgcctcagcctcccaagaaggtggcattacaggcatgcgccaccacacccagctaatttttgtattttttgtagagatggggtttcaccatgttggccaggctggtcttgagctactgacctcaagtgacctgcccatcttagtctcccaaaatgctgggattatagatgtgagccactgtgcttggcctgaattgtcctttttagatggaaaggggactgggaaatgcagtcttactatgtgtccagaaagaaaatgaaacaatttggctactatttggtttaagggtttaagcatttttgtaggccttaaaacatttagtctactgctcactaattggttatatcactagcaatgtatgacagtgccagagtattttaaatttttgatgagtgtctatataatcagtcctggttaccttaacaaaacttctgtgttcttgccccagtgttacctctgataatagtaattaacaccagtacttagcgcattttgggaatttggaaaatgatagcaattattattagaattataataatcataatagtattttctaaaaagaatagtcatggggctggttgaagatcatgttaaaaaacttgtctagagatatgatgaaagcaaagtgccttttttgtttttgttttttctctcttccagctcagattatatcttgaatttaggagttgtcattgactgttttttgaagttatctcaatgagatatctcaatccaatcctcaacacagttagggaatagctggtgacagagcacggggaagtccggggtctggtgttgctgttgaatctggcactagctgtcaagcctcttgagggcatttactccctcttgcgggcttcagttaatttatcattaaaatgaagggattggtgatttctgagcattcctcccattccaaaatgtcatggttgagtgaagcctattcatgaactttgttgggctttacaaacttttaactaccataggaggagctgggaagccctttctttagtaattctagttagtgctgtcgtatcttgttggtcggacctattatgacaaacgtgaatatttgatgatcattgtttggtccttggtatagaacaaccatcataagagaccaattgactcttcttgatgaaccacccataccacctgtttagtggtaacatttcttagtgtcagaagacagttttttattggaagaatatccgaaatgctggtttctaagtttttcttttatttcagctaaatttacagcagatccaaagaagatatgtgtaaaatttaagaagagatgtgtgaaattttttgacttttgacattcttgtagtgcttttaggagattgtttacttatttccaatcaaatactagttattatatccccagagaacaaagccttgtgttaatggatggatagattctaaacttggttcttgttaaaattggaaatttttattttttattttttatttttttgagacggagtctcactctgtcgcccaggctggagtgcagtggcgcgattccagctcactgcaagctccgcctcctgggttcagaccattctcctgcctcaccctcccgagtagctgggactacaggcatccgccaccacgcccagctaattttttgtatttttagtagagacggggtttcactgtgtttgtttcaccgtgttagccaggatagtctcgatctcctgacctcgtgatccgcctgcctcggcctccaaaagtgctgagattacaggcgtgagccaccgtgcccggcccttaagtttgtttttcatagttattttcttacccatgaaatgtaaatgcctgccctctcctggaataccgactgtcttgaatacatcagaagatgaactctatattacttaatttggtgatcttacccaagtctcatagttttatttatttttatttattttttatgagacagagtctgactctgtcaaccaggctggagtgcagaatcacagctcactatagcctcaaccttttgggctcaggtgattctcccgcctcagcctcccgagtagctgggactataggcacacaccaccatgcctggctaattttttgttgttgtttgtagagccgagttttgccatgttgtctaggctggtcccaaacttctgggttcaagcaatccacctgccttggttcccaaagtgctgggattataggcagaagccaccaagcctgggtcaagtcttcaagttttaaatgtcacctgttgacctttcctctgaactcatacccctgtaatccagttgcctactctacagctccatttggggtctagtaggtaacttaaacttgatatgttcaaaactgagcttctgatgttccagctgtgatccatctcctgtattcttccttatatcagaaaatggcaactccatttccttggccaaaaacttggagttatcctggattgtcttctttctcttacatttcacatccagtctttcagcgtatacttttggctcttactatcaaaatatatccataacctaatcacttcttgctatcttcaaaccacagtcatcttttaactacattgttgaagtagacgtttaacaggtttgtctgctcatgcaactccgtcagtctgttctcaactgagatcctgttaaaatgaaagtcacatccctttatttctctcctcaaaaccctcccatggcttcccatctcattcacagaaaaggctaaaatccttatggtttcctagaaggcctttcatgatctggttcttggttacctctctgaactcattttctgctactcttccagctgtctgtgttccagctagctgaaattgtagctgttgcttgaatgcattggttttaactaacttaaagacctctgcatttgccatttgacttggatacttttccttcacttattcacgtgactagtgcttccaccttcttgcagatctttctttttcccccccccttttttttttgagatggagtctcgctctgttgcccaggctggagtgcagtggtgcagtctcagctcactgcagcctctacctcccaggttcaaacgattcgtctgccttagcctcccgaatagctaggactacaggtgtatgccaccacgcccagctaatttttgtagttttagtagagatggggattcaccatgttggccagtatggtcttgatctcttgacctcgtgatccacccgtcttggcttccctaagtgctgggattacaggcctgagccactgtactcagcctttttttttttttcctttcaattctgctccttctgaattgcaggtctttattccacatgtttctcagagaaagtctccttgatcactgactaacccttttataaattgtgattattctcctctgtcttctgtgctttatttttctctgtggtacttaagatcacttgacatactatatgtttaattatttgattattgtatgtctcttcccactagaatgtaaactctatgaaggcagagattttcaggtcacttttgcttattgctctgtccccaatatgcagaactgcagaaccatgcttgacacatactaggccttcaaatatttttgtctttttaatttaattttttaataggtaaaaaaaaatatatatgtgtatatatatataaagatacaaaggttcatattaaggcctccctttcaccagccttctgtcaccctagttttctaccccaccctgataaccactgttactcatttcttgtttgtctttcctgagattctttatgcaaatacaagtacaaatacaaatattcttattcctttctctcctcttttttacacaaagtgtaccatactatttatgtttctgtaccttgcatttttcacttactgtcttagggttttctccatattggttcatagacagcatccctgtattttgtttttttctgcatagttttgcattgaatagatacaccataatttatttactggctcctattggtggacacttaggttgttccagtcttttgctatacacacagtattgcattgaataactttataatacattgttttgtatgagtgacagtatattgatagggtaaatttcataaagtggaattactaggacaaagagaatgtgtacttgaagttttggtagatattgcgaaattgccctccgtgggagttgttttatgtgtgagtgcttttctccccacagcttcaaccaccaagcctatgcaaacttttgaatttttgccaccctgttaggtgaaaaataattttgcagtatagcttaagtttgtatttctcctattatgagtccacattcatagtaggagatagttttgctttgaatagatacaccatatctatgagtattaggatgaggcacttaagcatttgttgaatgaatggaatgctgcagaacagccaaaatatgccacttgaaacatactctgcaatctgtgattgctttgtttctttccgtcttagcatggctacatagagaaatatttatatttaatggtctttttcatgtagaagtaggtcttgaatgatatctttttgaaaatttaggctgggtgtggtggctcacgcctgtaatcccagcactttgggaggccgaggcgtgtggatcatttgaggtcaggagttcaagacgagcctggccaacatggcgaaacctcttctctactaaaaatacaaaaattagccgggcggtggtggtgtgcacctgcaatcccagctactcaggaggttggggctggagaatcacttgaacccgggaggcggaggttgcggtgagccgagatcacgccactgcactccagcctgggtgacagagtgagaccctgtctcaaaaaaaaaaaaagaaaatttccttgtatgattttactcacattgaatggaaaaaaactaaacaattttattaataaaattttattaattttgttttaaataattttaggttttgttttaagcaataaaacttaaacaataacaataaaaattataaaatattttaaatacattattttatttcagcctcgtaacaaccctattatattccaggtgtcattctcctttgaaagatgaagaaattgtgggccataaaggttaattgacctatccagggtcacaaagattgaggtagattgaggactggaactatttttttttaactctacattcactcatttttttatattgtgctataaattttattgataatattttagatgcaatagaatgctacacagtgtaggttcatgtttgtcatattagaaataacctcatactcagcaatttctttccaaattgtatggctcctttgttaaactctcttcatttacattggcatgttcattttgagggtctgctggagaaggcgaattgttttgtttgatttattcagccaggtaacaaagttttatttatttatttattttgagatggagttttgctctcgctcaggctgaagtgcaatgtgcaatctcagctcactgcaacctccaccttctgggttcaagtgattgtactgcctcagcctccccagtagctgggattacaggcacccaccaccacacctggctaatttttgtatttttagtagagacaggatttcaccatgttggccagactggtcttgaactgctgacttcaggtgatctgcccgcctcagcctcccaaagtgctgggattacaggcgtgagccaccacacccagcccccaagttaacaaagttttggaagaaggaatgataccactcatcttagagctagaaatatgtattgcaaaaactgtttaatttagacactttgcagattaagctaaggaattcgctttctcaaaagaaaaagggattatctttcttgtgtttttcactgacttaacagtaatatatactttaattcaaacaacacaagaatatatacagtattatgtaaaaataccctgtaataaaaaacaatagttttaaatcccttatgcttttgttttttgaaaaatgtatggtgcgtgtatgttaggatatatgtatatgtatacataaatacatacatttctaagtttgtattgtcagttaatggttggaataattggttaaccatttgaggataaaatgaaaagaacaatacttacggtttcatagtgttggagaaacagactttttcataagtggtattgtaaattagtataatatttgtatgtaacaatttggcaatatctatcaaagtcaaattgttctttgagcgtgcaatttcttttcttttcttttcttttttttttttagatggagtctcactctgtcacccaggctggagtgcagtagtgcaattctacccactgcagcctctgtctcctgggttcaagcaattctcctgcttcagcctcccaagtagcagggattacaagcatgtgccaccacacctaatttttgtatttttagtagagatggggtttcatcctgttggccataagagcagcatggagatgacttgggcaggataagcagagggaatattggaaggttttcaggagtgtctgaacttctgacacattttgattgcatctttgagttttgtgaccttttccaacatacatgaaggcttgtagagtcatgaaattttaatgcttaccaaggaccttcaattatctgttcaattctctaagttgtcttagagcaataatgagcccaggggaattaaagagacatagtgttagtgacagaggtagaagtaggacttaagtcacccggttgctagtgttttaaccaaaactgtcaaccagttaacctagattaaaacactagcaaccaggtaacctacatcagtattcactccacagtactgcaatgggtaatcattcgagatgtttgagaaaaacagagcggatggagtcagttgtgagggtggaagcggggaaggaagaaggttggagcttttaagggctcaaattagaattggaggaaaaaggagtcagtaaggtaataatcactaaagcaaatctgaaaggttttatccttctttactgaatttttttccctttaaaacactttcattgaatttttacttttttttttaacagataaagatatagagagaataaatcccttgaaaatattttaaatgttttactgcaacatatgttaaaaaaattagaggattaacagttggttaatgggcttattttctttcatatcacttattgttcttttttcttcttttccagaattttatagaagtgaagtgattaagaattccttggtaagtttgctttctgacgggtacatatgactaagtatatacacctgttttcagaaaatgcagaaatgtaaaataagttgaggttcagctctggttttatgatactttaacggatctgctcaattgttaaatcatcattgttttgttcattgctgtatctctagtgcttatgtagtaggtgcttgataaatatttactgaatgaaatgacaagttaatgggtgtagcacaccgacatggcacatgtatacgtatgtaacaaactggcacgttgtgtacatgtaccctaaaacttacagtataataataataaaataaaaaaagaaaaaaatatttactgaatgaactgatttttctgttaagaactttaaatgataaaaactcaaattctatagttttctcacttccatttcctataaataagtttctgattatttcactcgccatatgtcataataaatgatatctttgttcagatatagttcttaagaattttatgcctcgggcttttgtataggatactcctacttgtttcttggcagtggcattgctcagttggaaagttgtaaatatcctacttttgataatgtatacactggatatttgcataaatggctcaatttattaggctgtgttgaaaacaaagaagacctttctggtaatgaaaatatcttagtaatggtccagtaccatcttggatttggcccttgtctgcttttccacctcatctcctcctcttttccgcactcattgtgttccaggtgtacctctttcagtgcttcaaacacacaaagcttatcttgttccttatgtctagaacacttgtttcctcagctgttcgcttgactgaagaggtcttcaaggtctcagctatgtcacttcagcaagaccttctatggctatctcatctagagcagttctctttccccagtcatgctttttcatgaccctgttttattttctttaaagtgttcatcactgttggaaactcttgcttgcttacttgtttgtgtttatgaactgcctcccacctgctagaacataagttccatgaaagcacgggccctgccaatctcgctgctcctgttaccctggagtctagaatagtatagatgctcagtaactacttgttaaatgaataaagggttatcaatgatgtgttgtatttacatgttatcccattttgatccttagaacaacctgtaaagtagatggggcagatcttaggaagctggtacccagagagttccaacaacttttgcagagtcagaggactgcaggaccagaaccccaatctagaccttctgtctttgtctctactctttcctcttcatcaagctgtctttgaaatgtctctaaaatatcaatagatttggattctaggccagacagttccttgagtccatctctggggaggtcccatcaccagtaaagctctggttctacgtatattatatgatataaaataagtgcctagcatcatgcttgatgtataatagttactgagtaaatattagtttttcctcctctccttgctcaggtggaaacagaaatagtttgcagacagttaagagctaggagtgattatggggaagatagaacagaattttgtgttcatttattctgttctcttttccatagtcaaatgttggggatggttttttaatatccattgcttttcccccagatttgtgttataatagaccctatgtcataataatagaccctatgtcataatggcactttagtgtattgttctgcattattagtattggatttattagatcttcccttggctcccaaatccatatttctaaagatctctgaatgttaactcctatcttcaactccttttggcctccatcttcaattgctttggagctatctgtgaggtcatgataccttcatcctttgtgcacttaggtggaatattgtctccaaagaatactgtagaatggattcaagacaagggggaggattggactaaaacacttgtaggtccctttcaactcacagtttatactataattgttttccgaatgtacctcatacagtgtttgcttgcattgtgatttcatggacattctgtttcacaaagtagatcaaatctcctggaggtcacagactgtatgtctttatatccccttagttcctagtgtatttctattgggtagttgtttgacaaatattaattttttgatgttccttttaaaggtattctttgagattttggcaaggattctttttttttcttttatatcttaataaaggttctattaactttttttttttttttgagacagggtctctctatcacccaggctggagtgcagtagcatgatctcagctcactgcaacctccaccttgtgagctgaggcgatcctcttacctcagcctcccaaggagctgggactacaggcatgaaccaccatgcctgactaatttttgtattttttgtagagacagggtttcaccatgttacccaggctggcctggaactcctgacctcaagcaatccgcctaactcagcctcccaaagtgctgggattacaggcatgagccactgtgcccagcctaattaactctttctttctgagggagctcttttttcttagctttttgctaattcattgtgattggttcagattgatgggcattgggcagtacaggagtcaacaaccctcagagaatatgccagagatggcacgttgttactgcccttcttgctgcctctgaagaagcactgccaggtcaacagcagaattggttggtttctttcctgtttaggattttgcgatttttaagctattgtgatatttgctgaatagttagtcgtttaaatgcttttgtatttatttgttaccattgtgcttggcacacagaagacgctcagcaaatgtttcttgaataaatgaattcttccctaaggatatttattaacttcgaagttatatcctgaaactgcaaatcttcaattagatactaaaggattaggcaaagatttgaatactttatttctaattaaggctttgagtaaattttcactctggtgaactaagttggactttgataagcttgtaagtatctttttcactcatgtaactttgagatacagaatgttgttccttgtttatattctgagcttggttcttagaccagagtggcttggtttcatcactctgacgtcaaaggagacatggaaaaatggactcaagattaaaaagaggccgagtgtggtggcctacgcctgtaatcccagcactttgggaggctgaggcgggcggatcatctgaggtcagaagtttgagaccagcctgaccaacatggagaatccccatctctactaaaaatataaaattagctgggcgtggtggcacatgcctgtaatctcagctactcgggaggctgaggcaggagaattgcttgaacctgagaggcggaggttgcggtgagccgagatcgtgctgttgcactccagcctgggcaacaagagtgaaactccatctcaaaaaaaaaaaaaaaaaaaaaagataaaaaagagtgttttcccccaaatattagataaactgttcttatgcccttattctgtgcttctttctaactcttgaatactccagatcacctgtccaataaaactttctgcaatgatggtaatgttctacgtattgttcagtacagttgccactggccacatgtggccattgagcacttgaaatgtggttcagtcctactgcagaactgaattttaaattttgtttaattttaatttaaatagccacatgaggctagtagatatcatattagacagcacagttctagatgcttctgaaaagctttctttttttttttttgagatgttgtcttgctcttgtcgcccaggctggggtgcagtggcacgatctcggctcattttaacctccgcctcccgggttcaaatgattctcttgcttcagcctcctgagtagctgggactacaggtgcccgccagcatgcccggctaatttttgtatttttagtagagacaggatttcgccatgttggccaggctggtgttgaactcctgatctccggtgatctgcccacctcagcttcccaaagtgctgggattacaggcgtgagccaccacgcctggccagggcttataatcattaacaggaagaaatttcacctttttgtttttttaaaagtagtttggcccaggtgcagtggctcatgcctataatcttagcactttgggagaccaaggtgggcggattgcttgagcctaggagttcaagaccagcctgggcaacatggcaaaaccccatctctaccaaaaaatgcaaaaattacccgggaagttgaggcgagaggattgcttaagtctcagaggcggaggtttcagtcagccaagattgtgccactccagcttgggtgacagagtgagaccctgtctcaaaggaaaaacaaattacttcgagctgagcgtggtggctcacacctatatcccagtactttaggaggctgaggcaggaggatcatgtaagcccaggagcttgagatcagcctgggcaagatgacgagactcccatctctacaataaataaataaataaataaataaaataaaataaaataattagctgggcatggtggtgcatacgtgtagttccctgctagctgggaggctgaggcagggggatcccttgagcccaggaatttgagattgtggtgaactatgattgcaccactgcactccagcttgggcgacacagtgagaacccatctcaaaacaacagcaacagcaacaaaaactaaataaaaaactttgtgcttttttttttaataccactagtctcatttataaatccatataatagctttttgtatggttgtcttagcttctttggtatgtaataataaacttcagaaagcagggacctcatgtggttcatgttttaatctccatagtcattgtatcgtgatttgctttgacttggcaaacaaacaaaatatgtttagtatgtcatatatgtatgtatccaaatctaagtttctggctgtaagactcactgttattttacatttacaaaaaatagttaaacattctaattaaactgaacataaggcctgagcaatagtcttatgagttgtgattcaattttactaacctgttgttactttggagtttcttcaatccattccaagatatttagcagtctttccttttttcattatttgacttatgataaggaatcctattagcaataaaatatttacttccttaagtcctttaaagaggttggatgcagtcatttctccagtgacagatatttgcttctctaataccaaattcatgcctcattgctctgtttctgtgctttctgcctacacaaaatcttaatactttttattgaagtttggcatttatagaagagtttatagttcataagtatacagcatgatgaattatctcaaactgaatacacccatatatccagcatccagatcaacaaatagaatattttcagctcttaaaaagccctctcctcccctctccagtcgctgttactttcctgacttttaacaccataggttaattttacctgcttttgtatgaatgaaataatatcgtatgcactcttttgtgtccgattgccatgtttcaactttatgtagtaagattcatttattttttgggacgtatttgtggtttgtttgctctataatattccattatgtgaaatcacagaattgactcattttttctgtggataggcatttggttaggttctagttttgagctaacataaatagtgctgctataaacactctcctatatgtcttttggtaaatgtatggatgtatttctgttgagtatacatctaggagtggaattgctaggaatatgcatatggtcagctaaagctgccaaatagttttccaaaattattgtttgatttatactctcacccccagtctgcaagagttctgtttacatggttgtgaacacttgatttttaaaaaaccttttgaatttaaattgttaaatattacaaaattttttgtttcagtataaatcaagagaaatattttaaatggcaattaaacttagcagcacatgtagtgctaacattgtgcctaacttaatatcaaacacggctacttttaagggtgtgcgtgtagatacaatgacactggatgactgccacctggtggtcaaagattgtaggactttattgattttactatttctaaaatcagaattcatcttacaatgtgaaaaaatacgcacgttagaactggtgagtgggactatgttggatggtaataaatagaatggagtagactgaagcagaataagggagtacctgccaggggagattgcagtttttctgcagcagtcacatgggagatgtcacttgagcagacgcctgacagaagtgagggaacaagctatatagctatttcaggaatactgttacgggacaagaaacaggaaagtagaaagacaggagtgtacttgaggtgttcaagaaatggctaagaagttagtaaggctggagtgcagtgagcagaggtggtttgaggtgttgctaggcacataagacagagagacaggtgcaagagaattgaggatcaggacagcagagggaatggcctggagcaataggagatgatggtcaagggctaaggagcatgagaatgagattttggaaggcatagcattacaattaatgcaaaatggggcacatctggtggaccaggaccctcaccttatccatgatatatttagcatagaacaattcatggtgaatgtatagttcagtgttaaggtctctggcttcagctagctgtgccctccatatcatctcttcttgtgttcagggagaggttagatccttgatattattgaaaggtcattgggttaataagtaaaattattgaagcaataacaatataagtgactaaattctctgaagttggtttctcatgtttataaaagagattaattatattgcaaacccacatctgcctttaacagttacaaagttaatctactcattggttattttcccaaaaacaagttttaaacttttattagaatattaaaaatctcatggtgggagtatactgatagctaatttgtgtgtgttttgaaatgtctctgtacctggattttttaaatgaagaagaggtatcaattataagtacccacctatgattgaagtagcatgttggacatgtcatatacattatttctcatcctgataatagcattccaagctaagagatatgcttgttttacagctgaggaaccaggttcagcaggctgaggaacttgatctaggtcacaccgctaataactagtaaaaccagtgttccagagccctgctgttttgcagcctcccttatatcccacttccttccactgattaagtctgctagagggctaacagaggtcactgataggctttatcattgaataaacaatttctagagcatgcattttagggaaagcatgtggcataatttatcagaactataaagttctgttgagattgtgactgaggagctgtttttaaatctttgggaaaaaaactggctaaacagtacaaatactttttatgagttactggtctgagtgattctcaaaccaactttatgtttcagttgaattatgattgaatgaattaacattgagtgtgtgtgtgtgtagcttatgtcagattatgttactgtcttttaaactgcatcatcttcaaggttttccaacttctgtctgtttaactacatgatttgaagggagacagagataatcaacaaatcaacacatggaattatatgtagtaccagggaagaacaggatgccatgaaaacatgtaaaagtgttatttatgttagtttggagggagaagttaggaaaggtttctaacaattagtaatttctaaattgagataggaagtctgaataaaagtgaatgagacagggaaagagagtttattgtgttaatagtaatgataaaatcagtatgctattccagtgagatgtgttgtatggtttcagaaagttagaacacattttatgagttcttggttgtgttcttgtaaccatacatttgttatcaagcaacagtaataaataatggttttatgtcctcttgtgggtgtgtggtagacagtgaacttttcagagcttataaatatcctgatattctacttttcagtgaatgtggtggtacaggtccctggatgatattagtacttgattaatttgttccatgtagaaattgggcgggtatgtataggttaaatataaataaaaaaatcatctgggtctatatagtaaaaatagtaggctataaaatctttgaatgtgtggcaggctgtatctgcctgtatctgaatgtaccaacttaggaattattgctcattgtctggcaactgttttgtaatagtataaaggaaagtctttgtaatcagaagattgacaatagctctactgtatcagtgttgtattggcttagaaagaacacccaggtcatctattcaaccacatgaaataacttcaaaaaacttccctgtcctccagaggcatttgattttgaatgaagtatttaagaatatttgctacaacaacccccaagagtatctatccctcttccttgccatgcattatgccccttcagatacattcaccaagtgtcattttttcactttgaaaggaggtattattttctgctttttctgatactttatcactctaatagtaataggaaattatgctacttcatattttagtatatatttactcttattgaaaggtggtcttaaacaaaggggagtaaatgactaccttttagggtggtataatttgaagaccaggagggtttaggctttaggacatacatcaggaagagatgacttcatttgatttatttcagtggggcacctgttgttttttcccttgttggatctttaaaaaaaatagtttaattactttttattgagatattgtacacatctagtaaatgcacaaataatagccttatgacttttcaaaaggaactgatcaatgaaacacgatcatcttttgcttttctttgctttattttatttttttttttgatacggagtttcactcttgttgcccaggctggagtgcaatggcgcgatcccggctcactgcaacctccgcctccaaggtacaagcgattctcctgtctcagcctcccaagtagctcagattacaggcatgtgccaccatgcctggctatttttttatatttagtagagatggggtttcatcataacatgttagtcaggctggtcacgaaccccagacctcaggtgattcgcccacctcggcctcccaaagtgctgggattacaagcatgcgcccctgcgcccggcctatctcttgcttttcagtcactaccttttcccagagagaacctctcttctgacttctaacaccatagcttagttctgcctggttatgaacttttacatggcatatgccctttttttttttttttttttttgaggcagagtctcgctcttgttgcccaggctggagtgcaatggtgggatcttggctcactgcaacctctgcctcccaggttcaagtgattatcccacctcagcctcccaagtaggtgaagtgtgcaccaccataccaggctaatttttttttgtatttttagtagagacagggtttcaccatgttggccagattggtctcgaactcctgatctcaagtgatccgcccaccttggcctcccaaagtgctcggattacaggcacgagccaccgcgcccggactgcatctgctcttttgctcagcataatatttgtgagattcgttcatgttgtatatagtagttcactaattctaatgaacatatcctttgctgaacatatgtgtgcctttctctgaggtaggtacttagaagtggaattaagtgctgggttgtaggttatgttcagctttagtagatattgccaaataattttcccaagcatttgtaccagttacatcttaccagcagtgtgagatttttagttgctctatccttgcccaaacttggtattatctatctttcaagttttagccattctggtgggattatggtattatgttgtggttttagtttagtttaatatggtattatgatatttatgttgtggagcacttgttctggaaaatcataccagttaatgccaattaggaataaacaaatcccgaacaagtattggagtctttttaaaaaaattgatgggatatatttgatctaacttgatagttaacaagctctttttcatcttctttttgactgttcaaggataagtggagttggtggtctgttgaattccagtttagtaaaatattaccatttgagtttttcatatccatattaccttttaatggatttccttcctctcccctttcttaaataggggaagattattcaaccttttctcaacaagtcaaggttatcatgaggaacattaatgattatattatattcgaacttcaggggctgcctgggacataaggctccattattcttactttagacagtccccacaacatggccttcctcgtatacaaagtgatctaatgctgccttttttttttttttttagacggaggctcactctgtcgcccaggctagagtgcagtagtgcgatctcggctccctgcaacctctgcctcccaggttcaagcgattctcctgcctcagcctcctgagtagctgagatacaggcgcgccccaccacgcccggctaatttttgtattttttagtagaggtggggtttcaccatattggccaggctggtctcaatctcctgaccttgtgatctgcctgcctcagcctcccaaagtgctgggattacaggtgtgagccaccactcccggcctgctggcatgattttagagtcagtgtcagatattgactttgtcttcctgttccagatataaccaaccatatgacgttagacaagtgacttaataattcttagcatcagcttctcctgaaaaattgggatagtgctgtctgtttcacaggactcttgagtttcatgaagattaagtaagaatatatagtcaaattagtagtatagtacctggcacactgaacctttggtaatggtgctggatattgtagaggataaatacgctagtagaaatccctgcctttgaggagctcacgttctggaggggaagacaggcaaaaaaatcagtgatggtgatgtgtcatgccaggtgccgtaagaaagttaaccactcacaggttcctatgggagcatagaggagcggcagccagccccatggacatcagtgaacacacagctttcattgttccccctttcttgtaataattataccagtagtaaaaatgagtaaaatggtttttattctctatttataaagcatgattcatattaggtgagaaagcgaatcactttttccaaatgaatcttaagctatgctttctggtcttggccttaaatttaatatttttgaccccaaagtgattaggtcttgttgcagcaaagtgccaggaatagttttttttttttaattctgcaaatatttgaatacttactttgtctccaggttactgtattatctacttgggaaaacaatagcaaaaaaagccccatcctcgcagtcggtggcaggcagagaaggctgacagttaaagagaattgggaaggcttctgaggaagagatgtttgaactgaaacctagtggtcagagaaacgttaaccaggaaaagaatgggtgggggtagaggcagggagggggtcccaccagaggctctcagcttcctcatttcagaacttgaggtggactaggcaaattcaaaggtcccttttattgctttcattcctagcatatgtaagctagaggaagccctcattttgtctctttctatgttgtacgcagcttgcttgtttgtcctgtagttcatgttaaattaaatccggtatagtgctcagcatgtagtaaatggctcacaaatgattgccattactcatgtaaggtagagttggtgaagggtactcagttccaggggagcaggcacatcctcaggctgcaggctagaaggcttttccccagcattcctagctacagttttctcagcgtcctcggtggacagttgggtgaaccagtgaagggccagttccttcttagctaatctgtaatgaatgcttcattcttgtagtagtggtctaggctttgctattatgtttagtcgtttgttttgtctcagctctagtcagctgtagagtctggtgatggagcagcaagagcaagtgtgagacctgtggagtctccccagttctttctctcagagaatagggcataggcagagggcagagttctttcttccttttctgcctctggctgtgagatataaaataaggaaattgttgacattctctttagcccgcctttgttctaaattctgtcttttgtaatttggtagaaagagaaaaaaaaaacaacaacacacacacacaaaatgaacatgagacaaattctagagaactagattcaaattctgatactgtttttactaagtgaccttaggcaagaagactcagtttctgtgttttattgatttttaatttttcacaatttaacattcctgcacaatctagatgcatcttaaaaccagttctttttggttgtatatacaattatgatgcattttatgattggtgatgtcttggatttgatgaaatatggtatttcgtcttaactattagaattaacaaattgtcttatttacttcatgtggatttattgttaggattaacaaggcttattcagcagattaaatatttgtatgtgctagaataagcattctctatgccctttttatctattattaatactttatatagtgactgtcactagtaagtattaaaatagtagctattgctgtaattagttttttattactattctgttcaagcttcataaaaaccctgtgaggtgatagttttataactgaagattctgagacacagggaattatgcagttcaacaacgtggcttcattatagcactttcctctctaccactctgcctgtcagctctcttcatttttcagaggaaaggctgaagctacgtgattctttaaagccattccacaagccagtggttctgtttgggtgacggtctgctgctgttcccaagcccatccacgtttctagtgattactcctatgtctgcatagcttagtggtcacccagtgattcgtgactttatgcttagatacctcaagccagtaacttctgccagtggattgtgaattttgtccagttttactgttgctttttgggggaaaaatttgctgagctactcattttatcatgtcagacatcataccccttctttagatttactcttataggtaccatttatttgctattcattcattcttgcagcaaaaatgttctgagttcactttgcctaaagtgcatcctttaggattttctttagtgagcatatgttagtgtcacactcccaagtttttttgtctgaaaatgtattcattttactctgatttgtgaagagtattttcattgggtggatttcttggttgtcagttacttggttttatgtgttctgatatggttttatttatcttgcttaggacctgttacgtatttaaacctgtgaattagtttttttttttttttaatcagtctaggaaattgctacttatctctttaaataattccttgcctccttccttaatccattttctctctctggactgcttgctaaatgcgtatcagatctttttactctgtcatccatgtttttaaaccttttttttttttttcatattggtctttttatctctgctgcattctgtgtaatttcttcttccaaggaaggttctcctctcatctgtcatggcaactttccctacagacatctgtgtgtagggatttggtggatttagtttagtttcacttatgctgtttaggggtatagcccttttgtggtcctcagtgtggagagggacattttttagtcatggatgggacctgggcctggctcttgaattatgtccttgcttcctttaagaatgccaaaactggccacgtgcagtggcttacccctgtaatcctagcactttgggacgctgaggtgggagcattgcttgagcccatgacttagagaccagtgtgggcaacatggtgagaccctgtctctaccccaaaaagaaaaaaagaaaaagaatgtgaaaaccaaagccccggctttgtatagatccgtcatggcttcacgacaaagacctctagatctccacttacctctctgggttctttcttccttggtttggaaattctttgatgttaatggtgattattattattatttaaaaaatattttacctgacattttagttgttttcagtgagaggattgtctcatcagtcattatcagaaatggatggctcccttccattcacccattcacccttgggccatatagtcttttatatttacccacatgtttacaattgccagtgctctccattcttttgcctagatccaagtctatatccagtgttgtttccctttagcctgaagaactttgtaagcatttcttgtagtgtggatcagcatagttactcccagaccttattgttgtcttcacatttaattgaaactctgcccctatttagcagggctgctaaaacagttatagtgagatacagactggaggtcatttaagagtggaattctgttgatcttagactgaaattcttgcatggctagcatttagtttttatacaatccagtataaaactgactgcataaatgtgtgtgctaggttatcatcatgttatttgtggtagtatttcagtgtcctctcccaccttacactttggtcaggaaaaaaaaaaaaactgccacaaagccaagaacagttagttacccttatctgaagaccctttgatttactgatttacataatatgaaaattggtaataggttgattttgtttacattcagcagtgaaagcccttatgttttttttttattttttattttttatttttatttttattgatcattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttggggggtaaggtcacagatcaacaggatcccaagacagaagaatttttcttagtacagaacaaaatcaaaagtctcccatgtctacttctttccacacagacacggcaaccatctgatttctcaatcttttccccacctttccccgctttctattccacaaaaccgccattgtcatcatggcccgttctcaatgagctgttgggcacacctcccagacggggtggtggctgggcagaggggctcctcacttcccagtaggggcggccgggcagaggtgcccctcacctcccggacggggggtgacccccccacctccctcccggacggggcggctggctgggcggggggtgaccccccccacctccctcccggacggggtggctggccgggcggggggctgaccccccccacctccctcccgtacgggtcggctggccgggcggggggctgacccccccacctccctcccggacggagcggctggccaggcagaggggctcctcacttcccagtaggggcggctgggcagaggcgcccctcacctcctggacggggcggctggccgggcggggggctgacccccccacttccctcccggacggagcggctggccaggcagaggggctcctcacttcccagtaggggcggctgggcagaggcgcccctcacctcccggacggggcggctggccgggcggggggctgacccccccacctccctcccggacggggcggctggcctggcggggggctgacccccccacctccctcctggacggggcggctggcctggtgggggctgacccccacctccctcccagacggggcggctgccgggcggagacgctcctcacttcccagacggggtggctgccgggcggaggggctcctcacttctccagacggggcggctgccgggcggaggggctcctcacttctcagatggggcggttgccgggcggagggtctcctcccttctcagatggggcggctgggcagagacgctcctcacctcccagacggggtcacggccgggcagaggcgctccttacatcccagacggggcggcggggcaaaggtgctccccacatctcagacgatgggcggccgggcagagacgctcctcacttcgtagatgggatggtggccgggaagaggcgctcctcacttcctagatgggatggcggccgggcagagacgctcctcactttccagactgggcagccaggcagaggggctcctcacatcccagacgatgggcggccaggcagagacgctcctcacttcctagacggggtggcggccgggcagaggctgcactctgggcactttgggaggccaaggctggcggctgggaggtggaggttgtagcgagccgagatcacgccactgcactccagcctgggcaccattgagcactgagtgaaccagacaccgtctgcaatcccggcacctccggaggccgaggctggcggatcactcgcggttaggagctggagaccagcccggctaacacagggaaacccagtctccaccaaaaaaatatgaaaaccagtcaggcgtggcggcgcgcgcctgcaatcgcaggcactcggcaggctgaggcaggagaatcaggcagggaggttgcagtgagccgagatggcagcagtacagtccagcttcagctcggcatcagagggagaccatggaaagagagagagagagagaccgtggggagacgggacagggacagggacagggagggggagggggagggagagggagagggagagggagacccccttatgtttaatgtaggggaaataagcaaaagtagttgatgtattacattgtagttcattcctttgatgttatgaaagctccttaacattttcacttttcagagagggtttcgactccctggacggttctcttaatgagaaataatgttctttcagagcataaagctgaccttgttattttcaacttgaaaacatttcaatggccccactgttgtacagagtaaagtattccctcctagcaaaaggcataaaagatccttcagttcagttccttgtgtgtctgtccagctttgtgtcctgccacttttgtattgtgtgctccagcagtagtcctgagtgccctgaccacaccttggcattttacacctctgagcccttttcatattgtgttcctctttgcctgaaattacttattttaatctggtgaaagcccacttatctgttaaaagccaggtttcacagcctttgtgatgtcttcccctgttcatcagtttatttttcctttctcttctgctgtgtagccttatgcataattctgttattgaactttgcacaaaacagtgtaattatttaaatggaggtttgaatccaacagtaagttggagcctctttgagggcattgtttatgtgttggctgttaataatcacgtattaagtgtcgaataaatgaatgaattaccgtatgaaaccatgtaagtgagtgataggaatatacgcttcttctaatgactataataagtaagcagagaaattcaaaagtaccattatcaccccttttgtgttaattgtaatgtcttcttggcttacttaagtttgcaatttaatgtatttatgaggtcttttggttttgaaaaacaaaatgatttgtcacctaattgaaataatcgtaaacaaatagagttgtcctaaagcgtgttttcattttcatgagcagaatcccacgtggcgaagtctcgattttggaattatgccagaccgtcttgatacatctgtgtcttgtttcgtggtgaagatatggggtggaaaggagaacatctaccagctgttgattgaatggaaagtctgtttggatgggctgaaatacttgggtcagcaggtaatttttagactgtagtttcaagtagttgtcatctccaaattaacgtgtctaacctttctgttgattcttctgattctgcgtttcctattataaagagagacttttatgactgtttacttatatcactaagagagaccttgatgatcatttacatatgttattatttacttatattacttacattgttatgtttgaatcattgcctagtttaacaaacacctttgtctgaagaaatttatgaagatggatttgtgtgtgtgtttaggaaagaatgtgctttctcatagcattttgctttttctgtcttactggatgtcctcacctagaatctgaaaattaagttgaaataaggaatatcacgttaaatacctctcttttgaccagtagcgttattccaggaataagaagagctactatttattgagcacaggatgacacctgcttggattatttgctgccactggttctccatctctgctgtacccatgactgatgtagctagtagattacagttctctttttttttgagacgaagtttcactcttgttgcccagactggagtgcaatggcgcgcaatctcggctcaccacagcctccgcctcccaagttcaagcgattctcctgcctcagcctcacaagtagctgggattacaggcatgtgccaccatgcccagctaattttttgtattttagtagagacagggtttctccatgttggccaggctggtctcgaactcctgagctcaggtaatacacccgcctcggcctcccaaagtgctgggattacaggtgtgagccactgtgcctggcctctacagttctcttttaactgggctcaaaagtagctccataatattttctttcttcctttcttttatttacttctttttttttttttttttttttttttttaaattaaagacagggtcttgccctggtgcctaggctggagtgcagtggtgtgatcatagctcactgtagcctcaaactcctgggttcaagtgatcctttccgcctcagcctcaatccctcaatacctcctgcctcagcaagtagctgggactacaggcaggcgccatcatgcccagctaatttttatttttatttttgtagagatgggtgtaaacatgtgagacaggtctcagttaatttagaaagtttattttgccaagataggatgtgcctgtcacaccgccccagaaagacgtgcccaaggtggttggggcacagcttggttttatacattttaaggaaacatgagacatcaatcaatacatgtaagaagtacattggttcagtctggaaaggcaggacaacttgaaacaaaagcaggaagactcgaagcagggagggagcttccaggttacagacaggtgatacacaaacggttgcattcttctgagtttctgattagccattccaaaggcggcaaatcagatatgcatctatctcagtgagcagaggggtgactttgaatagaatgggaggaagggcccccaagcagtttccagcttgagttttccttaatgattttgggggcccaagatgttttcctttcacattgggttttgctatgttgccctggctggttgtgaacccctaggctcaagcagtcctcctgccttggcctcccgaagaactgggattacaggcatgagccatggcaccaggccttcagaatcctttctaacagtgttccaggacaaaactaggaatctgttagaattgtaaatgaaatgaaacctatttgctatcatcagatatagattattataattaatatttatagcaaccttgtgaagtttgatattattgcccttattttccagatgaaaaaaattgagcctcagaaactttaggaaatgattcaagatcacacagctggagctaagatttaaattcaggcctggctgatttaaaaattcattctctttgtcctatactgcactggtatatacatgtggtccttggtaaccccccaccccaccttggaatgaatctcatttctattttgtgatgcctatggtactactattaaaggtaaccataaaatattagtcatagattatctataaacatcttgatgctttcttcatatttattcaatataatactttctgagatgtttcttattaaagaaacaacttaattctgcattttttcaggttaaaaatctgaaaatctgggccaggtgtggtggctcatgcctgtaaccttgggagcagtttgggaggctgaggcgggaggatcacttgaagccaggagtttgataccagcctggccaacatggcaaaccctgtctctactaaaaatacaaaaattaactgggcacagcggcatgtgcctgtaatcccagctactcaggaggctgaggtgggagaattgcttgaaccggggaggtggaggttgtaatgaaccgagatggcgccactgcactccagcctgggtgacagagtgagactctatctcaaaaaaaaaaaaaaattttttttgaaaatctaaaaaaaactaaaaatctctgtgctcattttgcttaccatactttttatttttaaattttttacctgtagtcaccatgctgtagtctcgtgaacttattcctcctatttaactgaaattttgtatcctttgaccagcatcttcccaagcctcctcccctccacgcagctcctgctaaccaccattctactctctacttctatgagttcaacttttttagattccacggacaagtgagatcatgcttttaacatattttttttattttgtgtcctatagtgaccagaacagtgcatataatatatatgttctttaaactacattctaaactacaatttaaacattttttaaaaaatcttaatttttttctctgttttagggattatcttaattaaaacttagaaaataatgacttttggtttaggccagggcctttgttttcttttttgctaccaggtacttgttgcctttagactgaccaaccagatccctgcactggggtatatatcccatctatcttcccacataccatacttggctctctttggatagactctgatattaagtacttgtttctcttctacttgaaagtatctatatttcatggaggatggtgcttcttaacgttctggttgcagggctctaggcctgaagggcttttttggctagtgaagatgggtttcatcatgtttttcaagtcacactttccttcggtggtggtcttgttgccatacccagctgagcttatatctaaccagccctactttcagagagttggcattcaggtgtcttcatataaagtcagttatgctggagtaacagagaacaaaaaaaaaaaaagaaaagaaaaaaaaaaaagaaaaaacatgtttcttaaagccagatagaaacttaagatcattgtagaaagtcaaaacttatctataaaatagctataacaagtaacatactgctaaaaataagattaaatagagttataaagttttggaggaacatgaggctaagatgttttaggataatagccagaatcagttaggttcattgatagatcatatactttctaccaggcattgttctttgtgttaaggatccagagatttgtaggacaaggttcttagacccggtgtactgatgattgatgaataccttcatagagagctgtgagagtcgtacggggaagagatatttagaccagcttgtatagaatcagggaggaatgacttctgaataaagtattttttttaagttaggtttattgaggtacaatttacatgtcataaaatccaccctttttaaagtgtgcaattcaatgaatttgaaaaaccgatagagttgagtaaccaccaccataataaataaagctactatgaatatttaaatataggtctttgtgtttcttttgggtaaatctccaggaatggaattgatgggtctaatggtaaatgtatgttgaaatttataagaaactgccagttttccaaagtgactataacatcctgcattcccatcagcaatgtataatagttctgtttgtttcacatctttgctatcacttgtgattgccagtctttttaaattttgaggtggtatctcattgtagttttaatttgaattttcctaatgacaaaattaaattgagccttgtaagcaaaaagtctatttgagatcagtctctctctctctctctctctctctctttctctctctctctctgtgtgaagtgttcagatcttttgctcatttttaattgggttgtttgaattattgagttgtaaagttctttatgtattctggatataaatcagtcctttataagatatgtattttccaatattttctgccagtttgtggcttgtcttttcattttttaatgttggtgaagtccactatgtcagtttttgctgttgtgttacatgctttttgtgtcttatctttgcctaacccaaggtcacaaagactttttcctttgttttcttttgtaagttttcttctagaagttttatagttttaggttttacatttacatcaatgatccattttgaattttctatataaagtgcaaggttcattgttttgcagatggatgaacaattgttcctgtactctttgttgcaaaggctattatttctccattgaattaccttgtcatctttgttgaaaatcagtagttgagaatcatttgtgtggttctgtttcattgatctgtatttctgtcttaatgccaataccaaattgtcttgattactgtagttttaaaatgtgtctagaattcagtcaatgagttcttcaactttgttcttttttcaaaaaatttctggctattctaggtctttggcctttccatatacactttagaacagtttgtccatttctataaaaatcctgggattttgatagatgttgaatctaagaaaatttggggagaattaacttcttaatagtattgagtctttcagtctatagatatgtctctccatttataaaaattttcttgtagttttcagcatacagatcttgcacatattttgttagatttatacctatagatttttatgctaatttaaatggtatttcttttttaatatttctgttttcaattttttttgctagtatatgtagaaatatatatctctgtactgagcttgtattctacacccttgctaaactcaaaaatcaaatctggtacttttttttggtagatttcttttgtagattgcttacatgggtcatgtatcatcctaacttgcgtgttatggaagaaattcttgtgcttagtttaagtggttagaactttgtattaataacaacaacaattgtatacctcttcagtgtttgggtatctttttacatacatacaatgacctgaagctttttgaagatcatgtgaacaagtattgttttcttcctcagtatttaagaaaacagaagctcagaaagattcagtgatttgccaaagatcgcgcagtgtttggtggatttaggccattagttgtttcattgctcagactgtatgtattattcatttcactaatcctagcagctgtcttaaaaagtatgctgtttttcgtaaagatatcaaaatacgaggttgtggttaagttctaagttctatagtttccatattaggattctaatacaattattgttaggccattaacctataattgataagtaaaggatagtacacattacgcttattagcataatttagcagttcggaaatgtgcacagtagtgtgcaatatgatacagccagttttgttaagcatatttattagtcaggaacaaagggatctttctgagttttatggttgccttattcctaatacattattagattttttaatcaatgttttttacatctaatttccaaaaatactttcatatcttattatctcaccgtttttatgacactcatgcaaggtagggcaggaaatgttttctggtttttggctgatgaaggaattaaagtatataccattaacattgataaactactatatgttggatagagtaggggtaccagggctgtaaaacaagtcagagttcccttctctgaagagttccttaagaaacagttaaagttggaattagaactcaggttacttactttttaaccccgtatcttttcaagtactagtactatattgtttcttatttttcaacaaactattttaatgcacgtcttcatgaagtttacactttgagaactttaccttcatgttagatttgtttctccccatactctcccatccctttctttaagtgtatatttttattttcttctaattttgtttgtggacaatttggaaaatttagaaaagcacagaaaagagaataaaaaattacacgtaattcttctgcccagctgtaaccattgttaacattttggtgaatataattttaatctttttttccccaggtatatatgtgtaaaaatgttttatgtttattaaatttcaggatccttctaatcttgagactgctttcataatgttttctcttttccaaggtgaaaaactccttgagattgatttatagtttttattttaaacttatgattgcagacttatcttttggtattgtattcagttcagtaaatgatgtggataaacagggagtatgtgattaattttgctttggtgatagaggtaggagatacagaagtcagggaagtgttcacaggaatcttctgctgctggctttgactattttccatctctaggtagagaaaggagagattctgttctggtagtccctcttgtctttcccccacttgaactttcacttaaaaccttcacggcagaagaattttttttttttttgccacaactctttctgatgaagtaactaaagctatttatatatttcatagttggacactttatactacttcgagttttttttttaatctgagttccttaattttgttttttttttttgagacggagtctcgctctgtcgcccaggctggagtgcagtggcgtgatctcggctcactgcaagctccgcctcccgggttcaaacaattctcctgcctcactcagcctccctagtagctggaattacagatgtgcactgccacgcccagctaatttctttttctttctttctttttttttgagacaaggtcttgcttggtcgcccaggctggagtgcagcggcgtgctctcggctcactgcaacttccgcctcccgggtacaagcgattctcctgcctcagcctcccgagtagctgggattacaggcgcccgccaccatgcccggctaaattttgtgtttttagtaggcacggggtttcaccatgttggccaggctggtcacaaactgctgacctcaagtgatccgccgccttggcctcccgaagtgctgggattacaggcttgaaccagcgtgcctggcgcaggtttttttttttttttttgagacggagtctcgctctgtctcccaggctggagtgcagtggcacaatctcggctctctgcaagctctgcctcccgggttcatgccattctcctgcctcagcctcccgagtagctgggactgcaggcgcccgctaccacgcccagctaattttttgtatttttagtagagacggggtttcaccgtgttacccaggatggtctcgatctcctgacctcgtgatccacccgccttggcctcccaaagtgctgggattataggcatgagccactgcgccgggccccaagttttgtatttttagtagagacggggtttcgccatgttggccaggctggtctcgaatttctcacctcaagtgatccgcccgcttcggcctcccaaagtgctgggattacaggctaccggtgtctggcctcagttccttaatttttaaagttttattcttccaccttttaaatgaagtttaatttgggatgcaatgactgcagctcacctcatctgaaatagagtggtttgcagacaataatagaagagagtggtttgcagacagtaataaaagagagtggtttgcagacatttaagactttagggattggatactattgcttttttaaaaattgcctttttgaaaatagaatatattaatcttttatgtttttctagggcttcattttttttcttatttttaagacgaggttgtgctccctcacccatgctggagtgcagtggtgtgatcatggctcactgaagccttgaccactcaggctccggcagtcctcccaccacagcctcccgagtagctgggaccacaggcgtgcaccatcatgcccggctaatattttttattgttattgttatttgtagagaagaggtcttgctatgttgcccaggctggtcttgaactcctgagcttaagctatctgcccatctctgcctcccaaagtgctgggaatataggcgtgagctactgtgccaggcctaggcttcatgttaaaaaaaaatacttttagaattaataaattgtgttttctttggggttagagagggtagaatatgcctctgaataccctattgttcaggaatagccattccataacaacctcaagaaatgtttgtgaaagatatgtgagtgatggtgcctgtgattgcatgtgatagttttgcaaggcctttgactaaagcaggaaatgctgaattgatcacctggtcttttgaatagtgattggttttctgctagtatgtttagatgtagtcagccggtttctcagtattgaagtagatcctgttgtaactgtcattctctggttgtattaaaacatgatcggaataaaaataacaaatactgtattttcctcctctcttagattcatgcccgaaaccaaaatgaaataatttttgggctgaatgatggatactatggtgctccatttgaacataaggtaagaagatccttctaatgttatgaattttgtttagtgcaggtgtgccttgcaggtgtacagggtagatataatcctgaaaactctgtgtaaatagaatcatgctttaaatttgttgcttagtgtggcttaaggtggatgctttttaatgggaaaactcattctgtaaggcacataaccatccagtccatcttttctaaatccagattatattaatttttctacaggaaatctggagctagctgttttctcttattctacataactctttgggggttaagaaaggatggtgaattttgattaaatgcaatacagttttatgaaatgtttcagatatcttttataactttcaatacatttaagaaactatgaatcggttgttttatagtcagcattatctctacatctaaaagttattagagaaaggaaagggaagcgaattcacatttaccaagtacctactatctatggtactgtgccaggtgattcttgtccttttcctcacttaatactagccaaaaccaatgtggtttgttttgtcctctccattttatagttaaggaaaaaagttgtttgagatgagcttcgtaggttcacccatctagaaagtagctgagctgaaatttcaggttgcctgcctctaaagcctgtgctttttctattctactatggtgttctacccaacaaccctgtgcattatttgctcttagtgatcatgttgcttcatagctcttggttgtctgaaatgctgttgcttagagtacttcatttattcaacaacattttattgagcgcctgctgtatgtcagccactgtactgtactccaagtgctaagaacacagtggtgagcaaatggataatttcctgctgttgtggagtatatatgcaagaggcaaacactgatacagtaatctaacagataaacatgtaaacacaaatggtggtaaatgctatataagcatataatgagggcctaacctattctaagggctcaagaaaggtcttcttggggacttgacttttaaagctacactccagatgatgaatagaagtgaactgtgtaaagggagtagggagtaggggctgaatagagagagcatttcagccagaggaggttaacatgttggaaggccatgaaatagaagggaacatgatgagttttagggactaaaggaaggtcagagtgatgaggggggagtgatacccgatggggctggagagctaggcaggggccacagcacgcagaacttttaaaggattttaccctaagaacaggggtctttgtgaaaggagttttagcacagcagtgtgattatcagatttgcgtttcagtaatttcattctggctgcagtagagactgattgtagaagaggcaagaatatttgtgggagaccagtaaggaggatcttacagtataccagataacagatgtattactttgaaacagggtgacagtagaatagagagaagatagatttaagaaagttttagtagataaaatcattaggacttgctgatgatttgaatttaaggcataagaaaaaggaggtgtcatggatgacttttgggtttctggcttagatgaagtaactggatggataaaggtgtcaggcactgagaaaactaagtgacactggaggaaaaccaggtttggtggaggcagattgtgagttgcgatttgatcctgtggagtttgagatgcctttgagacattcatgtgtagatggaagtaggcctttggatctatgagtctgaagttcagaggagaggactaggttagaaatatttatgtggggccaatgacaaacagtcattggagtcataagtggtgataagatggactaggaacaggcagtactgtaggaagaaagggggctaggtacccaagcctggaagacctccagtttttaaagtccacatagggggcaccagaaaagatgactgaaaagaagtggcccaagggaaagagagcaaagttttgtgtagaatctcaaagtccagagaaagaaagggttttgttgttgttgttgttgttgttattgttgtttgtctttttgcttgtttttttaagaggagagagtgatcaaataggaggaccaaaaattgcccattggatttagcaaaatggaagttattcaagtgacttcttcaaaattcaattcaaactctgatagacatttttctttctttatttcaaagctctcctcttctaagttcctatatcaacatactatgtatacctttgacataggatataccactttgcaactaggcttgtctttcttcctttctagcctgtaagcttttgaaggacagatttctataaataatattgaattcccagcacctgccacagtttttggggtatgcagtttgcttagtaaaagtgtttgtgatttaatgaaataattatgggattgctactgctgctgttcataatatctcatgtacagggttagctgttctaatactgttgcaacattaagttcctcctgcaactggtataactcaccttttaggacaatatctggcacatataataataatattaatagctaaaatgtattgagcattactgtatatcaaacactgtaagagcttcacatctattattgtatttaataccccaagaaccttatagccaaatcctcagagctgttgagattttgagtaagccaataactaatactcctttcttctcctgagtttggagcaagttcagatataggtgatagtctgtaatcccagtggattttgggaggctgagctgggaggatcagcagttcgagagctcagcagttcgagaccagtctgggcaacgtagcaagaccttgtctgtactaaaattcaaacaaaaaattagccaggtgtggtgacacgtgtctgtagtcccaccaacttgaggggctgaggcgggaggattgcttgagaccaggaggttgatggtgcagtgaaccctgatggcgccacttcactgggcaatggacgagaccctgtctcagggaggggaaagaaaaaaaaaggataggtgatagataaatgtagatcagaacattggctttattactaataaaactgatggacaaatgtgatttaaattatgtgactaaaagagtttgctgtgactaaaagggcttgtcgattccttctatatacttcctcttggactgaacctcccccacaaaataacaaaacaagtgaaaccaaggtcttcctcttataggaacaaagcctgagcctccaagccagaagcaaagtttgtatgcgtggttagacaggttgtttctgattggagagaacctggaaagaattaagccagtcacacacaggtccatctctgaagcccagccatcagatcagtcatctgctggtcctggagaggagtgagtggaggacacagagaaactgcagatgctcctttcatgaccttttctcctgagaaatggagtggggcatttgtctcctgtgtgggaacatgggaatgcagagtaagtgtttccctctaacgggaataatagctagtatttagtgagcacttctatgctggcactattctaaacactttacacattttaccttatttaaacctcacacttggcctttcatagaagaggaagttggcacagagaacttaagtaactttccccaaattacgcagctccctgagtagcagagctgcgattcaaaagcagatggtcagtacatgcttattgaatatatgatcgtaattagtggtgtactttcccctattgtccttcagttagtgagctttgttaattggataagttcagcagatcttgccccctttaccagctttcaaatgaacacctgacatgtagactgaaccttaaaaaaccttgtcttttttaacaaagccgcaagcagagtttccagtcaagatgacattgtaagtgtacactttgagaccttcctcagcaccaagcaagaagcaaggattgatgaaatcggagaaatgtaaaagaaatattcctggccgggtgctgtgactcacgcctgtaatctcagcactttgggaggccgaggcaggtggatcacaaggtcaggcattcaagaccagcctagccaacgtggcgaaaccccatctctactaaaaacacaaaaattagccaggcatagtggcgggtgcctgtaatcccagctactctgaggctgaggcaggagaactgcttgaacccaggaggtggaggttgcagtgagccgagatcgcaccactgcaccccagcctggaggccagagcaagactccgtctcaaaaaaaaaaagaaaaaaagaagaattattccttcctaaaacaaacaagaaaccaaggcaataaacatctcccaaacagaagtggaatagaaacacaaagaagtgggaagaagcagaagacttgggccttctggccactctgcccagaagtaggcagaaagatgggctcttcagggtaaaatgagcactaaatgagcacgaaaagctgagtggggctctccctattaaaaaaagggccgagaaaagacagcttagagaaactgcagaactttaagaataatcctaaaaggggaaatttgaaaagctaccagcgagaaaggaaatattactcacaaattaggctgacagcagacttctcatcagcagcagtagatgccagaagaaataggtcttcaatgcgctgttaattattaattgtttctagtaaactttcagtcaagagtgagggtaatttgagaccagctagggtaacataatgaaatactatctctaccaaaaaaaaaaaaaaaaaaaaaaaaaaattagccaggcatggtacatggctgtagtccaagctacttgggaggctgaggtgggaggattgtttgagccaggaatttgaggctgcagtgagctgtgatcgcaccattgcactctagcctatgtgacagaaaaaaaaaaaaagcgagggtgagagagcattttattgattgagacagagtctcactctgttgcccagtcccacctctgagtagcagggattataggtgtgaaccactgcacctgtcagggatagttttaaatgcataaagattgagagtttactacccacagaccctttacccatgctgaatgatgcacatagaagatgataccaaagggagcatatagtgtataagaaaacagcaaggggtatacaaatggttaaaacattagtgaatttaatttctgactgtaagctaacaaacaaaaataaatatctgataaacctatgtgttttaaggtgaaagaagctaggccattgttattcaaaatgtagtctggaccgctgcttgtctaggaactgtctgtcacaatctgtggtgagcaacgtggaaaaagtgagggtaaaagtttcaaaacttctatagcaatttgacgttattgtgactcttcattgtattttacaaaagtatcagttcacaatggaatgaagaaaaaaaaaactccagccaactggtctttccccacagagagtgaaaagcattgccctagacaacaataatgagagtgggtgttcaaagggttaagactcattgagatcactgatttgtttgggaggaggatagagatagtaaccaactttagaatttgctagaaaaaattttggtcaagtgtacatgttaaaaatttaaggatacctagtaaaggctaaaatcagagggctgagtgtgttggctcacacctgtaatcccagcactttggtctcaaacccctgatcccaagtgatccgtcctcctcagcctcccaaagtgtggggattacaggctgaggcaccctgcccagactgtataatcctagcactttgggaagctgaggtgggaggatcgcttgaagccaggagtttgagaccagcctgggcaacaaagtgagactcccgtctctaccaaaaaaaaaaaaaaaaaaaagatggaaagcagagattatagatttctaattagcagaggaaaaaagggaataaagtatagaaagctttgtcaacttggtaggtaacagaaaaggaaacaaaagataaaaagaaacatgtagtgtgggggtagcattatgtccaaatatatttgtaatcacaataattataaatggatatcatatagttttgaagtatttcgtttaaaactttaaaaatgctgaagcaacaaggctttgagaacaggattaaattttaagaatgagtgttttatacagaagaggaaaagttacccttaggaagcaatgacagagcacattttaaagcagctttcaataatgcctaaaatttttgttgaccagttctttggcattcttcttttttacattagctgtgaccagaaacagttttattattattgctgatgattttgttgatgttaatactccctctgtctacattatcttaatatgtcttcaggcactatggatctaaaagctgaaattacttatctgttcataacttttccctctttgtttatctgcttctcccaaaggctttacatctttctgttgagtttttaggaaccaaaatctcttaactatagaatacaatggctaagtagttcattttcacttccaggagtgtgttggacactacctaatacactgaaaaatttttcattaaaataaatactggattttaatcctttgttcagtaacctcttctggcattgttagggagtgatatattctggttaagcgtatgtagcaaaatggtctttatttggcatacaaatgtggcactctgtttttttttttttaaaggaaaaaaaaatagagatgaggtctcactgtgttgcccaggatggtcttgaacttctgggctcaaatgatcctcctaccttggcctcccgaagtgttgggattacaggcgtgagccaccacacctggccagatactgcaatcttaagtatttaatagcaattcagacaaaagagaagttgaataagtgatgatgcaaatttttgtcttagttgtaaaagtgattcatgattttttttcctggcaaaaaatgtcaagcgcctactacaagcctattattaaactaggtactgtgggatacaaaagtataagacatggattcaaaatttattttctttgttgaggagataagacagtatatattccagaagacatgcagtttacaaatgagtttagtttgaaaaattgtttttggtgtcatttgtttgcatcttgcagataatgcaggtaagttatagcagaaccttaaataatttgaagagcacttcaggaagaggttttaatgtttggtgactattgggaagcaaagaggagctttgttataccttgaagttggtgtggaggttggtgaataaggctgggtgacctttagagatttctacaggggttttctaggtgggtttaaccgctatgatggtgattaggggaggatgataaataaaaagctgttgagtcagtaagctggaaatctttcagatccctattcaggattttgcctttaatgtatacaggtaagattatctttgcctttatttcattttggtgaccactcgtcttttgtgggactgctgacagctgctttttatgaatgcacagtcctagtcgttaggaatatggatattggagtcagattgatataagtttaattataggcactcctgacaactattactccagtaaatggaaacttctactcactaggctctaaatcctatgataagaggaattacatctctaatgcttaccattgtattaacactatatctctagcacagtgcctggtatgtagtaggctctcagtaaaactttgttagtgaatgaaggtgaatgcttgctgtgtttagggctatcacagcaatcattgagaataaaaatcttgagtagatgatatttgttccaccctgggttacctccagcctcaacttttggtatttatttttatgtaactcatattggcataattactccaacttttgtgctattgataaggtgcaaaagcattagaccagttgttataaggctggagtgaaattacttatagacaaatctctaaagattaaagagctgtgaaggtaagtatatagatacatagagatacaagtaagaatttcatttttctgactagaagctacagcggtaatatctttagagtccagtagatggcaatactttctcactttaatggaaaaaattagagcaggcatagaatccaagtcaaaaggagcaaatctttgtggatgaaagaaacccaagatattgaaatagcaatttggtgatgaatttcacaaaaataaccatataacttgatcgtctcgagtacataggctgagattgaagatttaggtataaaaagtttcaggatctgttttgaaagcctgaacaaatgaaaactccttattttatatttttcaatttgttctggtactgtgttgcttagcaaatcacttaacttctctcagttttaggttcctcatctcaaaagtaagaaaatcctaattagctggataacaccgcagggaatattagttatctagcccaacactcttattttgtagatggaaaaactgacgttcagggggctcatgatttattgaacttgacatggcaagttagctctatgctacagatgataacttagacatagctataatttattttatttattattattatttttgagatggcatctcattctgtcacccaggctggagtgcagtggcatgatctcggctcactgcaacctctgcctcccaggttcaatcggttacctgcttcagcctcccgagtagctgggattataggcatccgccaccacacccagctaatttttgtatttttagtagagatggggtttcaccatgttgtccaggctggtctcgaactcctgacctcaagtgatctgcccacctcggcttcccaaagtgctgggattacaggcatgagctaccagctgctataatttatttatctctatatatctatatacttaccttcatagctctttaattttttttttttttttttggacaagtctcgttctgtcacccaggctggagtgcagtggcgcgatctcggctcactgcaagctccgcctcctgggttcaagcaattctctctctcagcctcccgagtggctgggattacaggggcctgccaccacgcccggctaatttttttgtgtttttagtagagatggggtttcagcatcttgtccaggctggtcttgaactcctgacctcgtgatccacccgcctcggcctcccaaagtgctgggattacaggcgtgagccactgcgcctggcccatagctctttaatctttagagttttgtctgtaattcatttattccagccttataacaaccttagaggaaggtagggccaatttatcattatttgcttaaaagaaattgagtcacagaggggcaaagtgacttcctttcattccgtgacttaatcatttctgtacaatgaattgcccctttctctttgctcctgaagcccttttgacatacctctgttagtagctcttgagtttattgtagttttttgaattgtctatctctctctctttctagaaggtacaaactgtattttaactttgtaataccaggctcagtagcaggcatctaataggtatatagtaagtacttatggaataaaaatgaatggccaagatgttaggatgagttgtggcagaacctggatcagaacacatctctccctctttatagacgtgcactttcttcgttatactacgtcacctgtgaagaggtgatgtgatagaagattttcatcatttaatttttgtttgaggtttcttccatcatttaatttcactgtgattatatactgttagcgacatctcctttaacttatagcgtcttaggggggcaagtagtagtattttcattttcaggatgaagatgctgaaacccagagaagttaagagatttccatgtagttaactttgtagaactgagaaattaaataggtggttatttcctcttgctagtcatactaatggatactaacttgtttccaaagcacgtcccaaacagtacgcaagcagaacatcattcagaagtagggattaactgtcccaagtaaagccaatattttaataacaaagagctggatatggtgtatttctgcccaggtcttttagtacattatcaaggaaaagttggaaaaaaaatcatttaaaaagtccattcctatgcatattctgtttggttttcctttcccctgccttacaaaatagaacaaagaaagactgggaaaatcctcagggactgtttataatagctgcttgctttattataaagcatctagagatctgaacccagattaaatccagggtaaaattttatttctgaactatttgagctggtgtgattgtgtactaacagtattatactaggtaagtatagagcttttatttattttatttttaaatatttcttccatttctcttctcaggaatacagagctttaaaaaaactaccattgccagttttcatttactgagtgcctgctatgagacactatgtcagaaaggttatgtatttttatttaatttgtgtataacagccccatgaggtagttctcctgcttttatgagtgaagtaccttagaagaaggcattaaactactgccccaagcaagatggcataggtggtgaatagcagatccatgattcgagcccaggtctcattcatttgaaggcttgttttcttaaccgctatgctgtatgacatctccacatttcttcccacttcatatagtgtgacagcgtaccaagtctctgccttcacattaaccagcacaaagcataactagttgtgcattgtgggaatcaaatgagagagaacacgtgcaaacactttgaacagtatcaaagtgctttattctacagactttgtgcatttattattgtagagtgggcatgcaatgcccatgagaccatcaacccactgaagtccacaaaagttccacacattagtcactgtatttggcttccctctgagtcttttttcccccttttctcttggattgaattagcttttgacaggtgtttggaaaatcatcttatcctgtaattcatatttataaaccctgctgctgcagtgtggtccccattctctctcttcattgaagccagagaataatctgggaaaatgccacgtttcctgttatgaatttggaggatcttgtcttcttagcacaatttttgagcttttgagaacttttaatactgtaaaattcaaagccaagtatggttctttatatagatgttttagattcttgagaagtaaacagaaacagagttcgacttgttctcaccaggggattcagagagtttaaaattttgttttgtttaatattttgaaaacttgttttcaccattcttttttagatttgtatagagggcatttttgagcctcctcaccccatcctgtaagttaatttctgtttcaactgttgtacaaagctgggaatcttccctcattctctttttttctctctccacgaatgctagttaacatgctgtcactgttgccttctcttctttctctctgctttcaccgttatagtaatttggccatacatcctttcttcctattagggtgtatgctcctttagggctgaggttatgccttactcagctttaaagtctcagactttgcttactgaatatttttccatgagtgaatgaagtctactaggatcacgttgttcccatctctgttttaaggtagactttttgcttaagggacggctacttcagcagggttactttcagtcctcatgtcatggagtagcattgaaggcacttagtccacttcatacttggagtgtgtgcctgtgattgtgattattttctgagaatatttgaagtatgaacaaaaacatcttcatctctgttgatttaaatttaaaataattaattttaatttcaggatctgtatatctttgcttaatgacactattcttatttctcagtgcttctcactgttttaaaggagaggaaaaacatcctctgttgtctcaaacactgggccaaatctgaggggatgtactcattcagctcaggttaattgtctaagaagaggtctcacctttcctccttaactactcagtatctgggcttcgtcagatctcagagccaggggtgtctaaggcttgatgatgcttaacagagatacgtacacagttttattcggcttaaacttggctgatgcctagaagtgttattaatgtccaaatgaacatatacacctaggaacacaggctgtctactgattcattaggtagctgtagtcatacaaacaaacactgtatttttaaaaaagtatactcattgcatctgaaaatgtgctcaagtagtaggatgagccattgtttttttttcccttgcccatcaagatttcttattttacctaggttaagtagaagacgactattttcaaagctcacttatggttttatgaataaatatagaacactggcaagtcctgctggggagagatttcctcccagataaacacctccagtctagatttccatgtatctaaacatgtgtcaaatttgcctggatgtttcagagatacatatgctctccatagcccaaactgagctcagttcccttcccctctcacaacacttcctcctgctgtgtttcttagtgaagtgaatggtaccacaatccatctactttctcaagtcagaacatagagttgtcctgagtcccttcttctgtgtttccatcactactgatggtggctgctacttttttcctggttcttgacattatagtcagatttatttttctaaaatgatcatattcttcctttattcaaatcttgtcagcagtgtttgccctcaataattaatgacttatgaggtcttgctattccttatttctaaacactccatccttaacactttctcaggctaagatttgttcacgtcagttttagctaaggcctcatttctataggaaggtttttctgtgatatacctcttaagtccagtgtggatagatcccttttatatgcttccgtagcaccttgtattacatttccctcttcactgacccttatcctattatattctgattgcccgtttgcttacctctcttacctgctacactgtaaactgtgtgagggcaaggacagtgtctgttttcacctgttgatccctagtgcttagcactgtgtctggcatgtaataataatccagtacattcttgtcaaatgagtgaatgaagcttctgtagcagcagatcattagaaattctattggaatacaccacttggttgtcatcagtagtatagctcagcagtccccaacctttttggcaccagggatcggttttgtggaagacaagtttttccagggacgggagtggggacggtttcaggatgaaactgttccacctcagatgatcaggcattagttagattttcataaggaacgcacaacctagatcccttgcatgtatagtttacagtagggttcgagctcccatgaaaatctaatgcccacgctgatctgacaggagggggagctcaggtggtgatgcttgccctgggggttgggaacccctgatatagcttgttactcaaaattgtaattctctgtcttagtggtttctgacatttctgcatagatgcctgccaaattattatactttaaatggagctcttcattttttctctccaaggttgctttctcttccagttttccatgtctttattaactattttttcatttatcctggcctcaaattttatagttaagtgttgattttttttaattttatccattctattcagtcagccactagactcttttgagttcttctttgaagtagttctggtatctgtggctacttttccctctccattgacataatccaagctcagatcaacattcccaaagggctgggtcactgcagtagtttcctggcggacctatagactctagtctctttgtatccactctgtcttactgctgcctgattaatcttgctaaaggatgctttcgttttttattcctttgcttaaagattgtatggagtaaattcttattgtctgctagatgtgtccaactctctggtctgattgctttctctccatcagcccaaattcagtcagttgtatagtactttgggttctgtctccgctttttatctctcttcttccttctcctcctcctccccaccttcctcctcctcctctctctttttctgtttctgttgttttttattaccattgccactgatggattttgaaccctcattatgtctaatatgtatggatttttatagtagcctcctatcgggtagttggacagtcttcctccaatttatgaggtttgttaataccagagtaaccttccttaaatgtagctctgattataaccctaaactgttagaaaccttccatgagttcttactgcccataggttgtctttacattttagcatggtattcaagacttgctgtgttctggccctccttacttacttattcagctgtatctcccactacttccctctccagggatccaaataatttccacgtcactgaagctaaacgaattggactactatttaattttctctgaatgcagcttgtgttttcctgctgtcatgctttggctaaaggtgttcagtctgtgtgggactttccttcactgccattcagcttttcagtactacttaatccatcccaaatactgccacccctgcagtctttgatgttcctgctctaccagatggaatctttactgcagcagaactcctgtagctttttaaaaagcctttcttatggcactcttgcattatttgattcacttggaaccttcactgggttgtgttctctatgaggacagtagtaataattgcctaacaccatctatgtactcggtgttcagtaaacactgaaaggaataagtatatgtataatgctatttgcttcctaatcagttatcctactaactgcgttatttctgtatacattttgtagttttaatgaagttaaggacagtcttgtgttgttgcagctaaaaactctcaaaatatatagtaacatgttttaaaacgtgactcatccaatgaactagtacagggataagcaaactgtagtccagcacatatttttgtatagcttgcgactaagaatgattttacatttttaaagaattttaaagaaaaaataagactatgtgacagaaatgacatgtggcctgcaaagcctaaaacatttactatgtggccctttatggaaaaagtttgctgaccactcatctagaaatacacctgacttgcctggaattactcctgctcattggatatgttaaattatctatttccctgagcagtttaataggcactcacccagacttgttactattctgttccttgaagaattgttaggcctgacttcagaagaattttgagtgacatgtaaatctcttctgggctctttggcacttggcagtatctcacacagataaccagatacaaatgagccgtttctttccattataatccttcatcagaagtctgttgggatcgaacatctggtgaagttagatgtcattcagaacaaggctcttagcatatttcaagaatgttaattgctaagtgatggctgaaacaggagggcttaataatgtccttaaattgccttaaatgtacatggactcagaatttttagaattggaaaaggtcctagagatcatcaagtatagcctggttcttaagaacacgggctgtggagccagactgcatggctcttctctttaatcctctttgtgtctcagtttccacacctttaaagtggggatattaatagcacctgtttcacaggggtttgtgagtattaaatgtgttaacatttaacatattaacagctaacgttgacatgtaaaatacaatactgcctgccacactgtaaatgcatgtaaacattactttttatattgctgttattttttattactgtttttattagtagtagttgcatctcattttataattaaagaaactgaggcctaggagagttaaattattttccttacttatgcgataggcagagtagattaaaacccaggattctagctttcagttgaatgttctttccctgttataaagtgtggcttttagttgtatgtcggtgggtgtggataaattttttatagtaagaaaaaatatttggcagctttttccgtaaaataagaaaagctaagtagaacatcattaattatttctcctgagaatcttaaatctacttctcaagtcttctattatttggattttgttgctgatttataagactgtctcctctgtcctttttctcctcatctcctcttaaaatgtattgattatttcttagcatccattttttaaaattgaagtgaaattaatgtaacataaattaactgttttgaagtgtgcaattcagtggctctgggtacattcacagtgttgtgtaccaccatctctgtcaagttgcaaaacattttcataatccccaaattaaactttgtacctatgaagtgctcactttctattttgctgtcctccaaacccctggcaaacaccagtttgttttccatctctatggatttacctattttgggtatttcatacaaattgaattatgtagtatgtgaccttttgttctggcttttttcacttagtgtaatgttttggtgttgcatctacatgtaggaaggaatgtacttcattcctttttagggctgagtaatattctattgcatgtgtacacacacagagacacacacacacacattttgtttattcatgtctgttgatagacatttgtgttgtttctctttttttgactgttgtgaatagtgctgctgtgaacatttgtgtacaactgtttgtttgagtccctgttttcagtcttttgggtatgtacctaggagtgaaattgctgggtcatattataattctatgattacctttttgaggaactgctaaacttttttttttttaccgtggctgaccaatacattcctaatagcaatatgtgagggttctcatttctccacatcctcactatcttctgtttgtttgttatgctatttgtatgtctttatttggagaaatgtctcttgcagttctttgcccattttaaaattgagttgtctttttgctgttgaatgtatgagttctttatatcatctggaaattagacctctgtcagatatacaatttgtaaatattttctcccattctgttgggttctttttctacttaattgatagtgtcctttgatgcacaaaagtttttgattttaatgaagtataatttactgatttttttgtactaatgctttttatatcatatctaagaatagattggtaaatccaaggttatataaacccctgtgttttcttctaatagttctataggttttttttagctttatagtgggtttttttgtttgtttgtttgtttggagatagagtctcactctgttgcccaggctggagtgcagtggcgtgatctcagctcacttcaatctctgcctcctgggttcaagtgattctcctgcctccagcctcccgagtagctgggattacaagcgcgtgccatcatgcctggctaatttttgtatttttaggaggtaccaggttttaccatgttagctaggctggtctcgaactcctgacctcaagtgatctgcccacctcagcctctcaaagtgctgggattacaggcgcgagccaccgtgcctggccagctttatggttttacagttaagtctttgattcattttgaggtaatttaaaaatatggtattaaggacaggtccaacttcattcttttaaaagtggctatccagtttttttagcaccatttgatgaaaagacttatttccccattgagtagtctatgaacctttgctgaaaatcagttgatcatagatgcatcgatttatttctggattctcagttctattttgttgatttatatgtctgtccttatgccagtgctatcctgttttgactattgttgcttggtattaagttgaaattgggatatgcgaatcttctaactttgttctcttcaatataattttggctattgaccccttgcaattccatatgaatttgagaactggcttgtccatttctgtaaacaaggctgctggaattttgatagagatggcattgaatatcttatctagattgctttgggtattgttcctatgttgataatattaagtctttatatccgtgaacatgggatgccattttatttattttggtccagtttggaatacactttatttttcttgcctaattgttctggctagaacttagagtacaaatgttgagtagaagtggtgaaagcaatcaccttgtctttcttgtttttgatattgggggaagattttgagtctttcaccattgagtatggtgttagctgtgggttttttgtagatgccctttatcaggtctgggaaattcctttctattcctagtttgtgattttttttttttttaaatcatggaaaggtgctgaattttgtcaaatgcattttctgcatcaactgagatgactgtgtgtgttgtggtgtattacactgatccttccttccttctttctataatttctctttttgacagagtcttgctctgtcacttaggctggaatgcagtggcacaatcatggctcactgtaccctcaaactcctgggctcaagtgatcctcccacctcagcctcctgagtagccgggactgcaggcatgcatcaccatgcccagccaatttctttattaaaacaattttttttttttttagaaatggtgtctcactgtattgtccaggctggtctctaactcctgggctctagtgatcctcctgcctgtgcctcccaaagtgctggtattacaggtgcctagcctgattgattttcatgtatcgaaattcccttgcataccgtgtatgaatttcagctgttcatggtgtataatctttaaaaaattttttttgtggtaaattacaaatacacaaaatttactatcttaaccattctaagtatacagtttagtggcattaggtacattcacactgttgtgcaaccattgccaccatccatgtatttcatcttgcaaaacttttcaccttacaaaactgaaactctttattaaacaataattcctcattctcccctatcccctggtccctgccagttaccgttcgactttctgtttctatgattttgactactctaggtacctcatatgaatgaatgaatgaatgtttttcctttgattggcttatttcacttaatataatgtcctcaagcttcatcaatgttttagcgtgtgtcagaatttccttcctttttaatggtgaataatatttccttgtatgaatataccatgttttgtttatccatcatctgtctgtggacacttgggttgcttccaccccttggctattgtaaataatgctgctatgaatatggatatacaaatggcacttcccattcttgctttcacttttttggggtacatacccagaaatagttgccaggttgtgggctgtaattcttttaatatgccactagatcacttttagtagtattttgttgaagatttttatatctgtattcataaaggatattggtctatagttttcttgtgacattttgtctggctttggtatcaggatagtattggtctcatagaataacttaagaagtatttccttgcttttatgttttttgaagactttgagaaggattggcattaaataattggtcaaattcaccagtcaaataatctggttctgggctttttttttttttttttttttttttttgtgggagttttgtgattacaaattctatctacctctttatctgttataggtctgttcagattttctgtttcttcttgagtcatttttggtagtttctgtttcttcttgagtcattttggtagagtcattttggtagtttggtagtttatatcattttgtctacattatctgatttgctggaatacaattaattgttcactgtattcttttataagccttcttatttctgtaagattggtaataacgttcccacttctttcctgattttagtgatttgagtcttctttcctttccctttggttagtttaccttaagatttgtcaatgagccaggtgcagtggctcatgcctgtaatcccagcactttgggaggccaaggtaggaggatagcttgagtccagaagttaaagagcagccttggcaacatagtaagacacccttctctataaaaaattaaaattagctgggcgtggtggtgcatgcctgtaatcccagctaattgggaggctgaggtgggagggtctcacgaacccaggagttcaaagtcagtctgggcaacatggagaaaccccatctctacaaaaaaaatacaaaaattaactgggtatggtgttgcatgcctgtaattccagctattcaggtggctgaggcaggaggatcgcttcagcccaggaggttgagactgcagtgaactgtgatcatgctactactctccagcctgggtaacagaatcagaacttgtttaaaaaaaaaaaagatttgtcaatgttgatctttttaaaaaacaagcttctctagtttgaattaatatcaacttagttttaatgctgtaaaaagctttgcttctgtatagctctattcccctacctttgtgtcattgttttcacagattgcatctttataatggtgtgcccatcaagatagatttataaagattgtttcatgtatttgtctagttgattgttttttaaatggtagatcaactagacattcttaggctacatccagttaataatatgtcttttttaatctttataatgtattgctggttcaatttgctgatatttcgctaaggatttttgtgtttcttttcgtgagggatattggtgtataatttcctttgtgtgtgtgtgttgtctctgtctagttttggcatcagtaatgctagttttataagttggaaattgttcccttctccgctttctgaaggagtttgtgtaaagtggatattctttctttcttaaatgtttgatgaaattcatcagtaagaccatttggacaggatttgtgtgtgtgtgggaagattttcaattgcttattcactaaaaaagtagatatgggactatttagatgtttcatagtatgtctgtttgggcacttttgtgtttcttttcaaggaacttgtctaattaagttgtcacagttattagcataaagttgttaataatattctcctaatatcctttaaatgtctgtagtgatataacttttaatgatactactagcattatagcgaacatgtatgtggtgcttattaaatacctttcattttacagatattaacttttaattcccgcattttgtgaggcagttactattatcatctccatattacagatgaagaaaccaaggttaaactaagagcactctggttccttgcttaagattatatagctgttgtattgaaggcttgaattggactcctggtgggtccagagtctttttttctaaattactgtgtactctccccaccccccacttttttttttttaagaaacatgactatttattcctttttatcttttttttttttttttgacagtgtcttgctctttcactcaggctggagtgcagtggtgtgaccgccagattggttcaccttgccctctgcctggacagagccaatttatcaagacaggggaattgcaatagggaaagagtaattcatgtagagccagctatgcaggagactggagttttatcattactgaactcagtctcctctgcctttcttaaatgacagagatacctattctgttcttcttctggaattgtcctgtattctttttagaaagtatccttgctactttgtaccacagagtagaaatatttgtttctggtgttcctagtcagaacttggaatgcccttttccccataaaaacattacatatgatggctaggcatagttgaaatattattgttaatactctttttgagtcacataatatgttaaaatgacttctggagcttccttgggaggttcaccacaatttataatgtgaaacattgtttccgtgggaaactgtgagaagaaatgtattttatttttttgacctaacaccgaatttatcactttttaaaaacaagatattttcaacaaaagtgaagaaataagaaacaaatccagtgttcatgcattcccaaactgcagccttgattccaggatacctccttctctcaaaccgagctggcttcctgggaatccagtggtggtacatggatcgagggttcctttgtgctgcattttttactgcctctctcctgagttgtcgggatagattctgcaggctcttgtgctagcccaaaggtgcccagccttgactccacttccgtgtctttgatcctgggtgggcacgtttcctgggtccctgtgctctcagaagctttctcaggcacctctccttggtgctgttgccccaggtgatgttcagccatcatctggagctctctcgttgtgggtgtgatccttgtcatcttctgtcactgtggagacattaccaaagtgggtcgaggatccgtgttcatctttctctggggatgactggtcagcacaagggtggcagcgttgggcgacatgtccaaatctgctctgccccctcggggtctgggggctgttgtcttcctccatggctggggcggcacctgctgggctggcactgtggtgggagggaaggccgcgggactcagggctgggctgggcgcgctccttctccactcttgtcagatccccctgccaaaatttattttacattccctcacctgaaaggttaggcttctattacatggcagatatactttactttttggaatctctaaaattttagatttactcagttgttaatatgtcatatttttaaaaagacaagcatgattaatttgtgcatatattttattttgtttggttttgattaatttgttggttaatgtctttcagggttattcaaatgctcagaagactattcttctgcaggtggatcagaactgtgttcgcaattcttacgatgtcttctctttgctacggtaagaaacttcttagattgccctgaattctaaagaatctttctcattttgagtttgtgacatttcaatgtgagaaaattaacggaagctttagaggctgttattcaagcttagcattttttagtgcaagcgtcataaattttgtagctacagtgatttaaatttatctattttacaaagtctttggaaagccatttcctttctctggacagtgggagagaatatttggaagccagtgatctgaaaacagacatgaactgttttctggtcttctgtaccctacagaacagtaatcaaagttgcaaaagttagacttatcaaagtcttaacaactgcggcatcactcggaaagcccttcaacggccccaaacatggctttgagtttggacctgttctttgtcttaaaagaattatgtttggcaagccaaaaaagctttgcatgtatctaatgctcagaggcttaaaggcctcagctctatattttcataatgtctgggcttaattttgaaagattttaaaatctggctttaattttaaatgtgatagatcatcaaggatatttttccagggagcaagccaccaaaataaatgcaattccaaataaagttaacagcaacactcaaccaatgttcaccctactcagacagattgttcattgaaatttgattttgacagtattttctaatgtttacgtgacacataatacatttcagaacattagacatcctttatatatgtacttgaggaagaatccagaaggatgctcggagaactggttattttagaaactttacaaaattggcctttcgtttgtgaaacttgaatcttattacacatgatatagagtttggtcacatggactgtgtccattaatcttaagaaacatgattttgactaaagtaaccatatacattttctgagttttggttcttgcttgagagatgcctacaccttgactgcttaggatatgtagcagaacacacaggatttagaaattagagggtggagattgtagtaaacatattttaatgcctgttcagtttgagacacacaaagttttaagttttgaaaagaagaaagttcagaaattatttgaaatatgagtaagccactaatatttcttgatctcagttttccttagtaagtaaaatgaggcgtagggtacaattattttaaagatatgttctaaatgtgagattgtgtgaccttattagagaaaacagtagaattaaaagaaaaaatactaagtcaggaagaagaggatttgggatagtgcagtatcatagatgctgaaagaggatagtttccaggagtagcgaacactgtgataatgtaggagagcaggaactgaagaaagactgttggatcttgtgaagcagtgtggtatcatggaggatgctttgattaatcctaccctgcctttatctttgatttatcctaattcatttaacctctgatgcttctaaaaagtggaagcagtgatgtaacaaatttgtgtaatttacaagcattttcacattttttatcttattctcttagaagtccttcatgcatcagggatgatagatagcccttgtcttgattgtagaagctgaggccaagaggcattaaatgttttatctatctgagggcacacagcaagtaagagccagactggaggatgctttgacggttttctgacaatgtttttgtagatccttttaatagtctcaccttcctaaactggtggttacaaggcacacatggcataatgactgtggacattctttagaaaacacaatgccctacataaatgcaaagtcatcaggctaatttagtagttgctcagttattgaacattgatcttgcaatgatttggctcttggggagttcatatctagagtatttttcagactcttcagatgtgtcagtaatttgaactgccttattaacagtggtctcctcatgcctattgtacaattcatgcctagctaataacacagatatacttttcctaaaccagatcacgtgactatttatcaaccaaatttactgaacccagggagttgttctggaattggaaactttaaattgcacttattaaagttgatgagtcagatgggactttggtgatagttctctcagacattagtaaagagtacccatcatctgctctattaaatgatcctcttttcccatagtgtttgccatgatatatgtgaagtgctttctaggaaacttaattgtgtgcctattgaattaaactctagttcgtggtttcctctctaacattgtccttggctggagtcattttaaaaaatatatcttttcttttcctgatgctttcttggtttataaaattgctgttacttgatctgtaattttgtgtgaaaacacacagtctaaattctttaatgccacttaactctataaaattctgcatgctgtttagagtcatgtttagaaccctggtctcctgattctgttttttttgagacagagtttcgctctgtcacccaggttggagtgcagcggcccgaccttggctcacttctgccttcatctcccaggttcaagtgattctcctgcctcagcctcccgagtagctgggattacaggcatgcgccaccatacccagctaatttttgtatttttagtagagacggggtttcaccatgttggtcaggctggtcttgaactcctgacctcaaatgatccacctgccttggcctcccaaagtgctgggattacaggcgtgagccactgtgcctggccccgattctgttttttgagagtatattctagttaattaattttcactgtactgttgggccactaggatacatctgttctctctcctttttgtgtgggagtgtcacagaaaaatgggcactcttgactaaggcaaggactttggagcacctaaaaccaggtgctccttcatgctgggtgtggtggctcatgcctgtaatcccagcactttgagaggccaaggcaggcggattgcctgaggtcaggagtttgagaccagcctggtcaacatggtgaaacctcatctctactaaaaatacaaaaattaaccaggcatggtgacacatgcctgtagtcccagctgctcgggaggctgaggcaggagattagtttgaacctgggaggcggaggttgcagtgagccaagattgtgccactgcactccagcctgggtgacagagtaggactccactgcagagagaaaaaaaaaagaaaaaagctccttcagatggatgggttgtattgttttatagaaaaacaatgacctgagaccttattcaggtgctttgacccatagttaagaatttaggctaatttcagtgttgccaaagattagcagttctttccaaatttacatttaatgtgggatagtaattgaactattccttcttaactcttggaaatctctggattaagcatttgttttcaggtaaaagtagacatttaattaatagccagtttacttgttgttgtatttcatattttagggtgctcaccacaaggtgtcaatgttattccttaactagcatttgaaattttatttattttacaattttgggttgagaaaagtacgggactaaaatggaatataaagcaatgttgtaaattataaataagcattcagttttaggagttaactaaaaaaatctcttagtatgattccttctaggttaaggaatacaggcttagtagatagctttctaataggcttattaggtacctttctccttttggttctgtttttttaaagtcctattgatagggaattattgaaagattataaagagaggaggagtaaatgacatagtcaggtttgcaatttagaattctaaccatggtgtcagtgtggagtggacctgagggatgagcctggaagcaatgatttctgtctaatcatttcttaatgtgtctaatcatatctaatctgttctctgactgagagattatttttagtgttaactcattttttggttgttttttcttttatactttttcaaagagataactctgttatagtaagaaaagtaataattctggtttttttctagtatagttttcattgtttttttccccttcttcttcagaaatatcctgcttttgccagtttaataagtggaagtatggtggaaaataaagggctttggtccttcacctaaattccagtcctaaaactgccatgtgtaggtagactggatgcaagactttgagcaagtaacgtcaactttttgtataccttagtctgcttttgtaaaatggggctaatatttgtctcttctattaggaatattgttagaattaaataagataaaatatttgaaagatcttaggatagttactggcatatagtagacatttaataaatgttagttttcttcttcctctttacttacctggtcttggatatagctttctcctctaagccagtattccttttccttgttaccactagcttttctacttttcagcatattttccctttctctccccagcattctagtgttttccatatctgcttttataactgcatgatggattcttcttgctcactgcccagaaaagtcaatgcattgagaacaggttttgcagcaaagaaagagtttaattattacagggccagccaaatggaaggatgggagataattctcagatccgcttcctcagaattcacaggctagagtgtttcaaggatagtttggtaggcagaggtctaggaaatggggaaacctgattagttgggttggggctaaaatcatagggggtctaagctgtcttcttgtgccaagttagttcctgtgtgggggtcataagaccaattaagccagtttcttgatatgggctacttatttgataccagctggtccatcagaattcagagtctgaaaaatacctcaagcaccagtcttagattttatgatagtgatgttatctataggagcaattgggaatgttacaaaccttgtgacctctgggtgcatgactcctgaaccataattttacaaaggtgttttcagtccctgagtaataaggaggaggttactttcaggaagggactgttatcatctttattttaaagttaagctataaactaaattcctcccgtagttagcttggcctatgcccaggaatgtacaaagacagcttgtgaggctagaagcaagatggagtcagctacatgttgattgatttctgtcactcataatttttgcaaaggtggttttactttcaaagttgcttttgttaattctaaacagtcataataaaaaatatttaacatgtgtgtgtcttttctccttaatgacattgaaatcttcttgaaggaaaggattatttcttatggctatatttctcctgtccttctatcttaccaatacttcttggttaattgttggagttcctttggcttgtgagcttactaggactcttctgtattactctttttccctaggtactctcttgtgttactaaagctacaaccaacacatctacatgttaatacctcttcaatctatatctctagctctacctctcttttggatttccagtctgcattttccaaccaccatggatatttgaacttttttgtccttgaggaacctcaaccccaaagtgtctggagccacactcatcgcgttaatactcctcttccttttcttttccctggtttgtctaatggtattatcaccatcctagtctcccaagctagtaatcttagtcatttttggtttctctaatttttcttcccttggtgatagatatagttgatgataaaccatattgattctttggcaagatgtctcatctgtcgacccttctttgtttttaatctgtattttcctagactatttccttatctcctagatgaagaaattaaggcacaaagcagttaagtaacttcaccaaggtcacacaaactagtgttagaatttgtattcaaacccaggcagtctagctccagaggctatcatataaaccagtgtatcttaaatccttacaatcttttacactgctgctggagtgatcttttaaaagatacgtgggctgggtgtggtggctcacgcctgtaatcccagcactttgggaggccgagacgggcagatcatgaggtcaggagatcgagaccatcctggctaacacagtgaaaccccttctctactaaaaatacaaaaaaaaaaaaaaaaaaaatagccaggcatggtagcgggcgcctgtagtcccagctactccagaggctaaggcaggagaatggcgtgaacccaggagcagagcttgcagtgagccgagatcgcgccgctgctctccagtctgagcaacagagcgagactccgtctcagaaaaaaaaaaaaaaaagatacatgaattttcttactcgctgggcttagaaagctttgatatatcatgtacaggagaaagttcacacttcttagtgtgatattcaagggacatttagcaatacatgcccttagggaccaaggtctttatttcaaagtcctcccactccctacttgtataatcaataactatcatttatggagtgcttactgtgttataaatagttcttcattgtctgattttccctccactcatctcaacacccccaaactgagagcacctttaggcaagaatccttgttttattagtctttgtattagccctatcgcagtgtgtatcatatatatgttaaacagataataaatgccatttctattgatcaaattgaactattgttcaggttactagaggactaaagttttgtttttcctaatggtttccatctggtaaaatgagagttgcaaaaaatttctaggctaatatttaaaaggtgatgaaaatgcaatcaggtctgtgagccttcagctgttgctttctttcagcccctgctctccacacaacatgtggtgagattttcaggattttgtgactttcaatccaactctttctataagtgttttgggaagacctttatttggctctctagaagcaaattcccctccccgcactttgctagaaagtactgtcaactataaaattccaattttaacaggaaaatgctcacaaccaataaattatcaatagcatagtgtttagagaagagatgggatgagaagtataaggtataactttgtttatcatctttaaactatggatgtgataaccaacttttaggctgcaggaagagatttttttttttcctccctgcctaatggactctaagtggtaattgcagttatacagaatacagctaagaacccaactgtaagcagactttacaaagtttatgtgctaaaactcgtgtactttcttttcttaatagagactaggctcttacccagtttctgtatgcttattttaagtaagttaggggaggaattaagaggattactgttaaaatagacacactgacagcaagaagcgaaagctgatagtttgctctgttatactctttgattctggaatatagctgagtgataaatcatattagctactgtcctacctttgtagtcactgtttggattcttaaacagccctgtctcactacttcatgtaaaaagagagaggaggagaaacagttcactgtaaggagaggccaactaaagaaaaaaacatagctagccaacttggccaaagcacatgtctgtattgcatttcataactcaagttactcacgagaattatgagtgcactgtcttagtttttaataatgctgtctccatttaacagatgaggaagcagtcttaaaatggtgagatgatttgcctgggccacaggctggttaagtgtggaagcaggtctgaagaaaggtctgccaggctccagtgcacgtgctgttttctattatgccatgttggtgccaaatcatcagtaaaatagaaaagtgtaattatgagagccttcataagaaagcaggcacatagaagatttaggaaggttttcaatcaaaatttaaaataaaataattttggtttttttttttttttttttttttttttttttttttgggacgaagtctcgctctgttgcccagcctggagtgcaatggtgtgattttggctcgctgcaacctccgcctctccagttcaagcgattcttctgcctcagcctcccaagtagctgggactacaggcacgtgccaccacgcctggctaattttttgtgtttttagtagagacggggtttcaccatgttagccaggatgatctcaatttcctgacctcgtgatccacctgccccggcctcccaaagtgctgggattacaggtgtgagccaccacgcctggctaattttggtatttaatgtgagttttggtggagcaaaatttgtatttatgtgcagcagcacattttattcttctttattcatccgtctctacatatactataaatatatctatgtatgtatacatacacataaagacacacatatacacacacacacagttttacaaaaataggatttaagcaaaatacgggagtaattatagggtgaagtcttctccttcccctttccttgtactttttggctcatcttcttctttaagcccttttcccccattccgctgccagcaaaccacccaaacacagaacataggtccgcatgacccctagtcacccttcacccatgttaacaatctgatatgtatccatctgtattttttcccatagtctctctatatgtcatagatatgatttatagatacatttatatatgttttctatataatttatggtttatgtatatggtttgaattaatttataaaattaaaattgttttataaaattggagttgatacacatacttgggtttcttgttcaatattctatgcatacattcctctaattcactttttaaatggcttaataatagtcagtggtgaggctatatcatatttattcagccactaccctattgataggcatttaatataatatttactctggctctggtttttaatgcgtgtttgttttgacagtatgcacattactgaaggaaatatttatacacatatataaccttgtttttatgatgattttgtttccatggattacattcccagcagtgggatttctgagtcaaagggtatgtattgtttcaattgttagagataatcaggttgttttcccaaagggcacaaaataaatggcattactccttaccctgattctgtgctggcaatggccatcatcaatttttatgatttttactaatttgatgagtgtaaatgatacctcagtattacttcaatttttgtcagcctggtgcaagtacttagtttgagctacaagtgaaatttaacatgttttcttaagcttattagctatttagggtattcttctgtgaatttgcctattcatttactttacctagtttttaaaaattgagttgcttgcatttttctcataagttcctaagagtacttggtatttttttcccaaatctgacaattacatcttgacttatgataccttatacaaaaagttcatatttgttgtatcgtgtaattctgttttctgttttatattttctgggcactcttgagttgaagaggactctcctataccttgcttctatagatattttttgctaactttgagatttatattattttactttttaaattaaatatttaatacaaattgcaatttattttttttttcttttaatccacccatctgcacactgatatctagtatagatagtccatatcttgtaaggtagaaattatttcttcatagatgaattcattgtgccagcacctttcttttcccactgaatttaaataatacttttgtaatatattaaaagtgcatatatactgggatctatttctggattcgctctttttttgtttatcttatccttttgtgtattttgtaactttcagattgatttaactacaggggatttttttgtgtggtctaaaatcaagtaaggcacgtcctgttgctactcttctttttgatactatttttggctattctcagaactttattcttttatgtgaactttaagcttattttatcctactttaaaagaccaatcttattggaattttaatcgaaatttttatatcagttgaagttttacaattattttgggaaagatgtcattttatattagtatacccatccaagaacatggtgtcttttcatttgtttatattttattttattccttcaacaagattgtagttctctttatatggtcatttggctttctgttacatttgttcttaagtatgttatagtttttacagtattttgtataaaataggtgttccattccattcttgtgtgcttactgctattataaggaaaagctatacttctaggaaaatcttatttatatttagtaatatatctaattgtttttattgctattgtttttttaaggaaagctctccttttttggcatacacattatcatcagtaaaaggataggcttttcttctctaatgtttatactgattttctagacttactgcatttgctaaaccttctggaactttcagaataatgttgaaaagtaataggcattgtgaccatcccagttccttgttctaattgaaaaagttcagtagtttgctgttcagaatattttctgttaattttgaaaactattggccgggcgtggtggctcatgcctgtaatcccagcactttggaaggcctaggcaggtggatcacctgaggtcaggagttcaagaccagcctggccaacatggcgaaaccccgtctctactaaaaatacaaaaattagctgggcgtggtggcacgcacctgtaattcctgaggcaggagaatcacttgaacccaggcagcggaggttgtgatgagccgagattgcaccactgcaccccagtctgggcgacaagagcgaaactacatctgaaaggaaaaaaaaaaaaagaaaaacgaacatatatatataagaaaaaaatatatatacatatattttttcatatatatatatatatatatgttcgtttttctttttctttttctttttgagacggagttttgctcttgttgcccgtgctggagtgcaatggctcgatcttgactcactgcaacctccgcctcaaaaaggaaaatattttaaataattctttttattcacttaatgcttttgttaggattggttgctgaattttttgaaatgcctttccacatttattaatattatatattttcttcctttataattgtaataaggtatgtggatttcccagtgttgtattactgactagttataggttattcttttgatcattacttataagcaagattagtttttagcagttgtgttgttgttatggggggaggtataaattaccgtctctcccaaaatcataaaattgagttgtgaatgaattgtgaagctttccatcttattctatgatcctaatctgtaaaatgatgatgataatagcatttgtctctggatcgctgggaagatgaaaggtattaatgtgaactgcttagtacagtgcctgaattgtatgtgtcagctatcattatcatcattaccatctgaaacagattaaataattttgaaagtttttagttctttgaaggttaggacttagctagtaaatcatccagttcaggtgcattttataagggtaaatcttctttcaatccctttagtactcatcgctctgtccattttttcctgcttctccttggtttattttggaatttgttttttggtaggaaaccacctatttcctctagatttccaacattattgctgaaataatgcacatagttttattttataattcttttaataatttcaataatttacagcacattttctaattaagaccagaaactactctaatgttgtagttagaaatgttgttacattatgacctcttcttggacaggatgctctctgatgttgaaattgtaataacttttttcatgtaaactaaaacaaaatatttcagatacttttgccttaaagtgtttctcagaatgagaatggagaatgtggactatatacgttcagggaatttatatctcagtttacaatgttgttcctagcatatagcaccaagctggctcagagcgaatgctcagcaaatatttgttaaatgaatgaatgaagaaatgggtgaaatataatcctgttggataataactgaaccaggtagattttttgaggaattttttaaatggtagatttttaattacctttccaaagatgattagtactaaccttggatatgttttgccacagttatagtatattttatatataaaataatttaatatttcattttggatacagtgcatgctaatgaaaaattcatgttgaaagcattgtgtttttttttgtttttgtttttttttgtgacggagtctcgctctgtcacccaggctagagtgcagtggcatgatcttggctcactgcaagctctgtctcccaggttcatgccattctcctgcctcagcctcccaagtagctgggacttacaggcgcccaccaccatgcccagctatttttttttgtatttttagtagagaaggggtttcaccgtgttagccaggatggtcttgatctcctgacctcgtgatccacccgcctcggcctcccaaagtgctgggattacaggcgggagccaccgtgcctggcctgaaagcattgtttttaaattaactgcagtttactaaatgagtaaaccagtagtcaggacttactgatagatctcatagtctttaactaggacctcttataggcaattatgctactaagttcattttctctagtttactgaatgtttaatagagaatggaaatgtaatgggtaagttaaatgagcccttcccaaaacatgttcagaacttttggcttagagcaaaagtcagctttcaaatgttgaaaaggtgaatgaagaataaaataggaagaataaaatcagcgtaaagaagtaaagcattctttgagggcagttaagtatatgtagtcttctgcccaagagatgttctctgtctctgcccctgtcctttaattttggcttgaattcacagagttactggactaagactgctttgtttgagatgtcactgcgaattaaggcttcactgtcacatctctcatagctgccttgtaacttctacattcccgctggtgccaggcatgttccaaggcagcattccaaggtttagtgatttcaccctgatgtctctgccaataaaaataaccagttaccattaaaacctaccccacccataacttgatttttacatgccgttttattaagaaaacttattgatgattttaggagaattaatacattaagtttatcaggatatcaactggcccttggagtaacttttgttctaaaagtggatgtttcaccttggaagagaatctgagactcagcatgtttatctattgagagtggactttgtaataaccttattcctacagttgattctttatgactggaaatactctgttaaaatgagaagccagattattaccttagggatttatattctagtaggacagataacagatacagcaaacaaagggtctttcattcgttgagaaactaataataatttctaaatatgttgtgttctaagaatgagtcagaatccgttccttttctacaaagggcctacacagggggtggagaaggaaaataagatttgaatattaaaaattttcacttaaatacattaatgctattaagtaaaatagcatttcagttaaatgctaaaagttagcatacatctttttattgtgttcacaatagccacactactattgcaattccaatactattacaagctcagactgaagcttgcaaaagttgagtagtgtggttcccaggtgttcagctagtaagtcatgcagagtctgagtttagtggtaaaggcctttccattatatttctccatctcatgtggaggaattccccgtgacattcttttctcttgttgagacttccttatagcacccttagtcttcccagtaaaagttttttttttttgatgatacaccaacataaaatgagccaggaattacttagagtcttgtggcacccacacaatggagactttcctaataggctttcctggagccctccagagtgtgcttaatatactcctcaccttgtgcctccccgtggaggaggtcttaatggtttactattgaggagtgtctctgactctatgaccacataggtctttttacttcttttctcccaatatgtcaagtgtgaagtgattggacccaatgattctttcttagttggcatccctgactgttcttaggcttctgttccttaaattcagactctgcaagaagtaaactaatgtcatagaggaaaatgacttttccacagtagcactgatttttctgttcccgagattctttgattctaatgacagagttaaatttgaacatgggaggaaaactgactttaaacagtttatggggagaacatctggagatttaaactcatgaaaaattcagtgtaagccaagaaattgactcagcagcattaaaaaaggagctaagatgatcttatattgcattaattaaaatatattgtccagatcaagagaagtaatagtcttcctggactttgtgttcattagatcatatttggagtattctgtttaatttgggtcccagtttactttgatgggaaagagccggggagatggccaggaagataaatgattttaaagcagtcatgtaaagactagttgggaatagaggatatttagagaatataaatatcctagagaagagaggactttggggatatagttgccgtctttaaacagttatgtagttaatttggcaaacaattttagggtaataagagtaaaagacacatttattggatatgtactatctgccagttaagtttttcacatgctttatctcatttaatccttaaagcaagtgtatggattgctgctagtcattgttaccgctgttttactcatgagatccagaaaggggaattgatttgcctaaggttgcattatggcaaaggcatttttttttttttttttgagatgaagtctcgctctgttgcccaggctgcagtgcagtggcgcaatctcgggtcactgcaacctccgcctcccaggttcaagcaattctcctgcctcagcctcccgagtagctgggactgcaggtgtgtgccactacgcccgtctaatttttatatttttagtagagctggagttttgcgatgttggccagactgctgtcttaacttctgacctggtgatccgtctgccttggcctcccaaagtgctgggattacaggtgtgagccactgcacctggccagggatgtaatttggaagtgaaaaagtatataggttgttgttattcctgagagtagaatataatgatagctatgtttattgagtgttgttatgttctaggctcttgttatatactgaaaaagaaagaaaaagtcctatcttcatggagcgtacattttaataggaaattcagaagtagataaattagttataaatttgttgctagtggtaagttctatgaagaaaaataaagtagtaggaggagaatagaggttggtagatactgaggatggtaggatgatcagggaagacctcactgagaagaaaatatttgaacaaagacttgaaaaaaattagacagcaaagttggatgggcatttggagaaagaacattccagagagaagagatagcaggtaggaatgagtttggtttgttacaagaatagctaggtggtcagtctagtttgggcatagtgagcaaagttggcaaggccagaatcatgtagagttttattttttttccaagcatgataagaagttgttggagggctttgagcaagggagtgatgtgatctgatttctagtttttaaaaaaatacctctgattagccaggcttggtggcacatgcctgtagtcccagctacttgggaggatgaggctggaggatcccttgagcccaggaatttgaggctgtagtgagctctcattgtgccactacactctagtctggccaacaaagctgagaccccatctctaaaaagaaaaaaaaaatgcctttggtgtggagaatagactgggcttcggggtcaacccaccacagctgtgatccagcaatcagaaaactgctgctggtgaaatagccatcccacacttaccagacacctaaataaggaaactgtctactgcaaaacctcactcctgaaagagcttgtcactgctgcaggaagaatggcgtctatcccttctaccttccagattttgctcaaggcattccaacatttaagaagaggatgatagaacagaggagaaggacggctaatgaggttgtggaaaatctaggacaaagaggtgtcccagaggtcaaagtaaattaaatatttctaagagagtgattaattgaatcaaatattgatggctgggacatggtggctcacgcctgtaatcccagaaatttgggaggctgaagggggaggattgcttgagcctaggggtttgagaccagcctaggtaacatagtgagaccctgcctcagaaaaaaaaaaaggttgctgattggttgagtaatgtgagggttaagaatcgaaagctgggccgggtgcggtggctcacgcttgtaatcccagcactttgggaggcccaggtgggcggatcacgaggtcaggagattgagactatcctggctaacatggtgaaaccccgtctttactaaaaatacaaaaaaaaatttgccgggcatggtggtgggcgcccgtagtcccagctacttgggaggctgaggcaggagaatgacgtgaacccgggaagcagagcttgcagtgagctgagatcatgccactgcactccagcctgggcgacagagcgagactgtctcaaaaaaaaaaaaaaaaaaaaaaaaagaattgaaagctgaatttagcaacttggagctcactggtgacatatataagagcagttttgatgtgtggtgaaagtggtacaaagaagaatggaagtgttttccaacattttaaatgattgaacaattataattatgtgactgtgagaatgtgtataaaaatagtaacaataaagaattttaccatatagtatccatatgaatcgtggagattgctgtgtgataaactttgcagttgagaattttatgacaaattaggtgcagagtttagtgatccagtaatcaagaaaaagaatgcttgttaattatttgaaataaaatgtcattagtgagaaatctttattgagaatctgttgttagtagaccttgtgttactctgtcagtcacccccctccattctgtcagtttgaatggggagctatgcacagaataaacagtagcggaatgaaaatcagagagttgttttatgagtaggtgcccaaaggaagggtgcagtcgctgaaactccctggaaaaggactgggttaaaatagggggatttaggcccaagggaacctcctacattacccctaaatctaaatcttggcctcagcgtgctcagtcatatttttattttggggtgtatgttggtgagggagagaaatgaagcccgttgtcatcttctattataaaattttacatggcgatataattctgtgtttaattattctgtatccctccatagatttgtgggggacagggactctagtttatcttgctcacggtaacagccactggtgcttagcttgttccctgtcatggggcaggtgttaaatttataaggaataattgagagtttatcaggcagtataaggaacagaagataacacctgggtaccagcatgtggaaaggtggggaatgcttgcctgacacgttaaatacattcttagagatgtagatcacattcctctgctttaggaagcattgttggatctcacttcgttcctgtacccatattgcacatagaaagtattctgtgccctggatactttgcgttattcaccttacattatcatatagatacctccttatctcctcaatactagtcacaactttttttgattgcctgtcatttgcaaatattgtgctaggtgttgtatatattttatcattctatttaattctttcagcaaccagggacattaggcaaatgaataaattgaggctcaggaaagtttaacaacttgtctaagattgtacactactttcttagcaccttccaaaagcttgaggcttcttctgttccatggtgttttttaacaggatacatacttcagtagaatttgtatgcttaatgaaagtcttttatactttttttaagatcttaccacaattcctttcttttttgttgattatttgatcaaagggccatgtaattctaacacttcttgaaacattggagctgaaaagtaagactggtgaaatagctgactttaaatattgcgttttcaaggctaaaaatgagtgtctaacttactgattcattgtatgataaactaatattatagaactgtttttatatagagcagacagaaaaagttttataattgctctgagaaaaaaatatacttactcaaaatgtgttaagcattccaattttgatgcttcaacacggagctgtcccctgtagccttggagaccataacttcacagtgcttgtttttaaagtaaggttttcttttgaatgtaagcagattttgatggtagaaagaagttgtcgtgtggaattattctgtggagccatttgaatagacttgaaacattgtttatgcataaataaattcaccactctgaaaagtattctgacaaggcacggcatgtgttggcatctgcaagtcagcctgtactgagttttcactacccacaagaggtggtgaaaacgatctctggtataaagcaaatggaaaaggtaaagtgtcgggattttctttctttctttctttctttctttctttctttctttctttctttctttctttctttccatttttaatttcttttaacctttcctgggtattcatcaaaagtttcttttcaaaattaattttttggtgagatacagttagcatgacagaactataaatgttgatgttcattttatgtttttttgggagtttgtttctctcttcttttcctttttttaatgctgttttgcaaataatttgtgtgatcatttttttcactatggaccatcattcatgtgttgttttcattcagcagatacttattgctcttctagttattatactgttatgtgctggagatacaaatgtcacgttatgacaccagccttccaggagattttagtctagtgtgttagtcatacaactatgcacacagacacagtacagtatattaaatgcttggatagtgtctcatgcttgcctgttgggaacacagggaaaagagaccccaaggtagtcatgggaaacttcctggagaaagtgataccatctttccttttgttccccaaacaaacttagcccccaattgcacctggcatattttaaaaaattaaagtgaaatctgcatacaatttttaaaaaatcaaattctaaaatgaaaagtaaaagttctcgttcaaccctcccaaccttgacccagtcacagcccttagtaataaccacctttcacactttctattttcccttatgatggttatcattaaaacatgaaacaatgtatttgtttctgttatttaatacaaaaacattaaatagtgatttggctttggacaatgaaagatgaggaatttaccacatttataatacctgccaccttctctctctcactctacctctgtgtttttgttagctatctcatttttacattatcaagtttaaaaaaactttacatgttatgttgttataatcagctcctgtgctttgtctatagggtgactttaggagttgagccacagacaaatacccttcataatattattataggcagaagtagtgaaatgtgctaacactggaagaatttcccaagaatcaaggtccagtggtccaatggatggtttgtcttttttttctttttaccacaaagacctgacttttttctcattggatatgtgaattccaaccttctttttgaatgacatttagtatggtgcttgaaaattcaaacagaataatgcctcatttatttggcaatatcaatttataacagccaaacagtaatccaaagttagcattaaaaatccgctaagcaaattggaaaggaagaactcaaattatctttgtttgcagattatatgatctttatttatttatttatttatttatttatttatttattgagatggagtctcactctgtcatcaggctggagtgcagtggtgcgatcttggctcactgcaacctctgcctcccgagttcaagtgattctcctgcctcagcctcccgaatagctgggactacaggcgtgcatcaccatgcccagctaattttttgtatttttagcagggatggggttacaccatgttggcaaggatggtctcgatctcctgagctcatgatctgcccgcctcggcctcccaaagtgctgggattacaggcgtgaaccactgtgcctggcccagatgatatgatcttatgtttggaaaaatcctcaagactcaaccaaaaaactgttagaactgataaacacattcattaaagttgcaggatacaaaataaacatataccaaaatcagtttctatatgccaacatgaacaatctgaaaaagaaatcaagaaagtaatcccattcacaatagctacaaataaagttaaatatctaggaattaactaaagacatgaaagctctgcagtgaaaactacaagacattaatacaagaaattgaagcagacacacaaaaatggaaagatattccatgttcatagatttagaagaattaatattgttgaaatgtctgttctacccaaggcaacctgcaagtttaatgcaatttctatcaaaatatcaatgacattcttcacagaaatagaaaaaagaaaactcctaaaatttatatggaaccacaaaacacccagaatagccaaagctatcctgagcaaaaataacaaaacttcaggaatcacattacctgactttaaattatactacagatctgtagtaaacaaaacagtatggtactggcctaaaagcagacacatagaccagtggaacagaataaagaacgcagaaataaatccatacatctacagttaactcatttttgacaaaggtgttaagaacatacattggagaaagatcagtctcatcaataaatgatgctgggaaaactagatatccaaatgcagaagaaggaaactagaccactgtctcttgccatataaaaaattaaatcaaagtgggttaaagacatgaatctaagacctaaaactatgaaactattaaaagaaaatattggggaactctccagaacattggagtgggcaacagttttttgagcaatatcccacaagcacaggcaaccaaagcaaaaatgggcaaatgggatcacatcaaattaagaagcttctgcacagcaaacaatcaataaagtgaaggcacaacctagagaatgggagaaaacatttgcaaactacccatctgacaagggattaataaccagaatgtataaggagctcaaacaactctgggaataaaatctaataatccgatttaaaaagagcataagatctgaatagacatttctcaaaggaagacatatacatggcagacaggcctatgaaaaggtgctcaacatcactgatcatcagagaaatgcagatcaaaactacaatgagatattatctcacgctagttaaactggcttttatccaaaagataggcaataacaaatactggtgaggaggtggagaaaagggaacccttgtacactgttagtggaaatgtaaattagtacaaccactatggagaatagtttggaggttcctcaaaaaaactaaaaactgagctattacatgatgtagcaatcccactgctgggcatatagccaaaagaaaggaaatcagtttatcaaagagatacctgtactcccatgtttatcacaatagccaagatttgggagcaacctaagtgtccattagcagatgaatggataaagaaaatgtgatacatatacacaatggaatactattccgccattaaaaaaatgagatcctgtcatctataacaacatggatggaactggaggtcataatgttatgtgaaataagtcaagcacagcaagacaaacatcacatgttctcacttatttgtgggagctaaaaattaaaacaattgaagtcatggagatagagagcaagaagtatggttaccagaggctgggaagggtagtaaaataggaggtggtggggaggaagtgaggatggttaatgggtaccaaaaaatagtagaaagaaagaataatacctaatacttgctagtaaaaacaagatgactatagtaaaaaaaatttaattctacatttaaaaataactaaaagtataattggattgtttataacacaaaggataaatacttgaggtgatggataccccatttaccctgtaattattattacttattgtatgcctgtatccaaatttatcatgtagtctgcaaacatatacacttactgtgtgcccactaaaattaagaataaaaaatttaaacaaataataactccctagttacaaaaaaatccactgagcagcaaaaacatctcatacctaaaatgttctacattttatgcctagtaagaatccataggcctcattcagaagctgtttactcttattttgtgtgtcattctacaaatcatgatctagtctccaagtctgtaacagattaaatgttataatttagtgatgctacaggcaggcacattgaaagccctaagaaatgtcatatgggaatctcatagagaagaaaggcagtctgtgcatatcatcctgaatgtgcctgatgttgtctgatctcagaggctaagcagggttgggcctggctagtacttagatgggagaggaaaggcagacaaaatattaaatgctgactatacaatttaaaaggtattatgatgtagggctgtatgatactgggcataatgatgctctagtgatcatcaacctttacaaaaagaatcactattttcattgtacagtgtcagaagacagggaagtaagtagtcattgaggatatattcctatccaaaatggttaaattttgaaatattgttcatacaattaaaaaagataagcgtatgatacagttatctggaaagttaatttgtgtgggagctcttctccaaggtcagtggaattgtatatttattatcacatttgtgacatgaatgggaattgctttattagttattaaaaactcaacaaattagctattgtgtgaattattactgggaggcagctgttgactttgttgtgaaatatgtcagctaggaaaaaaggcaatctgtctctctttctctctctctctctctctgctatatcagtggattgaccattatttccatggattaaaagattggacaggctgccactggggataaagggaatatgcttccttgtggaagagtcttggtttgggatactgctaccttaatactccctgcctttatttcttgagtattttatgtctttttccttggaaatatttccaaacttgaagaaacattacagaaatagtataaagagctttccccctgctaaccatttgaaagtaaattagaaagatgatccctcagtactcccaaaataaatcatggatatttgctacaaatacgaacatccttctagataaccatagtatgcccatgaaaaccaggacattaaccttaacatgttactggcatctcattcatccatccattcaagtttcttcagctgtctcagtgtcctttataactaaaggattccatctaagaccacaaattacatttacttgtcatgtatctttactctctgtcaatctgaaataatttctcagtctttccttaagatttttgaagagttttaggccagttaatttgtaatgtttatcaattttggtttgtctgatgtttcctggtgaagagattcaagttatgcatctttggaagaagtaatgcggaagcaatattgtattgtttttgcatcctgtcagaggggacacattttgatttgtcctattgctagtgatataaactttgaagccttaattagtgtctaccatgtttcttctctgtgaagttaaccttttagactttgcaatcagtaagtatttgtggggagatacatttttagatgataaatgtctcattttttaatcaaatctctgtccactagttttagcacatattgatgtttcttggctaaattaatttttttaaatgatagttgccaaatggaatggttaattcagttctcctacatttattagtgtgacattccatttaaggaaaagctttcagctttttctgtttaattgtatcaatgtagacacatggattcctgttttatccggtgaattattatctggtagtataagtatttattttgatactcaaatcactccagatttggccatgggaatctcttcaatctggcttctgtgttcttaagacatatttccatcactctttgagtatgtccttactttctggcataatatattacaggctcatattccctttgcccctggattagaattagtcatttctctaaggagttttgttttgttttagtacagaataataataataaaaaaacccactgttgattgacttaaacatttctgttttttagagacaaggtcttgctgtgtctcccaggctggcgtgcaatggcctgatcacagctcctcaaactcaagggattctctcatctcagcctcttgagtagctgggactacaggcttaggccaccatacctggctgatttaaaattttttagagatggggtcttgctatgttgcccaggctggtcttaaagtcctggtctcaagtgatcttctgttctcagcctcctgagtagctgacaggccaccaagctccagttaattaacttttaaagcaatttaaataataagaaaagtttttaggctgggcgcggtggctcacgcctgtaatcccagcactttggaaggccaaggtgggcggatcctgaggtcaggagtttgagaccagcctggccaacatggtgaaaccctgtctctactaaaaatacaaaaattaactgggcatggtggcgggcgcttgtaatcccagatgaacctgagaggcagaggttgcagtgagccaagatcacgccactgcactccagcctcagcgacagagtgagactctgccaatatatttaccatttctggtgctcttcatttcatttattttcgtctggtatcattttccttatgtctgaagtatttccttttgcatttctcatggtgcctttctactggtaattgaactctttcagtatgtctgaaaacatctctatatcatcttagtttttggaagatgctttcattgggcttggaaatctaggttacgggttttttatgtcttttaattctttaaagatgttgctccactgttttctagcttgtattgtttccagtgagaaatctgtcattctagtatcctctcctttatgtagtgtgtctttttttccttgggctgctttgtcactgttgcaaggcaatttgattctgtgtaccttggcatagttttctttgtgtttttcatacctggtatttgttggtattcttgcatctgtgggtttgtaatattcatcacatttggatattttgcaaccattaattattcaagtattattttttctgtctcctccttcattattttccccttcatgaactccatctaaatgtatattgggcctcagaagttgtgctatcacacactgatgccttttattttgtttttgttttagtcttcctctgtttttcattttaaatagtttctacccaaatgttcactgacatttagtatatcatcaggtttactgtttttcttgtaataactaatttgttcatccatcctttaaaaatatgtgtgtgtatatatatgtatatgtatatacacacacacacacatatatatatttttctcatttcagacatcatgatttccttttttttttgcagtcagctttctcagattaaacagacattgtgattttcatctctgaaagttcaatttgggtttttcaaaaattttcaatgtcactatatgttcagtctattttctggcttttaaacatataaattatagttgtaataactgttttaatggccctatctactgattctgtcatctctagcaattttggatcagttctgattgattttgctgctcattttggattgtattttcctacttctctgcatatacagtcatttttaattggatgtcaggcattgtcaattttaccttattgtttgttggatatttttgtgttcctataaatattctggaaacacagttatgttatttggaaaaattttcttcctttcagttcttgcttttacgcttcctcagcctgtactagagcagcatcaagtccaggattaattttacctacccctgaagcaaacctcttctgagtactttattgcgtggcccgtcagttatgggccatactctggctgtcaggaataggccctgttcctggtcctgtgaaatctctgctttttgtttcctctgtctaatccttttagattgtccttttcctggccttggatcatttcctcagatgattcactgatcagtactcagctgaatatttgagtgtgaccctctgcagatctctggagttctctgtgtgcagttctgtcttcttcagtactgtgccctgagaactctcgcactcatggcttccctggactcctaaatctttcttctacactcaggtagaccaccttattctgttgggatccccatccctactctgaagcctggaaactttctctaagcattaagccggggcaattgtagaactctcctcatgtgtttctctactctcagatgttactacaagttgtctggtggccagtcttgaaatctatcctctcatgttttcctagggtttttttttttaagttatttcaggtgggattaaatgcagtctctgtcactctattttggccagatgcggaataaattttgctggttcttaacattttgatgtcctaaagatcattttagtatcttcagggtaaaaaatgaattttctctacactgtagtgtaaggtgtggaccataccttgctacctctgtatcattttctttgtcctctttgttcttgttgaaacttgaaccaatcttatgggaagctgactatgggccaggcagagtagaatgggagttagattcatatgatctgattccttcccatagagaactcagagcttagagttacataatatcctctaaatcatagctcttaaattggtagaactgagttttgaaccatatattttggccttcccgttgaatgtctttttcactatagcagtgttcttgaataacccccatacatatacatacatagactcacacatatgcatacatacacacacacatacacaccctttgtaactcaggaagcctcatgagcatatggtctaaagtgttcacccccttcagattgctttttgcttatcagtgattaaaaggcttgggaggcatttgagaatgtgtgaggctggtaatgaactggaggtccaacgggatgaaaagggaggaaaaaggagagtgtggtgtcttattttttggaacagacttcaataattataattactagtatgctggtataaacttgcctttggagacactgtggtaattttgatttatgtccagttaaaactgcaacaaaactgccaatacagaaggaattctgtgtttactcattttcttcagatagtaggccaaatggagaaattcgttaagccaatcctgaaacactataccaaaaacttaaatgagcaaaattaatcacatgtattggcaataggggattccatgaaaatgtttcaacttctggcagcaacttttaaactttctaatttcagtaataaggctatttgcataactctaaatgtagcaggcaaatggtacaaagaagaaagaagacagtgtggtgtagagaaagaagggaactggaaattaagaaacttggcctttctaaactggcatagctttgagacattggacaagtcattgaatcttaactgtggtttcattttcatatttaaaacgagagcattgaattaaaagacttctaaaataactcctagtactaacattatcatggtcctttgactataaaggtgaccttaattgacttaagagtcagttttctagttatttctaaaactaataacattttaaaaaaatgatttactatactatcacattttctattctacttaaaaggtcattgtccagtttgattgccttgtaattcacaaaaatttagcccagattaattttaatgattcctaaaataccaagtcctctagcaaaggtggagatttgccattatagaggatatccagtgatggtaccacaagttttgtggagaactccccaagtgctttggacagtggcattcttgctggaataaatatgtaggttgtaaggggatagtaataattagagtcactgctaatatttgagtacttatcaagtgataaaactgtagatgcttttgaagtatttagttatcagaataaacctttgaaaaaatgtatgatttttatccccattttgcagatgaagcacgggacttttggttaatggttaataagccactgagctgggatttgaaccatcactggcaccacagcctaccttcctaaccactacactatgctaactactatatttataaaagtcaaatgtatcaaattgcctgatgtatttccacaagtagacatcattaattgtgaaaattctgccttcaaaaaaagtcctttgacattactactaaattatctgtcattctgaactgtttgttaccattctgcaaaaaaaaaaatgaggcagttttgccaaaatgttttcagcaatatccttaataagcacattgttgagttcagctgacattttgtaagcaagattttctcagtgaaggaagtagtcattcattgacttacactcaagagcaaactgcataaaaatgcccttctcactttgcttttatgagctacccaaagtctgtgtaaacccaagaatatagatgaaaccaactgtttctgttcagatttttgttgttgtctctacttctccatatctttattattaatttccctggaaattagaacttttctaaaactgtaagatatttaaaaatcttaaaatgtgttttcctttctaaaaagccttctttaaagttactcattactacaggttgagcatcccttagccaaaatgcttgggactagaagtttctcaggtttttttgtttgtttctttttggaatatttgcattatacttactggttgagcgtctgaaatcccaaatgctccagtgagcatttcctttgaaggaaatgttgatccacttgtttatgctcaaaaagttttgaattttggagcatttttgaattttggattttcaggctagggatggtcaacctgtatcaccatatctgacattcccccctgcaacctgatattatttcctttggtgcagagtttcagaatcaaattaaggaaatgtcatgtttccacagatgagttctctgaaaaacttcctcttacagtgaaagtcatagtccaggagaactttagatgtggaacttcagggccaggtggaaggccattatgaactcttgcattggctctcttatgatcataagcctgaaagtacagaatcctggaaaaggaggcctctctctgcacccatgtaatttttaaaaaggagagaaagatatgaagggtgctaaagcttgatcctaaaagatcagggcaatgaaaacaaatgataatgaataactagtactagaattaaaaatgtaaggcattttaaagagatggggtgccagttataattcagttttgaatactacattgcaaaagaactatttttgaaaatagttaagggaaaaaatatctgaattgttgaataagttccccctatttattcctggtaaacttcaatcccatcttactgcttcattctaagttcttgtggagtgtgaatatcagcaattttctgaccttcaaagaggaacttgaataatttcattggaactctgtgcgttttttgatagtatgattctttgagtttcttgggatgtgttgtcatttttaccttgcagtgaacctcactattgtcctgtctaatgactttgaataaaatatatattttttctttcttgtccctgaagtccatggtggaagcttttgcctcttgtttagacatgatggtggtggcttttctttcggatctccacaaacagcagattcacagcgggagagtctttctctctgagacttacaaatccatgttttttcttcacagctcaacaccactgctttctgttaagatgtaaacaagtctaataatttctttttcaaatgccgttctgatgaaaacctgagtagttaaaaaatactatttaaattacaatttaaaaattgtacaattattaagtgtacattaaacacttgctaagtgtacagctgtttatcagacacaatacaggaggggatacaaaggaagaagacaagaagcgaattgtctagttgaataagatttagcttgtggaagaattagtgtcaagataaatgtattcaagtgctgaacttcatggtacatatgcttactgaataaagcagcatgaaaggtcctttgtatccttagtttatgagccttaaaacagatttagaaaaaggaaaagccaactagacacagtggtgtgcacctatagtcccagctactcgggaggctgagacaggaggctcacttgagcccaggagtttgaggttacagtgagctatgatcataccactgcactccaatctgggtgacagagcgagatcctgtctctaaaaaataaaataaaaaaagtcccacctcccaatactatggcaattaatttcaacatgagtttgggagggtacaaatatttatactatagcacctataaaatcatcatggcctacaccctcccacccccactttggtagcgtttttagtttctttgtagttatcgatctattcaggttttcaacctcttattgagacaatttggtaatttatagtttgatagaaaatcattcacttttcctgtttttttttttttttaaatttattggcctaaagttgtatataatattccttttaaattgtaaaaatcttgtccatatctgtagtttgttttgtttattgtttctaattctgaagtgcttttctgtatacttcctcaagtgtgtttattgtgtaatgaatacattttaaattaaacttactaaaatgcacatggatagtattatgaaaaaatttggaatgatttagcttgcttttatgccaaatgtggttcttcttgcctgaaatgagttagttgagatgtaaattggaaatgcgaagagttgattattgttctataactgtcgcttcatcagtgttgttagtttttgagggtatgcatatcctggttagacttgatgcactaattatcacatgctttcacaccacctaccatctcctcaatagaactttcccacccacgatgctatttacttttccatgaaagtaggttaattttataagtatttataagcaatagtattgtcttatttgatgccattaccatgagattgtgttcttcccaactatgtgcatggtctagacagaggaatgtagaagcaggcttttgggtagactcctggtcttttgggaaactatcatatttaataaatccatcaacgagtatttgagtgattcccatgtgccttagactgctgtaggtgctgtagaggtgcagagaatttattaggcatttaaagtctatagcactgtagctctgatcaacctttccagcctgcctctcatgatattgctcttgtgccctctttgttttatagcacacaacccactttctgttctgaacgtgtaatgcactctgcttccttaatgactttgaaaagctattcccaataccctaaacagcagttcccttgcatacagctgtcagagtcttagctacccttccttcatattggagcttaaatgctgtctcctttaatgagcctttcccaagaacaagttatcttagactaatgtatccattttgcaagggtacttagatttgtagatacagataacttcaataatgtgtttgataaggtatgtcaggatagctttgggagcaagatgaagaggtgtaagctaaatgacagaaaagataggtcgactggtaactacttgatgacttgctatctagagggaaatttttaaatgcatggcatagggctctgctattgacctagtctttttcaacatgtccattcatttgattacttacctgccaaatgtttattcagtactgcatgctggaaactatgcaatatgctgggtatacagtggtgatcaagggagacatggtttttcctcttgagaataccacaatctaagcctttgaacaaagatatagaaaattgactaagttaatgcagtggtaacgtggaacttatagagacagtgattattgcgtaacggaattagtaaataagatctctggggactggaaagatagaattatattcagctcatcttaaattttaagatagagtttaattgtgaaaagaatatagtcttatacttgagtcctaaaaccaactgtatcagaagagggaggcttggcatatgggcaacagtctgagtaaaaaaagatacagaacctttagtcagtagtcaagtcaatatcaataatcagtgagatattactgccagaaaatgttgggttattaaattgatagacatgtagtgtctacaatgagaaatgatcagtcttttctggtttacaaacattaaacaatgttctcaaggcagtttcccaggagtttttctacgcttgatatacatctaaaaaaataaattaattatcactgaataaatattgcatagcatctgagaaaaatagaatcagagaaatcttaaaataatcatttttaattccgtgggtgtctgttgtgctttggggggttaagagaagggtgagatgtgcccctctgtatttctgaggaaggaaagggagtaatctttattacagtctgttactgaaggcctctatatacaaagtactacggggaagctcaggagcacagacactaccaagttataggcctaggttttcaaggagtgtggaatccactgctggagaaagccggaaaacaaatgattatagatgatatgaagtctagatggagcatgctcccagtgctgttgagggagaccacaacccttaccaaatattgactattcctgggctcctacttgagttcttcctcttccaaaatgaatttgtgggtctgttttgtacctacaggtgcctggtctttttgcattgcagcctacatacatgacatctcgtggtcaggcctccaaatgacttatttatttgccttgagagtaaagctccttatcctaatataccaggttttcataatctgacctctgcctgcctttttacctcatctcttgccatcctctcccatatgaccctgtgctccagccttgctaagctgcttacagttcctgaaaatgttagggtaccttttttttgtttttgtacttgtttttgcttttgtctggaatatctttctccctttttatctagctaattcctacttttccttcaaatgttggctcagtgtttaccccctccaagaagacttttgcttccacttgaccccgtccctagaatagatgctccttttttatgttcagcccttacccgatgcatgcctgtgttgtagcctgtataatgctgttatgattgtttacaaaccaagttgtctacaaagtttgagcattatgaagataatgctctgatctctgtatttttattacttaacagagggcatggtgaacatttaggccttcaataaatgtttattgcatgaatatgtaaataaatggtatatttttagagagcacagactgtctgcaatgttttttctcttaacactagactcagtattagcaacatagaaagtgctcaatgtgaagacaggatgaatgaataaatttaaagatacgttaacatgatcagataaggaattaggctaaagatttataatgtgcaggtgttattttgactaatgtgataatgtgctcagtaaatggaatcatgaagagatggctgtgaaagaaggataattaatatttggattgaaagaatgtattagtttttgattgctggataataaattaccacaaatttagtggcttaaaataatacctgttttattgtttctcggtttcttctttaggccggaaatttgggaacagctgacttggttctctgcttatggtctcatgaggctgaaatcagtgtcagctgcgctgtgttcttttctggagctcagggtccttgtttaagctcccatggtttttggcagagttcacttccttgtggtttataggactcagcctcttgttctcttgctgatagtggtctgagggctgctgtcagccccattgaggccacctgcagtttcttgccatgtggcccactttataggccctctcatgcttcaaatctcttctttcaggaagggccagtcccttttaagggcttacctggttagagcagacctaccgtctgtattagtcagcttagactgccataacaaaataccagtctgggtggttttaacaacagacatttattttctcagagatctgaaggctggaactctgagatcaaggtgccagcatggttcagtttctggcgaggctctctccctagcatacagatggccacctgcctgttgtgacttcacatagcctttccttcttgcatgcgtgtggagagggagagatctttttctcttcctgttcttttgaggccaccctatgacctcatcaactttaattacctcctgaaagtcttgtttccaaatatagtcacattaagggttaggatacttcaacatgaatttggggcgggggatgaagggatacagttcagcctatagcacccagctaatctcccttttggttaactcaaagtgaactgatacgtgaccttaattatagcccctcaattccttcaccttgtaaagtaacatttctgggagtaatatcctatggtgtttataagtcctgctaataaccaagagaaggggattatgcagagaatgggaatcttggggtgacattttagaattctgcctaccccaaagatagtgggataaaatgcagcagcagatttagttgagatacgagttatattatgaatagaatcgtagaataatggaagagaaaagcacacagcaacctgatatataaggggaggaatactgagcttggacacatatatttggaaggtttaacctaaataatgtgtctgtgaaaaagcactttggaaactaaaattatttaacatgtaaggtgttactgatgccaaggtttgtggggagatgatgacaagattagcttaggaacgatgggtttgtgggtgggaaataagcagtgaagaccacgggctttggagttaaacaaacctgggtttaaatagtgattctgccacttaccagcttcagttttctcacaggtagaacgggaatgattacgtctatggatttttgtgagaattaaatgaaatatccatttcaagtttttagcttagtgcctggcacatagccagcactaaataaatatgtattcattcaccaacgaattattaaataaatatattctatgtgccaggcactgtattaggcctcaggtttctggtaaatattaatactattgtgcctgagctagatttcattggactttgaattgccaggctaaaacaacagagtttaaatgtttatttaaatcgccctgagctgttttcaagcaaagaataacatctaatattagctttttagaatttgtgattatttggtgctagtacatggtggtttttttcttttgtataaagagctcaaatttgcctgtagtcattctaattattgatacactaagacttaaaagatctccatacctcttacatcattgttttgattttttgaaggacgctattgaaatctgtgttttaggagagcattctcatggcagtgttccaaatggattgaaaagggcagagattaaaaaggaaggccttttattaacgcagaaccagggtgcttacagtgggaatgatgaaaaggaaattatgcggataagagcattgggaaagaagaatcaataggtttaggtgattgaacacaggaagtatgagtgagggaaaaggcagcactaatataatgtgatgtcagttctggagcactgcagtgattcatgactatcatggagcggatttatttgataaaatttatttgaataggtggatttatttgaatagaattctttaaaaaatggaaaattcatttagtgtagaaaaatgtagatcacgcctttttagacaccagaaaaatccttttatcatcgatggaagatgttatcaacatgactagaagtacatatatgttaattacccatagatacataatgaaaggaactgtgtaggcaaccacacactagctattagagggcctagagtatctaaaaggttagtgtccatcagagaagaagaaagataaagtggtgaggtactagatgcattagcacgaatctttgaaattgtaagtttatggattgtgatatttctagttgtctctaaggaaatataattttagatgtgtataaggcaggcgttctggatgctgttggggaagataaactacaattagtaaccgagcaaatgaagaacagggattctttggtactaagaacagaatagaattgagaagaataagagttgaagctaagaaaccagttaggggctattggctaggtggcagtctatctggggtgaggtgaacggatttgaaatggctttaattaagtcgttgctgctaaatatgtagaaactgtctaggccttaggttgcttgatttttgtgacagtggtcattcctcccttgatgggctgttcctttaactgctgtcataccagctctcccagctgtccttctgcttctccctggatattctggttcacaattttttgcaggacttttttcccccctaatttcttaagtattgatattcctctggattctgttctaggttctgtttactctcattctcgcagtcttcagggtgatctcattcactttcatagcgttcataaccatctgtgtgctaatgactgccacatttttatctctggccaagatctgtctcctgagcaacagatctttatattcaactcatattcaacacatcctcttggatgttacacaggcacctccaactgaaaatagaactttcttctcaaactgttgctgccgtgttctacatcgcagtaaatagcatcaccattttttctggttccccaagccatataccagcaaacattcttttctttttctttggcagtgtaatttatatacaataaaatacatatatatatatatatatatatacacacacacacacacatatacacatatatatatacacacatatgtatacatatatacacatatatatacacacacacacatatacacacagtttgatgaattttaataaatatacacacctgtattgccattgttaaatcaaggtatagagtattttcattatccagaatgttccctcatttgccagagttctgacaccctcattcccatccctgggacacttttcttactgccttatcatttattagctttccctgtttttgaacttcttataagtggagtcatacggggcactcttttggtttctggcttcttttgtttaacatacaatttttggaatttatccatgttcttgtatagattagcagtgtattcctttttactggtgaagcagtatttccttctatgaatatattacagtttgcttattcattattctgttgatggatatttggattgtttctactttttggctattataaataaagccgataggaacaccttacacaagttttttgtggtcatgtgctttctcctatttatttatttatttgatattttagagacagggactcattctgtcaccaggctcggagtgcagtagtgcagtcatagctcactgtaacctcaagctcctgaactcaagggattctcccttcagcctcccacgtagctgggaatgggtgcgcactaccatgcttggctaatttaatttttttagcgacagcgtcttgctgtgttgctgggggctgatctcaaactcctgatgtcaagtgatttctcccatctcagcttcccaaagtgttgggattacaggcatgagccaccgcacccagcccacattatacctgagagtgaaactgttggcttatacgagaggtgtatatttaacttattaggtattgccacacaggtttccaaagtagttatacatttttacagtccctccagcaatgtttgaaaagttccagttgctctacctcttgccatcatttggtattgccagttttgtaagttctagccattataataggcttgtagtagtgtatcattttgattttgatttttacttttataatgactaaagttatgagcaccatttcatgtgctaatagctcattcttgtatcttattttttgaagtgtttgttcaaatattttgcctattctcaattattgggttgtttatatttttatttttatgtaggaattctttgtgtattttggatagaagtcctttgtcaggtgtacacacacacacacacacacacacacacacacacacacacatatcccaagtgtttttttctcagtcatgacttgattttttttcatttcctcaataatgcccttaggactaatttttgcctagtcagagtttttgcatatattttcctatgtgttattccagaggcactgtagtcttagcttttacatttaggtccctaatccatctcaaattaatctgtgtgtatgaggtgaggtacaggttaaggttcatttatttcctatatacgtattaagttatttcactgccatttgttgacaaagtttttcttttccttattaaaaaattgagtatgtatgaatgattctttctataatctgaaatgtgtgtgtgtgtgtgtgtgtgtgtgtgtgtgtgtatatattttttgtttgtttgtttgtttgtttgtttttttgagatggagtttcgctcttgttgcctaggctggagtacaatggtgcgatctcagctcaccacaacctctgcctcccaggttcaagcaattcttctgcctcagcctcccaagtagctgggattacaggcatgtgccatcacgcctggctaattttgtatttttagtagacacagtgtttctcaatgttagtcaggctggtctcgaactcccagcctcaggtgatctgcccacctcggcctctcaaagttctgggattacaggcgtgaaccaccgcacccagccctaaattatatttcattgatctgtttgtttagttctgtgtaactactgctgccttacttactgtagctttatgataggtcataaaatctagtagtgtaagccctccagctatttcccgcccccaacattttcttggtgttctaggtcttttgtatttgcatatcaattttaaaagcagtttgccaatttctattaaacaaaaatcttttgggtttttgattgggattgctttggctctagatcaatttagggagacttgactgcttaataatatcgtatcttccaatccatgaaatgatatatgtctccatttatttaaatattctttaatatctcagcggtgttttatggttttcagtgtacaggtctttcacatctttctttagatttattcctagttatttattgatattaaatagaaacactgattgatttttaatatattaatttaaactcttgcaatttgccgaatttactcattagttctagtagttggattgtagatttctttggatttttctacatacacaatcatagcacctttaagtagatttgcttcttcctttcctatacctatggcttttatttacttttaaaatgcattattacaatggtttggaccttgagtatatgtggaatagagtgatgaaagtgggtatctttgccttgtttttgattgtaagtataggattagctgtagatttttttctataaaccttttatcagattgaggaagctcccctttcctcctagtttgttgagggttttttttttatttttaaccattaacaggtattaaattttatcaaatgcttctttttttgaatcttttaagataattatgatcttttttcttcattctgtcattgattgattttcaaatattataccaaccttgtatagtatttgaaaatcagtcagtttaacagaatggtataacctactcagataaacccacttgatccagttgctttatccttttcatatattactagagttgatttgctaacattttattaatggtttttgcatttatgttcatgtataataattggtctataatttttttttcctatagtgttcgtgtcatgttttggtatcagggtcatgttgacctcatgaaacaaactgaaagcatcccttcttcttcttggaaagatttttgatgctactggcattttaccggtgaagctatctgagcctagagtttcctatgtgagaaaatttttaattgcaaatataatttatttaacagatggtggttctttagattttctgtttcttttgtttgttttggaaatttgtggattttaaacaatttgactatttcatttaagttgaatttattggcatacagttgctcataatttctccttaattccttttaactatgtgaaggatctgtagtgatgtcttctctttcatttttatgctggtaatttgttttcaagcatcattctttatctctcttctctctcacttttcacatttacaccatctttcctgtcactattttaatttaggacagagccatttgttacttggactgttggaataacctcacactaaccttcctgtttgcagtctcttttctctgtgtgccattcacctattacaagaagaaatatctttctaaagtgcaaatgtaattaaatctttcccagcttaaaactttttaatggttttctgatgccttcagaataaaaatctaagcaccttcatatgaaatacaaaaccattaattataaggtattgatttgtttcatagacatctgtctttcctgtatttcttctccctttttatctctctctgcaagccgtagggaactatacttcactgcctttgtaggtattctaatttgtcattctttgtcttaaacttgaatgcagggtttctgatgtcatatgatcaatattatcttctaacttctccttcagtgagattatttttaatatctcattggcttcatctcagttaatctttattaataatttacttgacataattttttttattcaatgtatctttacgttcacagaaatatatagcctcaaagcactttagtccagtttcagtttatctcaaatcatgttaaaaaataggaatgcatctctttcctatcaccagaatacctatcggatagctatttgatctctccttcccaacaccagtgacgataagttttatttcagcttgaggatgttagtgttgatattgaccactcacccatattactacatgatatatatttctttctttatagattcttttgatagtttgcaaaatcaagaaacattactctgaaattggccaaccagtttggaggtaaagcagttgtttcttttttagttagtccttcacctctttatccccaggggaatcaggatgtcccatgttatttttcaaagtctaaatacttcaaacttttattctcctgttgggtttgaaaggggggtgttattagctctgtcttgatgcagcaggggctctgaaagtctatttggataacactgaagattggaggaaatgtgactctgtctgtgtgttttaagcccctaaggtaagatcagaaagcgtctggggcagtgagagccaaatagttgaagtcatacattaattatggtcatgaatcatttttatttttaaagtctttaccatttgacaaggttgtttgcatagtaccagtgaagttttaggcggccctttcctacttttaaagtaacaggctattttgttgatttcttctctgggttgatgatgcctatcatttttagaattctgataacatttttagtaaaaattgctgtttcctcacttgaatgagtggtctctatgtgatttttattttgatacactattttgaagttacaaatctaggaaactaccacactgatcttccaattaatctcccactgatgtcaaaaatgtcaaattttgggactgtgcttttatgttcagacattaggcattaagccagcaaatacattttgagtccctcctttgtgccacattctgtgcttagcatttggaatacaccttagaagatgaaatttatttttcccccagaaagatctggtgaaataggcaaagaaataaacagttgctgtaaaatagggtcatgtaatatttttgtggtgccatacacatgaagtagcagatttccagaggaaggagcacctctacctgtccgtaatagtcaggaaaggcttttgaagaagaggttgcttgagctgcctcttgatggattaggagtttatttatctgttaagggatgggaagaacttgtaggcacatagaacaactcacacaggggtacagaaggaataaattataaggatatgtttggagagttgccagtagtttagtattgctagagaagatggtgcaaggtaaaaaataatcaggaatgagactggatgtgtcagcagggtctacatcacaaagggccttaccttgatgtaaaattactttagagctgtctttttaagagagtattactgtcaatgtagattaaacacacaaacacacccagaccaagaggcaacaggatggagtataatctcctctattggattccttaggagccctgagggatttgttgaattactggtcccatgaacaaaatagctgtattgagagttggtcctttttatgtgacctaagaaatcatcaataaatatcaggcaatttctaaaagtaaagaatatatcatgaatattttcagggtttagggtaataataataatgttggcagaggtagtgatatcatcaaatgcctaagaaaatgaacctctcatatatatgatgactttcaggttaggattgatgaccaccttttaaaaaccgaggtaaaattcacacacagtgaaatgcacagatcttaagtgtaaaatctgtgagttttggtgtactccttaccctaatcaagacatcaaagccaggtgcagtggctcactcttgtaatcccaacactgtgggaggctgaggcggaaggatggcttgaggccaggagtttgagataagcctgggcatagcgagactctgtctctacaaaaaattagtcggacccagttgcacgctcctgtagtccagctactcagaaggctgaggcaggaagatcccttaagtccaggaatttgagggggcagtgagttatggtcatgccagtgcactccaacctaggtgacaaagtgagaccaccatctagaaaaataaagacttagaacatttccatcacctcagatagttcctttgttccctcttctccctatgttagtccccaccactcttttgatttgtcaccataggttggttttacctgttcttgaactttgtaaaaagggaatcatacaatatggacttttctgtttctggcttttttcactcaacatattgtttttgagatccattcatattgttgtatgtaccagtggtgtgttcctttttattgctaagtagattttcattatatgaatatacctcaatctgttgattcttctatttgatagacatttgggttgttttctatgaacattcttatacaaagcttcttgtagacatacgttttttatttttcttgggtaaatacctaggagtagaattgctgggtcataggttaaatatatgtttaacttaataactaataatttctaaaaaatggcactattatttattaggctggtgcaaaagtaattgcaattcttgccttttttttttttttttgagatggaatcttgctctgtcgccaggctggagtgcaatggcacgatctcagctcactgcaacttctgcttcccgggttcaagcgattcccttgcctcagcctcccaagtagctgggactacgggcgtatgccaccatgcctggctaactttttgtattttagtagagacggggtttcaccatgttggccaggatggtcttgatctcctgatctcgtgggttcttgcaatttaaatttaaatttaaaataattgcaagaactgtagttacttttgcaccagcctgatatatttttgccagcaatgcatgcaagttttagctgttccacatccttgccagcatttagtgttgtcattttaattttatttattctaacaggtgtgaaatggcacctcattatgattttaatatgcgtttccctgatgactaagactttgagtgacttttcctgtgcttattggccattcttatatcttcttttgtgaagtgttcatttcattctgttgtccatttttaattggctgtcttgattactgatttataagacttctttatagtcagataggtgctttgcaaatatttcctcccagtctatggactgtttttttttttaaattttcctaatgggagctttgttaagattaacaggtatttctcatttttttaaagtctaatttattcctttttaattttatgattaattctttttatgtcttctctagtgaatatttgtctaccccaagtttgcaggagatagtcctacatttttggtcataagtgttatgatttcagctttttatatttactgtgatcctctttaaattaatttttgtgtgtatgaagtaggggatgagattgattttttttctatgcttattcagtgttccatagcacctttgtttaaaaaactttgttttctgcactgatttgccttcattcctttgtcaaaaattaatttgctatatatgtgtaggattattatgatacactttcttctgttccattgatctttgtttttttttttatctccatgaccacaccatattgtcttaattatgtaacttaatagaaactcttgaaatctggcatatttcaagattggtttgtcccttctagattctttgcttttctctataaattacagtatcatcttactaatttctgtcaaaaaaaaatcctttgggaccgtgattaggagtctcaagctatttacccatttgggaaaagctgacaacttaacaatatagaatcttccagtccatgtacatgtattttttacttactagttcttctttattgtagcagtgttttgtgacttcagggttgagtcttgcacatcttttgtttatttcatccctaagtattttatgttttttgatgctgtcattaaagtattatttaaaaatttcataactcaattgtttggggctaatacaggaataccttggagatactgaggatttggttccaggctaccccaataaagcaaatattgcaataaagcagtaaatcaaatatttcaataaagcgagtcacatgaactttttggtttcccagtgcgtataaaagttatgtttacactatgctgtagtctattaagtgtgaaatagcattatgtctaaaaacaatgtacataccttaattaaaacatacttcattgctaaaaaatgctaacgatcatctgaaccttcagcaagccatatctttttgctggtggagggtcttgcctccatgtcagtggctgctgactgatcagattggtggttactgcaggttggagtgattgtgacaatttcttaaaataagacaacatgaagtttgacatatcagttgactcttctttcgtgaatgattctctgtatcatgcgatgctgtttgatagcattttacccagagtagaacttctttcaaaattggagtccgtccttcccctcaaaccctgccactgttttatcaactaagtttatgatggcgtaaattttttgttgtcatttcaacagtgtttatagcttcttcaccaggagtagattctatctcaaaaaaccacttttcttgattaactgtaaaaagtaactcctcatccagtcaagtttgatcatgagatcacagcaattcagtcacatcttcaggctcctcttataattctaattctcttgctattaaaaccatgtctgcagttacttcctccactgaagtctcgaacccctcaaagtcatccatgagggttggaatcagcttcttccaaagtcctgttaatgttgatatttttatctactcccatgaatcatgaatgttctgaatggcattcagaatggcgaatcctttccagaatgttttccattgattttgcccagatccaccagaagaatcaattatctgtggcaactctaggcttatgaaatgtatttcttaaataataaaacttgaaagttgaaatgcctccttcatccatgggctacagaatggataatgtgttagcagacatgaaaacattaatctccttgtacatgcccatcagcactcttgggtgaccaggttcattgccaatgaacaataatattttgaaagaaatcttttttctaagcagtaggtctcaagagtcctaaaatattcataaaaccatgctgtaaacagatacattgtcatccaggctttgatgtaccatttatagaacacaggcagagtagatttagcataattcttaagggccccagggtcttcagagttgcaaatgagcattagcttcaacttaaaatcagcagctgcattaacccctagtaaaagagtcagtctgtcctttgaagctttgaagccaggcattgacttctcctctctagctatgaaagtcctaggtggcatcttatttcaacagaaggctgtttcatctatgttgaaaatctgttgtttagtataaccaccttcattgatgatcttagctagagctactgagtaacttattgcagcttctccattagcacttcctgcttcaccttgcatgtctatgttctagaggtggcttctttccttaaacctcataaaccaatctctgctgtcttccaacttttcttctgcagcttccttacctctctcagccttcaaagatttgaagagagttaggtccttactctggattaggctttgggttaagagaaggttgtggctggtttgatcttgcatccagaccagtaaaactctttccgcatcagcaataaggctgttttactttcttatcattcgtgtgttcactggagtagcacttttaatttccttcaagaacttttcctttgcattcacaacttggctgactgtttcatgcaagaggcctagtttttggcttatcttggcttttcacctgccttcctcagtaagctttgtcatttctagcttttgatttaaagtgagagacataggactattcttttcacttgaacacctagaggttactgtaaggcttggcctaatttcattattgttgtgtctcagggaatatggaggcccaaggagaggaagagagactgggaatggccagtcagtagagcagtcagaacacaaaacatttatcgataaagttcactatcttatacgggtacagctcgtggtgctccaaaataactataatagcaacaccaaagatctctgatcacaggtcaccataacagatataataataatgataaagtttgagatattgtgagaattaccaaaatgtgacagagagacatgaagtgaccacatgctggtggaaaaatggctccagtagacttgattgactcagggttgccacaaaccttcaatttgtttttttttttttgtttcttttttttaaatatctatgaagcacaataaagcaaaatgcagtaaagtgaggtatgcctacatacagaaatataattgatttttttgtgtatattgaccttatatcccatgaccttgctaaattaacttattaattttagtatttgttttgtagatttctgatcattttccacatgacaattatgtcatctgcaaataaagacagtttgaccatttggtatggaaatgtataagaaatacatgagctatatttaaagataaagaggccaggtgcagtggcatagggctgtaatcctagtactttgagaggccgaggcgggcacattgcttgaacacaggagtttgagaccagtctgggcaacatggtgaaacctcgtctctgcaaaaaatacaaaaattagccaggcatggtggtgcatgcctgtagtcccagctatttgggggcctgaggtaggagaatcacttgagcccgggaggtcaaggctgcagtgagccgtgattgcaccactgtactccagcctgggcgacagagtgacatcctgtctcaaaataaaattaaattaaagataaggagaccaagaagcaaaaacacaaagaaaaccataatttaaaaataaaaatagctcttaattttttcattgttccttgaaagagaccttactgagaatgtagttggctagtttgaacctggccgagtatttaattcctcctattactttgtcttttctatcatcttttggttttttcttatatctttgagagtgctgtctgctttgattcaaccttctcaacttggattactgtgaattctttttttcctttatggatacctagaagtaattgtcacctttgagagtggtgatactctctcggtgactttagcaatccatttaatttcactgggcgtcagtttccacatctataaatgataggattttactatattactttctcagggctcttcccaactcctttgagttcttcatcttacctcacagtacatcagaggcaggcaggcaagtacaaaaagggtgttttagagctttactgttataggatttattgtattccctgttatttcattgcgaatatgctagataattaaaaatcaattgagttcattattaattctatgtatcctccaggtttgtcatttatatctgaggctctttgttgagtttactgttaactcatttacatttttctataacttatatttctaggcttcatagagcccagtgtgcaattaaacagactcaggtaactgttcagaaaattggaaaggaaattgaagaaaaactaagactcacatctacaagcaatgaactggtaggtttttatgtatttacctgtttacacttcttgttttctaaaggagagtatcatattcttctagggttaattttaaaaaacgctttagatcgtttttatcttcttaattgtccacagagagttctattggcatttaaatgttggaaataaactttcccatctgctaataatgtaacgcatgaagtgcctgctttattctgctagatgaaactttatattacataaaattacttagaagataattaacaggcagttttattaatgtgaactctaaacatgaactatatagcgaatgaaaaatagccgccaggaggaaaaaaaaaatgggagctaatctacttttgaaagacgaatttaaaaagtatttggattgagcaaaacaggctggtttgtggacagtgatctcttttgggaaatactcttattaaggaggcatttccaaagaaatagaaatcctaacccaaatgggcagatttaagatattagtataattttgagttgtttttcctagtggagtggaaaaatgtctattttgtaatgaatattgtgtttttctaagcacaatagtgggtatggctaataaattgagcttttttttttaaaagccacttgggtatgaatagcttttgaggaactttgtgctgtggattggacttaaaataaaattcagatcttcaaattaagttctagataaaattatttaaatatttgttcgtgtgaactcattatcacagataggcagcatcttcctattgtcatttacacccttctcaacttagcagagggcctttatatccccaaatgaaagctttttgttgccttgaagatttgcccaagataatcatatagtagaagtatagaaaagcagcaatgcacttaaccttacagaaacttctctctcatggaatttgaaattaatatattagttcaaactgtatacagttgctgattttctagctagtgctatagctggcaggtagcaaacatacaaaataggataactgcaataggtatagtagtaattcttattattcacttgactttccttgtctataaaaacatcttccgtttcaaaggtgctgttaaaccacctcttgttgtaacttagccccagcaagactaaatttcagactataaatatattgaagggggaggaaaaatcactaattttaattctttctgtagtgtataaaaatgctggatttttagaacccttggggaaaattgctgggttttatttttgttttcctctcccaaggaaagactgggaaattaattgttgcattaaatgacagcatatgctttatctcagtgtggaaaaatgtatttttaatcctgtttttaaaggaatataagtggtgacatacagagcaaggtaacagaatgtgtgagtttaaagaggtcaagttcagaggttcattgtgtgtttttatgctgcctagtcaacacagaagaaaaatcattggatttttgaactgaacgtgaacctagaaatcatctggttccctaataaccccattcaaaactatagccccctcagtacattctatcccttttcctgctttattctgtataatattcattaccatttaccatgatacatattttgcatatttttctctctctctaagctctataaggcgaggggtttttgtctctctctctttttttacattggtgtatttccagcatctagaaaagtgtttgccacacagtaggtgctcaataagtatttgttgaatttaagaatgaatctagcataatgtccttttataataggacaggaaaatgaagcttaaagaagggaaacagctttcccacaatcatttgacaatagagatggataatttggtttacttgtttccttttagagaataatgccatctacatgttaattagtcagtcactttgaggtttacctatagcatattagaaaactttactatttgtctttttgctcatttacttttcaaattggcccatggccattgtattccaacccatccatttccgatatttaagaaatcattttcattttaacctacgtaaaaatgcagcaaagaaggcatatttgatgttgaaagaaatcagattaccttccaagaccatatatgattaactgtgttataagaaattgggttcatagttggtgactttcaaaaatttggcatcttctcacattacatcaatgcctaatgttttttggcatttaattttatttcttatgaaatttctgctgttatcattttgaatttttacttatgttttataagttttttgtttgtttgttttgaggtgagatctcactatgttgtctgggctgctcttgaactcctggcctcaagtggtcctctcacctgagcctcccgagtagctgggattatagacgtgtaccagcatgcacagtttgtgtttcagattttgtcagattcctttcctgtatctgtttagataaatgtatgttttttctcttctggtattaaggtgaaatacattggttgattttttaatattaagccaactttgcattcctagggaaagccctcttggtcatggtgaattactttttaatgctcattactggatttaatttgttaaaaaattttaaagaaattgtgcatatgtatttataaagaatattggtctgtagtttgtttccttgtaatctctttgtctcattttgttgtcagggtgacgttggccgcaactcacttttgggaagtgttttctccctttttgttttcaggaaaaatatgtgtagaatgggaattatttcttaaatgttaagtagaatttgcattgaagccatctgggcctggaggtttttttgtgggaaggtttttgaactggaaattcaatttctttaataatttaccttttgcattaacttttgtagcttgtgtctttcaaggatttgtccatttcatttaggaggtcagtctttttacatttagctattctagcagttatgtagtattttctctttttgttctaaattgtatttccatgatgagcatttttcatatcctattggatatgcatgcatcttttaataagtatcagtttagggctgggcgtggtggcccacgcctgtaatcccagcaatttgggaggccaaggcaggtggatcacgaggtcaggagttcgagaccagcctggccagtatggtgaaaccccgtttctactgaaagtacaaaaaattagctgggtgtggttctatagttcattgttttgtatcacgtacgtaagggtaattttttccccctgcatggatatccggttgatttagcatcatttattgaatagtcttttcattccccatttaattgccttgacatgtttgttcaaaatcaattgatcatgtatatgtgcatctatttctggattttcttttctgttccattgatctatatgtctgtatttccccaataccaaactcacttattatcatagatttgtcatcttaaaatttgacagggtaagtcttccaactttgttaaaacttctgtggtttttctgggttctttatatttccaactgaatttgggaatcagtttgtcaatttctacacacacaaaaaaaaggtctgatggaattttgataagaagctgtagataaaattgtggagaattgctatcttaacaatagtgggtccttcaatccgtgaacatggtgtatatctcttttacttagatttctctctaattctctttataatgttgtagctttcactgtagagattttggacatcttttatttatttatttatttaattttgagacggagtctcgctctgtcgcccaggctagagtgcagtggcgcgatctcggctcactgcaccctccgacttccgggttcacaccattctcctgcctcagcctcccgagtagctgggactacaggcgtccaccaccacgcccagttaattttttaaaaatatttttagtagagacgggggttcaccgtgttagcctggatggtctccatctcctgacctcgtggtctgcccgccttggcctcccaaagtgctgggattacaggcatgagccaccgcgcccggcagatgttggacatcttttgttagagttattctgaagtgttttatgggagttttttggcaggggaggcattattgcaagtggaattgtttttaaatttttatttctcattcgtttgctgctagtatgtaataatacaattaattttaacttattaatcttctgtcttgcaatcttgttatattaacttattcattatgctagttatttatagttttttgggattttctttgtaaagaatcataacaggaaagtttgcacagttttatgccctttatttgattttcatccagtacaatgttggacaaaaaaaatagtaagaacaggaatcctcaccttgttcctggttttgaggagaaacaactcatcatttctctgttaaatatagtgctaagaatgcccttcattaattttaggaagttcctcttattcctagtttctgagagtttttatcacgaatagaagatgaattttgtcagatggtttttctatatccattgcaatgatcatatggttttttctttattctcttaatgtgattaactttttggtttattttcaaatgtttaacattgcatttctggaataaacctaaattgattataatatataattatttttgtattttgttggatttattcttataaatttttttccttcgtattgtcttggatttgctttggtaataatttaaggaattttgcacttgtatttatcagggatgttgtgatacaatgttttgaattgcgttttcagattttggtagtaggattatggtagcctggtaaaattagttgggcagtgttctttttttcctattccatcttgcccaggagcagaaatctggaccttttaaatattttctagttctctgctgatatttcatatccttttattcactataagaatatttcaatttttgtcgacatatatgtatgagtggctttaaagtttttgtaattctaacatctggatcatcttggggttggcatatgttggttttctcctccctagagagtgagtcacattttcctgactcttcatatattgggtaatactgcatagtattctggacattgtgaatgtaatttggtggaatctctggattttgttactttgttccaaaaaatgttgatgtttttattttagcaggtagttaacttggttaggctcaaactgtcatgcctgcaatgaacattggctcagattacagtgtagttcttttactcttaggcacaagcttctttctgtttgtctcatgcatgtgtagtataggattcagtcagagacttaggttgaatttaaacagaatttggggtgcccattctctgccttcctctattctggtatacttgattgcctgaccatttttccctggttcctctggtcagaaaggaagttgactttctgttggagtttgcagccaccctcagggaaaagccacagaaaaggggaatttcattttattggttgtttatgccaagttctgactcacctccaaaatatgcctgccattgatcagtctcaagaaccctcaagtagcaatttttgtattttatccatagtctatatttgttatccatagtctatatcttctatgagaggaccagtttgttgcatacttattcttttacaccagaagcagagctcctgtacattttattattatatatttttgctgtatcctcctggctaaatccgggttctaagcctgttactgctaagtctgtgaaattaatggataggaaatattttctgcggaaatcttttccttttcttagtggttgactaggtgtaggtccagtagaaacaacctgtaaatgacatttaaaagcagatgtgttaacttttgggacagctgccacaattttaaaaccttttttctgattgttatttattttcaatttggggggaagaattactacaggtgaagataaaatataccctaagctgtcaattctcaaagttattggtctcaagacctctttgtacccttaaaaatctcaaagaattcagtaatacatttttatgaaaaataagcatatttttctgaacaaaaggtttaattagcattacattgcttaaatattttgtgaatttaactgctattaagctaatgtctagcctaataaaagacacctggattttcacatctgcttctgcagtgaatctgttgcaatatcgtaagtctcgcagactctggtaaactccatcatacacttatgagaaaatgagagtggaaaagaggcatacagcttagtaatatgcgaatatgttttatcttacaagactctgtaaagatgtcaggaaccctcacaattcccaggaacatgcttgaggaacttttgacctaaggcaaaaagctttagctccaatatgatcaatgtgaagacacttgttccattactggttgaacatctcaaatcaaaaatccaaaatccaaaacactccaatgagcattttccttgagcatcatattggtgctcagaaagtttcagattttgtagcattttggacttcagattttaggatttggcatattcaacctataatatgttatttatacgttagtcatctttctgaaatgaatgtttaacatttcccatttttttggcagagactcataaataggaatgtgtgtatctgtgattttcagttcacatatagtgttgtataaaaacactaaaatctaattaaatgtaatctattggcgaaatatatgtgacattacacttggagtaaacagataaatagaacactgaaactcattagaagattatggaacattaagatctttgagcagttcatctttgatgcattagaaaggaagtagaactagatcccacatgggtttgtttactcatcagaaattggagccaacaattctggttttgaatgacttgatatatttctgtaaatgagccagtttctgaacatggaccataacacaaacactatacatatgccttcccatattaatgtagtatttagattaacttgtaaccttagttctttaaatctagaaaacatatctcagtatgtaccctggaatagagcaggttatcctcctagccaggcatatccctgtgttctctgaatatttgcttttctttttctgtattttctttctctgcccaggtagaattcaatttacatattttgtggaaaaattcaagttaagaaagttgaacacctcactctttgtgggaaaagattgcttcctaaagattttacctatctttttcctcagtgatgtaagaacaccttaggcttcttgattatactattgcattgctaaagaaaactcagattgtttcttcgttcctttttctttcataataaacagcctcattgactttttttccaattatttttgtggtaaaatacatataagatttatgatctcatttcatttttaaatgtacagcccagtggtattaaataccttcagaatgtcatgcaaccattatcaccatccatctccagaagtcttttaaactgaaactgtacgcattaaacactaactcctcgcctccctctactcccagcccctggcaactaccattctactttttgtctccgtgactttgactgtactctgagtaactcatataagtgaaatcatgcagtgtatacctttttatggctggctgtttcacttagtgtaatgtcctcaagcttcatccatggtgtagcatattgcagaaatttccttcctgattaaagctgaataatactgcattgtatgtatataccatattttgcttatccattcatttattgatagacactgggttgcttctgcgtcttagaaccttgtggacttttggtttctgtttttacagtggggtggcagggcaaaatggcttttatctccagtagacctaaattcatagaaagtagagaccatttctcattcatctagaagcatgcagtagggcctttattgatgtttggtttgttcaggaaaattgtttaggaatattctatgaaaggcatatttcatagacctttcaagctaaatataataatgattggaaataagtttttctgctgttttctcagcttgaatgtctttaacagatgatcataccatctgtttagaatcagtgtgtcagggatgagtaagaaagcatcttgggtgagaaatgatgctgtaagtacttttaatacattgccaaaaatcgttgtccatgcccgttgcttcaacgaggccataccatgatgcatctcactgagttcccacgcttcctcattgtgagtcaaatcaagatactaaccttttccttttaaagttttctatcagcttatcctggatcctggtaacctatttatttaatggatgagttttgtagttacaattttaattgtttactttataccttaggaaggagataaaaatttactagctataaccaaattgctgtttgcttaagatttatgtcataaaaaatgatgaaaagtgtattagtgacactgataaagactaggagagaagacacattcatagtgcagtaattatgtgtgtgcacacatatgcaggcacagacatattcattttggggacagaatttcagatttgtatctggaggtaaattcaggcaaggcttttggagaaaaaaagaggctgagtaaagtttaagcaatggtttgatgtagtatttatatggaaacgtaagttaacaaacaacaagtttaattgtatctctggctggtagaatgggtcaggaatttcattttattaaatgtgtattcagtaaaattgatttttaatgtaacttaaaaagtaaactttctttttcaaggtagttttagattcatagaaaaattaggcagaaagggccgggcatgatggctcatgcctgtaatcccagcactttgggaggccgaggcaggcggatcatgaggttgggagatcaagaccatcctggctaacatggtgaaaccctgtctctactaaaaatacaaaaaaattagccgggcgtggtcgcgggcgcctgtagtcccagttacttgtgaggctgaggcaggagaatggtgtgaacccgggaggcagagcttgcagtgagctgagattgtgccactgcactccagcctgggcaacagagcgagactccatctcaaaaaaaaaaaaaaaaaaaattaggcagaaagtacagagttcccatataacccaccccatccccaatttcttctgttaaaacatcttgtactcgtgtggtacaattgttatattgattaattaatattaatacattattattaactgaagtacatagtttacattagggtttactctttatgttatacagttctatgagttttgacaaatgtattatgtatccatcattacagcatcaaacagaatagttgcattgccctaaaaatatcctatcctccacgtgttcatccttttctccctcctctggcaactgatctttttactgtctctataattttaccttttccatgatttcatatagtaggaatcacacagtatgtagctttttcagactggcttctttcatttagcaatatgcatgtacaatttctcttttgatgggttgatagctcattttgtttcatcactgaatagtactccattgtatatataccacagtttatctgttgacctattgaagtatatcttggttgcttccaagttttggcaattatgaataaagttgttgtagacatttgtgtgtaggtttttgtgtaaacgtaagttttcagtatccaggttaatatataagagtatgattgctagattgtatagtaagactattttagctttgtgagaaactgccagactctgccaaagtggctgtaccattttgcatccccaccttcaatgaatgacagttcgtgttgttccatatctttgccagcatttggtggtgtgagagttttggattttattctaatgggtatgtagtcgtatcacattgttgttttaacttgcaatgccctaatgacttacgatgttaaacatcttttcatatgcttgccatctatatatcttctttgatgagatacctgttcagttctttgttgcatttttaaattgagttgttcattttctttttttttttggagatagagtctcgctctttcactcaggctggagtgctgtagcacgatcctggttcactgaaacctctacctcccaggttcaagcgattttcctccctcagcctcccaagtagctgggattacaggtgtacaccaccatgcccggctagatgtttttttgtatttttggtaaagacagggttttgccatgttggccaggctggtctcgaactcctgacctcagctaatctgccagccttggcctcccaatgtgctggtattacaggcatgagccaccgtgcccagccagggttgtttgttttcttaatgttgaattttaagagctctttgaggccaggcccaagtggtagatcacacttgggtaacatagtgagaccccgtctgtattttttttttttatgagagttctttgtatattttggagaccagttctttatcagatatgtttttttgcatagtttttctcccagtctgtggcttgtctttactcttaacacagtatcttttgcagattttaaagatttccaagataccaatttcttttttcatggatcttgcttttggtgttatgtctaaaaagttatctccaaacccagagtcttctgtattttctcctgtgttatcttctagaagtataatttttaatttcatgtttagatctgtgatctggtttgagttaattttttatgaacggtataagacctgtatctagattgattagtccctctcgcactcactctgtttcttccttctttcctttctttttttgcatgtggcggtccagtggtttcatcatttggtgaaaagactgtcctttctgcattgagttgcttttgtttctttgtcaaatattctttgactgtatttgtttgggtatatttctaggctctctgttccatttgattgatctgtttgtctgttcttttacccataccaccctgtcttgattactatagcttatggtaattctagacattggctactgtcagtcttccaactttgttcttctccttcaatattctgttgtatattctgggtcttttgcctttatataaactttagaatcagttttgatattaacaaaataatttgatggataattggataatttgattccacttgttcattgctgttacacaggaagacatctaactttttatacttattaattctatattctgcaatcttgctataattgctttttctaggagggtgtttttttgttttgtttgtcaattcttttggattttctatatggaaacaataatattatctgcagccaaagacagttttatttcttctttcccaacacgtgtagcttttctttctttttcttgtcttatttcattagctaggacttcaggtataactatggtgaataggagcgaaaggggatatccttgtcatgttctcaaacttaggggataagcatctagtttcttactattaagtatgatgttagctgtaggttatttggtagatgttctttaccagttaaggaagttcccctcttttcctagttagctgaaagtttttatcatgaatcgtagttggattttgtcacatgctttttctgcatctatcaatatgtatgatcataccattttttcttccttagcctgttgatgtgatgaattacattaactgctctttgaatgttgaaccaaccttgcctacccgggataaattacatgttgccatgttgtgtaattattcttatacattgttggatttgatttgctaatattttgtagtgtctttggtttttgtgttagggtgatgctggcttcatagaatgaattagcaagtgttcatcaacttctaatttctggaagagattctgaagaactggaattgtttctttttttttatactttaagttctagggtacatgtgcacaatgtgcagttttgttacatatgtatacatgtgccatgttggtgtgctgcacccattaactcgtcatttacattaggtatatctcctaatgctatccctcctccatccccccaacccacgacaggccctggtgtgtggtgttccccaccctgtgcccaagtgttctcattgttcaattcctgcctgtgagtgagaatgaggtgtttggttttctgtccttgcgatagtttgctcagaatgatggtttccagcttcatccatgtcactgcaaaggacatgaactcatccttttttatggctgcatagtattccatggtgtatatgtgccacattttcttaatccagtctatcattgatggacatttgggttgattccaagtctttgctattgtgaatagtgccgcaataaacatatgtgtgcatgtgtctttatagcagcatgattataatcctttgggtatatacccagtaacaggatggctgggccaaatggtatttctagttctagatccttgaggaattgccacctgtcttccacaatggttgaactagtttacagtcccaccaacagtgtaaaagcgttcctatttctccacgtcctctccagcacctcttgtttcctgactttttaatgatctctattctaactggtgtgagatggtatctcattgtggttttgatttgcatttctctgatggccagtgatgatgagcatttttaatgtgtctgttggctgcataaatgtcttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcacccgccaccgcgcccggctaattttttgtatttttagtagagatggggtttcaccttgttagccaggatggtctcgatctcctgacctcacgatccacccgcctcggcctcccaaagtgctgggattacaggcgtgagccaccgcgcccggccaaatgtcttcttttgagaagtgtctgttcatactctttgcccactttttgatggggttgtttgattttttcttgtaaatttgtttaagatctttgtagattctggatattagccctttgtcagatgagtagattgcaaaaattttctcccattctgtaggttgcctgttcactctgatggtagtttcttttgctgcgtagaagctctttagtttaattagatcccatttgtcaattttggcttttgttgctgttgcttttggtgttttagacatgaagtccttgcccatgcctttgtcctgaatggtattgcctaggttttctcctaggggtttttatggttttaggtctgatgtttaagtctttaatccgtcttgaattaatttttgtataaggtgtaaggaagggatccagtttcagcttttgacatatggctagccagttttcccagcaccatttattaaataggatttcttgtttttgtcaggtttgtcaaagatcagatggttgtagatgtgtggtattatttctgagggctctgttctgttccattgatctatatctctgttttggtaccagtaccatgctgttttggttactgtagccttgtagtatagtttgaagtcaggtattgtgatgcctctagttttgttcttttggcttaggattgtcttggcaatgcgggctcttttttggttccatatgaactttaaagtagttttttccaattctgtgaagaaagtcattggtagcttgatggggatggcactgaatctataaattaccttgggcagtgtggccattttcacgatattgattcttcctatccatgagcatggaatgttcttccatttgtttgtgtcctcttttattttgttgagcagtggtttgtaattctccttaaagaggtccttcacatcccttgtaagttggattcctaggtattttattctctttgaagcagttgtgaatgggagttcactcatgatttggctctctgtttttctgttattggtgtataggaatgcttgtgatatttgcacattgattttgtatcctgagactttgctgcagttgcttatcagcttaaggagattttgggctgagatgatggggttttctaaatatacaatcatgtcatctgcaaacagggacaatttgacttcctcttttcctaattgaataccctttgtttctttctcctgcctaattgccctggccagaacttccaacactgtgttgaataggagtggtgaaagagggcatccctgtcttgtgccagttttcaaagggaatggttccagtttttgtccattcagtatgatattggctgtgggtttgtcataaatagctcttattattttgagatatgtcccatcaatacctaatttattgagagtttttagcatgaagggctgttgaattttgtcaaaggctttttctgcatctattgagataatcatgtggtttttgtctttggttctgtttatatgctggattacgtttattgatttgcatatgttgaaccagccttgcatcccagggatgaagcccacttgatcatggtggataagctctttgatgtgctgctggattcagtttgccagtgttttactgaggatttttacatcaatgttcatcagggatattgatctaaaattctcttttttcattgtgtctctgccaggctttggtatcaggatgatgctggcctcataaaatgagttagggaggattccctctttttcttttgattggagtagtttcataaggaatggtaccagctcctctttgtgcctctggtagaatttggctgtgaatctgtctggtcctggactttttttggttggtaggctcttaattattgcctcaatttcagagcctgttattgctctattcagcgattcagcttcttcctggtttagtcttgggatggtgtatgtgtccaggaatgtatctatttcttctagattttctagtttatttacatagaggtgtttatagtattatctgatggtagtttgtatctctgtgggatcggtggtgatatcccctttatcatttgttattgcgtctatttgattcttccttcttttcttctttattagtcttgctagcggtctgtcaattttgttgatcttttcaaaaaaccagctcctggattcattgatttttttgaaggtttttttgtgtctctatttccttcagttctgctctcatcttagttatttcttgccttctgctagcttttgaatgtgtttgctcttgcttctccagttcttttaattgtgatgttagggtgtcaattttagatctttcctgctttctcttgtgggcatttagtgctataaattcccctctaaacagtgctttaaatgtgtcccagagattctggtatgttgtgtctttgttctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgccgaggagggctttacttccaactatgtggtcaattttggagtaagtgcgatgtggtgctgagaagggtgtatattctgttgatttggggtggagagttctgtagatgtctattaggtctgcttggtgcagagagctgagttcaattcctggatatccttgttaactttctgtctcgttgatctgtctaatgttgacagtggggtgttaaagtctcccattattattgtgtgggactctaagtctctttgtaggtctctaaggacttgctttattaatctgggtgctcctgtattgggtgcatatatatttaggatagttagctcttctagttgaattgatctctttaccattatgtaatggccttctttgtctcttctgatctttgttggtttaaagtctgttttatcagagactaggattgcaacccctgcttttttgtgttttccatttgcttggtagatgttcctccatccctttattttgagcctatgtgtgtctctgcacgtgagatgggtttcctgaatacagcacacttatgggtcttgactccatcctatttgccagtctgtgtcttttaattggagcatttagcccatttacacttaaggttaatattgttacgtgtgaatttgatcctgtcattatgatgttagctgattattttgctcgttagttgatgcagtttcttcctagcatcgatgatctttacaatttggcatgtttttgcagtggctggtaccggttgttctttccatgtttagcgcttccttcaggagctcttgtagggcaggcctggtggtgacaaaatctctcagcatttgcttgtctgtaaaggattttatttctccttcacttatgaagcttagtttggctggatatgaaattccgggtcgaaaattcttttctttcagaatgttgaatattgcctccactcttttgtggcttgtagagtttctgccaagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggtgttctctgtatttcctgaatttgaatgctggcctgccttgctaggttagggaagttctcctggataatatcctgcagagtgttttccaacttggttccatcctccccatcactttcaggtacaccaatcagacatagatttggtcttttcacatagtcccatatttgttggaggctttgttcatttctttttactcttttttctctaaacttctcttctagcttcatttcattcatttgatcttctatcactgataccctttcttccagttgatcgaatcggctactgaagcttgtgcatgcatcacatagttcttatgtcatggtttacagctccatcaggtcatttaaggtcttctctacgctgtttattctagttagccattcatccaatatttttcaaagtttttagcttctttgagatgggttcgaacatcctcctttagcttggagaattttgttattaccgatcttctgaatccttcttctctctgctcgtcaaagtctttctccgtctagctttgtttagttgctggcaaggagctgcattcctttggaggagaagaggtgctctgatttttagaattttcagcttttctgctctggtttctccccatctttgtggttttatctacctttggtcttcgatgatggtgacgtacagatggggttttggtgtggatatcctttctgtttgttagttttccttctaacactcaggaccctcagctgcaggtctgttggagtttgctggaggtccactccaggccccgtttgcctgggtatcaccagtggaggctgcagaactgcaaatattgcagaacggcaaatgttgctgcctgatcattcctctggaagcttcgtgtcagaggggcacctggccgtatgaggtgtcagtcggcccctgctgggaggtgcctcccagttaggctacttgggggtcagggacccacttgaggaggcagtctgtccgttcccatatctcaaactctgtgctgggagaaccactactctcttcaaagctgacagacagggatgtttaagtctgcagaagttttctgctgccttttgttcagctatgccctgcccccagaggtggagtctacagaggcaggcaggcctccttgagctgcggtgggctccacccagttcgagcttctgggcagctttgtttacctgctcaagcctcagcattggtgggcgcccctcccccagcctcgctgccgccttgcagtttgatctcagactgctgtgctagcagtgagcaaggctccgtgggcgtgggaccctctgagccaggcgcgggatataatcttctggtatgctgtttgctaagacctttggaaaagcacagtattagggtgggagtgacctgattttccgggtgcgattttccaggtgccgtctgtcgtggcttcccttggctgggaaagggagttccccgaccccttgtgcttccctggtgaggcgatgccttgccctgctttggctcacggtccgtgggctgcacccactgtcctacaagccccagtgagatgaacccggcacctcaattggaaatgcagaaatcatccatcttctgcgtcgctcacgctggaagctgtagactggagctattcctattcggccatcttggaacctccctgcctcttttttctggtattgtttcttacttaaacatttagtagaattcactgtgaaaccaactagaccttttttttttctcccctgtttctgaaggttagtaattgttaatttaatttctctctctctctctgttttgtttgtttgtttgttttttgagacagggtcttgctctgttgcctagactgagtatagtggcaggatcatggctcgctctagccttgaactcctgatctcaagtgatcctttcacctcagccttctgagtagctaggactataggtgcatgccaccgcatccagccaattttgttattttttatttttatggatggggtttcactgtattgcctaggctagtctccaacttctgggctcaagcaatcctcccacctgggcttcctaaagtgctgagattacagccatgtgccaatgtccagcctaattgctttattatctctttttcctactgtgagttttggtagattgtctttcaaagaattggtttatattagctaaattaccaaacttctgggcatagagttgtttatagtgtttttttattcttctgatgtttgtgagatcaattgtgataacccctctttcttcatattagtaaattttgccttttctcttttttccttgaagagtctggctagaattttttttttttttttgagatggagtttcactctcgttgcccaggctggagtgtaatggcgtgacctcgactaactgcaacctccacctcccaggttcaagcaattctcctgcctcagcctctcaagtatctgggattacaggtgcctgccaccatgcccagctaattttgtatttttagtagagatgaggttttgccatgttgactaggctggtctcaaactcctgacttcaggtgatccacgtgcctcagtctcccaaagtgctgggattacagacctggccctggctagagttttatcaattttatttaccttttcaaagaaccagttgttggtttcattgatttttctgtattggatttattctatttggatttaactggcttcttgaatatgtagatttctttcttctgcctaatttggtaagtttttaaatttaaaatttttagacagagtcttgccctgtcgcccagactggagtgtagtggcatgatcttggctcacggcaacctccacctcccaggttcaagcgatttttccgcctcagcctcccgaatagctgggattacaggtgcccactaccgtgcccggctaatttttatatttttagtagagatggggtttcactatgttggccaggctggtctcaaactcctggccccaagtgatctgcccacctcagcctcccaaaatgctggaattacaggtgtgagccactgtgcctgcccctaatttggcaagtttttagccactatttcttttcttttcgttttttttttgtgtgtgtgacagggtcttgctctgatacttaggctgaagtacaatggcatcatcatagcttaccgcagcctcaaactcctaggcttgaataatcctcctgcctcagccactgagtcgttgggattacaggcatgagccatcttgcctggctccattattttttcaaatactttttcagtccttctctgtttctcttttctttctagtattctgatgacacaaaagttagctcttttggtatagttacacaggtccctgatgttttgttcattttttttcaaggctattttctctcttgctaaaattggtagtttcagtattctgttcacagacttttccctgcttcctctgtgctgccattgagcccattcactgagtttttgttattttttgttctaaaatttccatttggttctttatatcttctgtttctttgctgagactttctagttttttttttcctactttttcatttgtttcaagcatgttcttaattgctattgaagcatttttatgttggctactttcaggtatttatcagaaaattgtaacacgtctatcatgtcagtattggcatctgttgtttgtcctttttcattttgtttggcattttcctggttcttggtgtggtgagtggtttttgattgaaacttggacattttgggcattaagttttaagtctctggatcttatttaagccctctgttttagctggcttcctctgagacctctctggtaggggaaagaagaggtgccatttcattactgccagatgagtatagaagtccagattccctatgcagcttccattggctaagtggcaggggagaaagctccccttgccttaattaatactggccaggagtggctccccactaggcctccaatgataaattcttagctgggaggaggagagatgccttgttacttctccccacatatcttccactgatatcacagaaaggagggtggcctcattagcactgggtagagtgaaagtgactctcaactaggccttctctaataccactgcattgggggtgggagagggttatcttattacagacaggtgggtggtaaaagtccaggatccccatgtggtgtcagtagttaccacatgggactcgtttggttactgcctagcagggatgaaaacctcaggcctctgcttggccttctttgaaacgggcaggggggttagagcacctcggtttggtttggcaaacgtggaaatctactttttgtttctatggatttgcctattctggacatttcatataaatggagccgtatagtgtgtggccttttaaaactggattctttaacatagcataatgtttttaaggttgatccatgttgtagcatttgtcattacttaatttctttttattacaaaataatatttgattgtatggataggccacattttatttatcctttcatcagttggtggacatttgggttttttatgtcgttcggctattatgagtaatgctgctatgaacattagtattcaggtttttgtgtggacatgtgttcagttctcttggtatatacctagaagtggaatttctgggtcttatggtacctctgtatttaactttttgagaacttacttattattaagttttaaaaatcttattgtattgtattgtggtatcagggaaggtacctgagatattttgtgtagtgtctgttgggtccccagacttaagatttacttttactcttattctttgcttatttctatatgattttcattaaaaggatggtgctggtaattaagttactcaagagttccataagtttgatgagtattaaaatgttttaagccattatttatttttaaacattgtgagtatgtaattattcatagtcatgacatttatattcataaatatacctgtgattttatttatttagaaaaaaaaaagtgaatgcctgcagttaaaaattttggtgcttcagaatgaactggaacggcagaagaaagctttgggacgggaggtggcattactgcataagcaacaaattgcattacaagacaaaggtgagtggaaataccatacaaacagcctaacctccacattcagtagttctcctttcttcttcttcacaagctcaaatagtcattttttgtgtaaatacagtcacacatcacttaatgacagggatatattctggaaatgcatcctttggtgatttccttgctgagctgccatcatagagtatgtttacacaagctcagatggtataaactactactacacacctaggctatatggctgtaaacttgtacagcatgttaccatactgaatactgtaggcaactataacacaatggtgagtatttatgtatctaaatatatctaagcatagaataaaaatactatgctataatctgtgggaccgccatcttgtatgtggtttgttgttgattaaaacatcatcatgcagtacatgattgtatggtgatagaattttctcaaatttttaaaatatttttgcaagtattttgaagttagtccatagagacaagtgtacagatctgtattcaaatcgtcccggacttacaatggtttgatttaatgatgatttaacgtacgatttttcagttttacaatgtgcaaaagttatatacatgtggtagaaaccatactatgaattttgaattttgatctttttccaggctagcagtatgtggtatgatattttcttgctatgctaggcagtgacagtgagctgcagctctcagtcagccacatgatcatgagggtgaacaaccggtactctataatgtactctgttgctagtgttttttggatattgtgttttatgttttcacatcccatcaagtctacaaagtgctcatctgtgtacggtattcaatgctgtgttataaaataagttttgtgttagatgattttgcccaactgtaagctaataaaagtgttctgacaccttaaaagtaggctaggctaaggtttcatgatcagtaggttaggtgtattaaatacattttcaatttatgatactttcaacttacaatgggtttatcaggatgtatccccatggtaagttatggagaagttgtgtccacagagcttgaattttcacaaagcaaacatacccatgtgagcagaatctcaatcaagaaacaggaccccaaagcctcctcacgcttccttccatttaccacatctccagccagactagccactgccaagactcaaaccggattggttttgcctaattttgaactttatagaaatagaatcatatatgtacatgtggtggctcttttcaacattatgtttgtagagtcattcttaccttcatgtggttgcagtttgttcgtgtttaatgccaaatagtattccattatataagtgtgaatttatttatctactcttgctgttggtttcagtaattttcattttgggaacattagagttaatgtttccatgaaccttctaggtttctgagtgaagaactttcatacgtttcttaataaagatttttaggtatttcagttgagtagaaactgaggagtagaattacagtcaagagaatgtacgtatcttcagctctagtagattgtgcccaatggttttccaatatgattgtgccagtttatctcccctctgtccagtgttgctccttcctacatccttgtcaggaatttcttttctttttttttttttttgtatattttgtatttatcgcatttggtaatttgtatttttcgttttagcctttctgttggatatgttgtaatatcctcttgcagttttaatttttattttcctgaagactaatgaagttagtctttcatatgttataaattttataaacatttcatatgcttcttgctgactgagatacactcttttgtgatatacctgtttgaatcttttgcccattaataaaaaaagtttggtttgactgtctttttgtttgtaagatttctttatatattatggatatgggttctttttttggcatatgcttaaaaatatattctcccattctgtggcttgctcgttcactctttaatgatacctttaaatgaacagaagttccattttatcagtctttcatagatgaggctttttgtgactacttggagaaatatttatctattttaagattttatagttgtttttctatgtgttctttaaaatactttactattttacttcttacatttatatctataattcatctggaattactttttgtatgtgatgtaaggtaggagtcgagattattttttttcgtattgatagtcagttgacccagcaccattcactgaagatcatcctttcaccattgcgttgcagttttgcttttctcataaatcagatgaccatttgcttgtaagtctgttaagaaccctctgttctgttctattgatctatttttctggtcctttgccattatcttgctgttttaatttttttcatgttataataggtgttgatatccattaaagttcttcagcttaattgtttttcttcaagattacctcagttatttttgccctatgtcattttcatgtgaatttctacatagaaaagaaaaccttgctaggatattttttcttaattgtcatacctcattgctgggatttgctaggattttgatggaactgcattgaatatatttatcaaatgtaattggggataatagacatctttacaatattgaggcttccttcccaagaaaatgatatatgcctttgtttattagatcttctttacaaaacgttatcgaaataagatagtgtatgggtctttcccatgattcattgaatttatttctattttttgttgttttatgatactattgtacatatctttaaatcttatttttactagtttctggtatatagatgtacaattaattagttttttttaagtggtattagtatttattatgtttaaagaaaaattcaccggaagccttatagacagattagtaattgttaatgttacagttacagccctgcagctgcagtcttgctgtggttatttatttacattctaatttagttgcattataattaaatttcattacactaaaattagtaatgattttaattatttgttacaaatataaaaaattgcagaaaattaaaaaatcggattattgagatataattcccataccatataattttgccattgaaagtgtataattcagtttttcttagtttattcacagagttgtgcagtgatcaccacaatctgattgtcctacctaaaagaaaactcatgtgcattagcagttattccacacttcccctcccccagttctaagtaaccacccccctaccttctgtctctagatttgccttttctggacattcttttataaacagaatcatgcaatattgtggtcttttatgaccaacttcatttgtttagcgtaatatttgtaaggttcatccacactgtatcatgcatcactaattcatttttactcctgaataatacattcagttatatggatatgtcacattttaaaaatccactcatcagttgttggacatttgggttgtttccgctttctgtctatcacagataaagctgcttatgagcattcatatacaactttttgtagggatgtttgatttcattcctgttacgtacacctggaagtggaattgctgggtcatatgagaactctatttttaactttttgaatgactgccaaccattttccacaacagctgttttacattcctaccaacaatatatgagggttccaatctccccattttctcaccaatatctgttattatctctccttttaattatagccatcctactgaatatagcattgtttctcattgtagttttgattcaaatttacctaatgacttacatgcttcttacaccagattttcgtatgttaattttatatccaaggaacttattaactagttctaataattgttagattgttttgaattttctgtttttacagtcatctcacctgcaaatgatggcatttttatttctcatttcctaatacgtatgcctttaaaacttttttcttacctgattgtgttgtctgagacatccagtacaatattaaatagaagtagtatcagtggatatccttttctcatttccagtctcagtgaaagcctttaatatttcatagagggtttaataaaacatagaaggtttactataagcatttttgtagttcttattttgtggtttaccgttttgcatcctttacccattttgtcatttttgcattaactgttttttttttttgagatggagtttcgctcttgtctcccagactggagtaaaatggcgtggtctcggctcactgcacccctctgcctgctaggttcaagcgattatcctgcctcagcctcccaagtagctgggattacaggcacctgccaccatgcctggctaatttttgtaattttagtggagatggggttttgccatgttggccaggctggtctcaaactcctgacctcaggtgatctgcccgccttggcctcccaaagtgctgcgattacaggcatgagccaccagcccggccgcattaactgttcttttaatgaattgataagagctcaatatgtgaattttcatttctttgttttttttattttcttaaaaatcagttttaatgaggtatattttacaatcaaattaatcaatttaaaatacacagtttgatgagtttagctaatgtattcaggcaggtagctaccaccacaatcagtgataacatttctatcattgtaaacagctttttggccttgttgtagtcagttctttcctccatcgtttgaccactagcaattactgatgtgctttctgataccattttccttttctagcatttcatatgaatggaatcatacaatatgcactttttatatctggctctttttcacttagcatagtagctttgggatttatgtggttgtatgtgtcaggaattcatcttttcattgctgagtagtattcactgtatgtacatacaacttgtttatacatttacctgttaatggccattgggtttgtttccagttttgaattattgtggataaagctgcatagatattcaagtataagcccttgtgtgggtatattctcttggttaaatattaataactaggtgtgggattgctggggtatagtaaatgtgtgtttaactttttaaaaactactaagctgttatgcattttcaactagcaatgtatgagagtttcacttagtccacatctaaacattaattttagattttagccatgttagtgggtatgtagtggtttctcattgttttaatttgtatttccctgataactattgtggctgagcatcttttcttgtgcttatctgttacctgtttctttcctctgatgaaatgtctgtttagatctttcatctgttttttggaaagtggggaagggggatggatggtaacgttattattaagttgtaagagttctttttatattctggatatgttctttatcaaatatacgctttatatgttttttcttccctatcttaacagtgtattttgagtttattcatcattttttttaaactttattcttttccttttttttgagatggggtctcactcttttgcccaggttggagtgcactggtgtcatctcagcccactgcagctttctgggttcaagagactctcctgcctcagcctcctcagtagctaggattacaggcgtgtaccaccacgcctgggtaatttttgaatttttagcagagacgtggtttcaccatgttgtccagcccggtcttgaactcctgaccccaagtgatccgcctacctcccaaagtgctaggattacaggtgtgagctaccatgcccggccacttctggaactttctttgtgtttgttcaccctctgcattgtggcctggaaacactccccatgtagtgatttggagccgttatagggctcacgtttcttgttttccttctctcaggaatcattatactaggctgcctcttatctattgtctgaaaactgttgttacatataattttgtatgactttctagttgtttacagtgggaggaaaatctgatgtatgttattccatcagtcagaaatagaagtcttttttacctctatacttgcttttatgagaacacactttactcatctctccttggtttagttcttttggttcttcaaagacatgctcaaatactacctctccttgaggcttttttctccctcaaatgaaagtttcctgctccttcttctgtgtccccatagtgttttgatgtcgtcttatcttcgcacttatttggtaagccctttcagggcagggactttgcacttttatggtatccttctcagtgcccaacactgaggccctcagtgagtattacacagcatgaatctttgaggggctttcatataggtaatgtaccattaaatgtagtacatgaattatttaaccttattttatttgttgcatccttttgtggtttcctgtttagtttttggtgtatttcacatagttgacattggtggataaatgagatataataggaaacagaaaacctactgtggcaagagtgtatttggaatgtgaataaagtaagtcatttttagcaggttttaaagttttgacctatatgaagtatagtttacattacaaagaataattttataaatgtgatttttcttcatttcagtaattttagaaaataagtttctaaaggaacaggctttgattcagaatgccttgtttcacaagcctacttcattgtttaccagctgtgtaaccttgtccaataacttagtgttatctctacaatggggttaatagtaatacttaaaactgtgtctcactgagttttaacaggcttccaagttctgctgatgtttctggtctgtgaaccacattttgtgtagcaagaatatgtataatatgatgatcagatgagttatgaagatgaaatggtctcataaaaataggagcaaaacaccatctgttttattcctatgtcatactctcgtgggtttctgtacctttaagataaaagtctcagcccaagatgacttacaaaggcctccaatggctcacctcaatctgaatgcttcaaccacacagaactcttttagttacttaagtatgctttgttctatcttacctgcatacaggcctttgcctaaatgttgttttcaccaggaaaccatcactggctcccttctctttctcctcccacccctaggttaaatgtactactgtgtgtttccatagcaccctatatttttccatgatagcactttgattattagtctatctccttctctagacagattctgagggcaggcactgttcaaggactacattaaatactcatatcttttaggcatggtatagtacctgggatatagtacacatagaataaatatttgttgaatgaaagcatcgtacttatgcttattggtgtcatgtcatgggtatcattgctaaagaaagacttctctaacttctagtttatcattcatatgggaagactgatactcttatgagaaagactgcagaaaaagtgtatgttgtttggcagtgataagtatctgcattccaatacaacttgcatatttataaatgagagtcaaaaggaataatgccatttaaaatcatgaagcattatgataaagtccatttgtctttgttagaatggccccaaataaatagacagttgttttgtacatacaaggcctgcttcaaaagatttcatcttctgtgaaaagacacatttcttacagtgctttggaagtaccatcaacttttactgtacttacattgcctgctatctgtggcatatatttctgcatatcttaccttttttaagatcattaactttcaaaatgaaaacactataaggttgtaaagggtttagggacttttgaccttttctagtaagagtaataatagtagcaataatgtatccagtacagtgcttattactataaatatgtaatattgtttaatcactacaataactttatgaggtagatgctattattatttaccttttatagctgaggaaactatgtcagggtcagagagattaagtaacttacttaaattcatgtagctaatgagaggtgatgttgagattaaaatctactgattccaaaactgtcaatcactgaataatactacatttttataactagcatgatatataaaaccaaggggtatatattattctagaatatggtaaaaagatagggagatatagttctttaactgtttctggttgtatatttgcctattaggatagaaagaggtcccaggatgtctatccttagattataagcaaatgaacatctaaacagtgatatctataccatttacaagactgaggtttaataataattgctcatatttagagaatatgagcttgtatttatattttatagaacacaagccggtattaattgctcttatatatagaatattagtgccaggaaatgtcatgttttctattctttatctaattttgtcctaatagtcctatacattaaagatactattattatccttctaataataaagatactacatattagtacccagtttgcagatgaggatgatttgtccaaaatcacataacaagttatgtgcccaaagccacatgcatagcaagttatggcagagcctgtgttcagagttactgctgcctaactgtgctgcgaagggagattatagaattttatagatatctcttctagtattttaattctgacagccaagtcagttgcacattcttgaatctctattttatcatggagagaaagaatggtaatcttcaagttaaatatgtatttgtcatggagggtcacaattgttgatttttaacactgagtttgtacttgaagtgccattttctcacttttatatatgtttttgagatgagaattactttgtattcccctggactattagaatccttagaaggttaggatctaatgttgatactttggttcctaacataagtaggagaaagagtgctgctgttggcttcactcttattcccattgcgaatgtttgtgggctgtggtgatcggcactggggagtgggaaagagggggatggctggatacagataaccacatttatttactagcataacctggtctactttttgggcacctgtgttcttcatagtggctgtgctaggtaaccagatacgtacttgttcttcaatattctattctaaacatatactattatatgcttgtgttgaacattattcttgtacatttacatgaaggtactatttaatgaatcttgagccaagttaaaatattttgaaagcaccatagtcactggtatttgctcaacgaaggtgaaaaaggtatttttctcttgcatttgcagctttgatttagtttgtttgctagggagtagtgaaatgatttgctgatatgaatattactagtgcgttcttacatattgtgactggcacttggtgcttatctaggtacttggttctgagtccaggagctcagttaggatataaagtcagtactatatcatatttaattgtgactttgctgctgattattctgaatgaccacaaaggaattatttactgtctgcatctttttacacatctgttcagtaaggatagctgctaataatactgacataggaattaatttgtgtaaacatttggaagaaaccaggtgcttatatttttgttcatgaaaatccattgcagcaggatgatttattggaaagtgccaaaaagacaatttttatccacgctgctgacttgctgagtggtcacataactccaaagggcctcattacttcacactcatacgttttcccttcctatccctcaaaggcagtggttctcaacttgtggtctatggcaacttccagctgggtcatgagctgatcttttcagtattaatgtttattagtgtatatattttcatttctggaaggtattagtagtttaacttaggatgtttaataaaaaccagatttcccctcagtaactcaagccaagtaatcttcccattaatgaattctgtgttgctttaccgggtcttttgtcctgacacaacccccaaatctttgaaaagcaacactctatcaaaattagtttgctggaaacttagctcaaaaaatggtatgaaatgttggttttatggaagtgtgttcagtagaatgtaggtttcttattgtattagtccatttttgcatcactataatgaaatacctgatgctgggtaatttatatagaaaagaagtttaattggcttacggttctgcaggctgtacaggaagcatgatgccaacatctgctccaggtgagagcctcaggaagctttcggtcatggtggaaggtgaagccagtacaggcgtatcacatggtgaaagtggaagtgaggggggtggggagaattgccatactcttttagacagccaggtctcctgtgaactaccaaagcaagaactcactatcaccaaggggatggcattaagccatttgtgagggatccatccccatgttccagtacttcccattattcctcccctccaacattgaggatcacatttcacacaagatttggaggagcacacgtccataccatatcacttataaacaaatgttgataaaaacccaagaatacttcagtggtgcctgggaagtggtattaactttataaaaggagagttctccaaactttgtgggaagaagctactttttaatacaattactttcttgataataaggataaccatacagttaaaaagtgcttatacagaagttcttatgtttgatccttaaagcatctctgaaagctaagtagggcagatgttaccctcattgtatatgtgaggtactgggaagttaaatgacttggccaggaacacacagacaattagcagcaaagttgagatgtggacccaaattcagcacagatttcaactctaaattctgtgcttttctcagtattccatactacctaaaactttgcaaaacattcgtttgaatcccacataaatcacatgaagtagataacttttattgaaatcctgtaacatgccagatattttagttttggtatattattaattcttaaaatagtcttaagatatcttttttaccttcttttcccaaatgaggaaaattagggctcagagacacttccctgaggtcccaattaagtgacagatccaaattcaaacattggtttctcttactccaaagcctgtcttgtttccactaaacgaaacgtcattactgctttctctagtatgtgtccgggtcaactcacagtttgctgtttttctatttggcctgtgaggtgttagctagagaactttgttttgctttgttcctttttattatagtatggctgaagtgaattttctccaaagattgctttgatttgggtctgccattttccaactttgtccttagacaggtctttcaactttttgagcttatttcctctgcataaacaaaacaaaacaaaaaattctgaattatacagtcaagatttctttcagctctattaagattttggttatctcagaaaggtaggactggtggaaatgatggtgatctgttcaccttttttaatgcctctctttattattgttattattataagtttaatgctgatgatatattttccagcattttataaaagttttttttttttttaatctttgacccaagtgtgtctatgattgttgcctgtttaatactgaaaagccatttggtgggaatgacctattagaattctgtaactagccatacttttctcctattttactttggcaattaagagcaaaaacaaacacattattttggtggcagtgaataggagaggtcagatatgtcagatttcattgctcagatttggggaaataaattacccttggtaatttcagtgaataaaaagttgttgccaaaataaatattttatgtgaagttcccatcaactgtaatagtttcttattgtcattttgaaaaaaaaaaaaaaagagtaattaaggtgacctacatatgtagtttgttctatttaattagcttctgcttggttagtaaattactgtgtccttttggtctgcatctcagataaaagaagaatcacacagtatatttaaattgatactttaatttctatcaaaagctcataggtttctatttgaagttgtaaatacattattaagtcttgcataacaattttttccttttcttaggtcatacagttacttatgaaaagttacttctcagtttttaaactcaaaatatatttatttgaaatgatggcaaaatttaaattttattagtttatatgtgttctgattttttaaataaccatctgacagaaattcttaaataggcatcttcaaaattattaatatctaactttcaaaaaaaagtctggacctgaggacagattctccctaggatttatgctattagcaataaaagccagacaacttgtggcaggggtattttgggggaagaggtaggtaaatatgagtcctgagcaaacttctgattttatttcagtttccatgtaagtatagtaatttattccagtaatgtcttatttgtttgtaggaatggcaaactgtcatattttaatctctgtttcccatgggaggtatagatgtgtagaaatatgccacctgacacaattgtatattggtttgtcataattttttctccacttactctcaaaatgcactggaagtaacatttacaaaaaaaaaaaatacatttacatttaggtggttgaagatagaagtaaaaagagagcatatgacttgtaaaggaagtagaaggagcattgatttttatttttctgcatatatgcctttgtcaattcatttattcataatttgtggaacactttcaaagaaccagacattgcgattagagtcaacatggcaggtgtgataaatatgtaaccgaagtatatagaggatactgtaggaacacagaatataaacatgataatcagaacaacaggtacaggaggtgacacactgagcctagaagaatatatagtattgttctaactagggggagaaggtgagaccttccaggtaaagggagcagtttatacagaggcatggaggtagcttagggaattgtgagcaattccagtaaagcttactgggggcaggcacaataatgcaaatgttaagaatgaaattctccccattttacagatgaggaacatgaagttcagagaagttgaaacttgtctagagtcttgaaagtagcataggtaggatttcaacctagatctttctgattcataagtccatgggctttctaaatacagttcactgccttccatagaatctgcttattgttcttaagaactaatattagctctgacctcagctgtcaagccaattgtgtagaggtatgacagatatcgtttgttttacattgcctgttaataaggaagcctatcagttctttaaggggagaaataaaaatactctcttagcactaaatgcagagaataatttagtttcatatgtgcaatatattaaatatcataatgaaataaagtcagttgtaattttgcaaaagttacagcaagaaatatctgttaacccttgagaaaggcagcatcataaatcatagtatagaaaaggcatttctgcagggaaggaagctaaagtactccaagtatattgctttttggtcatctgacttaatgtggaaaacccagaagaatgacaatttattggttttaactgtaattttgacaggagctggccattggccagtctcagaccaaactctggtgagagagaaccaagagtctgtgttttgttttgttgctggaagcaagattcatagtctttagctattatatttataggagccaacattgacattttgctgttaaaattatattgcctgacttgtgttcttgctgaacagagaggctatctgatttaacagagtagaacattgatatatgcctggacagggtcaaagcagttttggaagatggtaaaccaagctccggcatttttgttccctctctcccaatgacctattgatgtgataataaatatacatgtataaagaatgaaaccatggtaatggtagaaacaaaagaggatgtcattgggatagcaaaggttttggcacagttctccaagatacaaagtagataggactgttttgatgaataaactaaagtagagaaaaactgcagcctagaacacaaatagaaacggctgcaggtagggttcctgatagaaccatcagaggcttcaagcttggaatttgccagtattgagatcaagaattaagtagagcaataatcagggtaattgagcctgttggcccattctccttcttgtgtgcatttggagcagctttctataacatttgctgtagctgctttctaaacataatggattcctgacctgcttaggtcccacggtataagtgtttgacatggtagaaagttgcagtagaacttaaagtgactggacttttatcgccaacccagaggaaaacatgaaagacaactctactcaagagtgaaatacctaccccaaataaaatcccagtgtgaagctcccttgacagttgcagtaatttgaagtaaaagtataccttctcccagcatatatacccagaaggaaagcctagttgtcaacaggaccagctcacttatactaatggcactaaggggtgaggctttttatggaaataaatctcatagctccagaggaaacctatgccagttgtctatactaatcagtctaatcacttattcatgggtttgaaaggagcactaaggatcatcagatatttgaggaaaacagcatgaatgagacctagttgaataaacagaatagctgacccaaaataaacagacaatacaaagaatggagaacttttaaaaaatcaaattaatatcctcagattttccttccagcctctgcctaagatgtaggtgaaaggagtttcacttctaccctgagaataaagaaaaaaaaacactggataatatacaaagtcataacttttcttaaatccatcagaaaactaggatctcaaggcaacgaagtagcttgagtgtaaggaaagacagacaacctccaaggagaggtaggatgtgagcactgattactaatggtagagcatgggaagaagttgggggctgctgtgtaataaggtgaaataattgagctaaagcttttaacaaatcgttaatgaccaagtgtagactagtttgtgactacggcagatataaggcagtttttactagcttgcagtttcttctgcatagacctcttttggatattcacaagaaagattgaggacaggttaggaaatctttgttcttctgcaggtaatgtgtcttttttctatggctgccttggacattttctcttcatttcttgtcttcagcagtttgaatatgatggtctggggtgtggtggagcaagaaggagggaggaagggaatatgtgtgttttcaggtggatcacctgaggtcaggagttcaagaccagcctggccaacatggtgaaaccccatttctactaaaaatacaaaaattagccagacatggtggcgggtgcctgtaatcccagctactggggaggctgaggcaggagaattgcttgaacccaggaggcagaggttgcagtgagctgagatagcaccactacactccagcctgggtgaccgggcaagactctgcctcagagaaaaaaaaaaaaaaagtcaactttctaaggcaaaaataatggtgtttgtgggcttatagcatacataaagtaaaatgtatgaagaatttaaaaactgggaaaaggaagaattgaaagtatacttttttcagttgtttttttgtttgtttatttgtttgttttttgagacagagtctcactctgtcacccaggctggagtgcagtggtgcaatctcggcttactgcaacctccacctcctgggttcaagtgattcctgcctcagcctcccgagtagctgggattacaggcgcacaccaccacacccggctaatttttgtatttttagtagagacggggtttcactatgttggtcaggctggtctcgaactcctgaccttgtgatctgcccgccttggcctcccaaagtgctgggattacaggtgtgagccaccgtgcccagccatatttttagtttttttatgctctacatgaagtggtataatattacaagctgaatatttctaatcagaaaatctgaaagccaaaatattccaaaatttaaaacgttttgggtgccaacatgatgctcaaaggaaatgctctttggagcatttcagatttcagattttagggtttaggttgttgaaccagtatgtataatgcaaatattccaaaatctgaaaaaaaattaaatctaaaacacttcccatcccaagcatttcggataaggtatgctcaacttgtttttgaaggtagactatgcttaattaaagatacattttgtgaactcctgggcaaccaataaacatttttaaagagcttaaaaaataagccaatagtgaagaaaaatgaaatactgaaaaatactcaatccaatagcatttaaaaagagagagaaaggaacaaagaagaaatggaacatactgaaaacagctagcaaaatggtagattttaatcataacaatgtttatattaggtgtaagtagtctgaatattctagttacaaaagggattgtccagatttgatttacaacaaaacaaaaaacaagacccaaataaatactatctacaagaaatccactttgaatataaaggtagatatattcccaggtgtggtggctcacatgtgtagtcctagcactttgggaggccaaagcaggaggattgcttgaagccaggagttcgagaccagcctgggcaacatggtgagactccatcaacacacacaaaaaaacttaaaaattcaccaggcatgatggagtgcacctgtagtcctagctacttgggaggctgagacaggaggattgcttgagttgaggagttggaggctgcagtaagctgagattacaccattgcacactgcagcatagcctgggcaacagagtgagaccctgtttcttaaaaaaaaaaggaaaaaaagaaaaaagttagatagattaaaagttaaagaatggaaaaagatgtaccatgcaaataacagtcaaaagaaaactgtagtgtctatattaatatctggcaaagtagacttcaaaacaaggattactacctggaataaagagggatattacattttggtgaagaggtcagttcaccaaaagacgtaacaattctaaatatgtgtgaacatagcaatattattttaatacagataaagcaaaaatagatagaactgaaaggagaaataagcaaatgcacaattatagttagaaaccacaacactcatcctcagtgataaagacaagtagagagaaaatcagttaaaagacattactatcaattttcttcacctaattgatagcataccactccactgaacactagcagaatctgcatttctttcaagtatacatggaacattcagttagaccacatttggtaccataagacaaacaaatacaaaataattaaaatcatacaaagtatgttttctcaccaaaacagagtaaactggaagttactaacagaaaaatgtctggaaaattccaaatattccacaattacacaatatatatatcataaaccacgggtcaaagaagaaatcacaagaaaattggaaagtattttgaaatgaatgaaaatgaaaatacatttgaagtttgaggtaaatttatagcatttcatgccaatattagaaaagaaggtctccagtcaataatctaagcttgtaccttaacaaattagaaaagaggagcaaattaactaaacccaagtcaaatcgaaggaaggaaataataaaggccactaatcagtgaaactggaaactgaaagagtagaggatatcaatgaaaccaaaaggtagttccttgaaaagatcactaaaattgataaacctgtagccatattaactaagtaaaaagagagaaaataagaattaccaatatcaggaatgagaggggacatcactacagatcctacagaaattaagattataatgtagtattttaaaaaacatgatggcagcatctcacaaggactttagaggcaggttgaagagagtcccactggttgaatctgggatcacttaagcaccaaataattatgtacagtaatgagttataaatcattgaaaaataaaaaggagttaatgattctttactgataatggatagttaatagagaagatgggggggcttctgcttagagaagaatgctgagtgctgactgatgattatggaggaattactgaagttggaatattatttttcagcatgtttagtaaagattgatttaaacagaaaccattaatcaagctcattctagggagaaatttatatgagaagcaggacgtatgcatgctcttaaacatggacatcattgcttccagatgtgatacccttagaaggacacaacatcagtcatgtagtattcaggttggtaatataaaacctgaacaacccctgtagagcttgagtataccattgcatcagtattattacttattttgaagtgacttttagaatttaggttgagttttctggagtatcttcaaatacttagttcttctctatctgagcctaaataacccaaactgcttcagttttattccagagcccactcctatggaaccaataagctgtattacctttcatagagaaatgaatgtggtatgttacattttgttagctgattgggatattttttttaatttcctttctaccacattgcaaggagttttcttgaggggaggtcatgtaataacacattctagagtcttctgaactgaggaaggggacactcatttgtgttttgaagaccagatctgtctttggtccctatttgtggtcttgttaacattgagttgaggcagcctaaattatctgggatgaagaatgatactgcacgtttctctagtggtagaagaattcatatactttctgatgaagtatgtggggatagagggtgtcaacctaaatgtcttaaaaaatcactaaggtgaagatttgggaaggagttatattgtgggctaaaaagttaagttgtgttccttggttaaattctgttggggtcagagttcccaacttactggtcttcatagtatgttgaaagagaagagaagggtgcttaaatatgttgggaaggccgggcactgtagctcacacctgtagtcctagctctttgggaggccacggcaggcggatggcttgagctcaggagttcaagatcagcctggacaacatggtgaaaccctatctttacaaaaaaatacaaaaattagttgggcattgtgacatgtgtctgttgtcccagatacttaggaggctgaggcaggaggatcacctcagcttggggaagttgaggctacatttagctgtcatcatgccactgtattccagcttgggtgacagaaaccctgtctaaaaaaaaagaaaaaaagaattgaggtatgagggtatcatttaaaatgtgaaatattcctgtaattcacattcatggagttaaattttgtacagccataactcagactatctgtcgtcatgtaaaaatagttgaaaaatcagaatacacatttcctatacactatgattttcacgaaaatactgatttttttttttttttttttttttttttttttggagacagagtctcgttctcttgcccaggctggagtgcagtgtcatgatcttggctcactgcaacctccacctcccaggttcaagcgatttccagctaatttttgtatttttagtagagacggggtttcaccatgttagccaggctggtctcgaactcctgacctcaagtgatctgccagccttggcctcccaaagtgctgggattacaggcatgagccaccgcacctggcctaaaataatgatatttatgaggaagatgacggttcataaaaactcctttatttatgaactatattttagtagtcaaaatacaggtacttttttactcttttttaaaatatactttcagtaatgttattccgtagcatttttggttggaaaggaattaatcactcatttttttaaagtgaagtctgaattttgatatcttatcaattgctgaccatctttctcagtcattaattgagaaatatctataggcagagagtcttaggcgtatactcttaggcttctgccagaggctggacttatgtgaaaactggaccaatagggaagtttattctagctactctccccaaaaaatctctgtactcaacccactttccctaactctttttatttccctctcacagtcagggatttggcttggcctctttggttgtgattgagtaatcctatgttacatatggaattatctccttccttttctttctaggaagtgcattttcagctgagcacctcaaacttcaactccagaaggaatccctaaatgagctgaggaaggagtgcactgcaaaaaggtaaatgcacactgagaagaattgctgtgagtgtggagtttactgcgaggatagatttgaaaaagtagcattctttaaagctgctggtattaatttatagcccatatacctcagtaccacattcgtttattcaacacatattcattaattaagcacctactgtgtgtcatgcactgtgccagaggtcagttatgaaagctcctagtatgtagttataatcagaaacatgaaccctattcaagtttctcaggccacagcatcgtggtttaatgtttgaatttcttccttctgtcttctacatgcggtttagcttataggttttttttcaataattttttcagatttacttctgcttcttgttagctcatttggattacttcagcaactagattatctctctaacatcagtctcttcatctttccagattgttctccatgctacgatcagacctctcctcttaaaataccatttttaccttattttttatcttctttttttaatgtggagaaacatttcattcattcattcattcattcattcattcattcattcatagacagggtctcactctgtcacccaggctggagtgcagtggtgcagtcgtagctcactatggcctcgaacttctggcctcaagtgatgctccacctcaacctcccaaagtgctgggattacaggtgtgagccatcatgcctggcatttttatcttcttaatatggtgattcttttgcttaactttcaaatagcctgtaataaattggcaccttgcaactgtagttaattttagtcgctctcccaacattcgtttaacaaatgccaatagtttttctcttcattttttccaacatatgcttaattcgttggtacctctgttcttttggtcatcttcacttgcttttcctggaaaatccatccatcatgcacttttcttcaaaaaactttagcagttggggattcaaaaatgctagactggccgggcatggtggctcacacctgtaatcccagcactttgggaggccgaggcaggcagagcatgcagtcaggagatcaagaccatcctggctaacacggtgaaaccctgtctctactaaaaatacaaaaaattagccaggtgtggtggcggatgcctatagtcccagctactcgggaggctgaggcaggagaatggcgtgagcccgggcggtggagcttgcagtgagccgagatggcgccactgcactccagtctgggcgacagagcgagacgccatcttaaaaaaaaaaaagtgctagacctatagaaaaccatagagattatctattccaattctctcaatttgcagataggaagtcaatgctctggtaagttactgtttgtccaactcactagcaaagccaggactagatcccgttgtcttcagtgctgttttagataactaaaaaaccagtgattttcgtactgttacacaccactcaatacaacacttttaacattagattctccagcagaccctcactgtatgtcttagaatttctcactctgtcttcctgcaaatagtatcagatcccacagaattaaggactcattcccacaagactgcctcaccacatcaggtgccatttggcaagccccaggttgtgacctgtgcttctgatcgacctgctttaaatagaggttcccataacccactccttggattcgattaatttgctagagcagctcacagaactcagagaaacatttacttaacccttactggtttattataaaggacattacaaaagataccgatgagcaagatggaaggcatgcatagggcaaggtatgggggagggagcatggagcttccatgccccgtctgtgcacatcaatctccagacactgccagtctggaagctcattagatcttgttgtgcaagatctccagccctcttctcagagtttggtgggtggggaagaaagtccaaccttctaatctcttggtttttctagtgaccagttccatcctgaggctgtctaggagcccctgccttaagtcatctcatagcataaactgtggtgtaatcaaaaggggctcataatgaatagcaaaagacactcttatcgctcaggaaattccaaggtttttaggtgctctgtaataagaaccgggggcaaagaccatatatatgtcatgttatactttgatctacagtttctcctaaattccttttgttcttaaattcttgacacagttgatcaggcaacttactttacaggtattttatgtattgatcatgtttcttaagtagtgcaagaaaagagctggtgccaggcaaggtgtctcatgcctgtgatcccagcactttgggaggctgaaacaggcagatagcttgagcctatgagtttgagaccagcctgggcaacatggtgaaacactgtctctacaaaaaatacaaaaattagctcagcatggttgggcatacctgtagtcccagcttctcaggaagctgaggtgagaggatcagctgagcccgggaaggtcgaggctgcaatgagccaagattgtgccactgtactccagcctgagtgttaaagtgagaccccgtctcaaaaaaaaaaaaaaaaaaaaaaaaaagagagagagaagggtaatttcatactatagctttttatttgttgtttttactttttttcttacagtccaacatattggtttttgaggtaattataatatgtaattgtgagtgaaatatagaatactttttgaggaaataccatccagatctttcttgaaatcaaattggcctcattaaattgactgtgaaatcttggtcacattactcagactctctaaatattgtttccttgtttataaatagatataacagtatcaacctgctagagttgttagaataaataaggccatttgtagatgcctagtgaatgattatttgtaccctttacatttcttttttttcaaagacaaggtcttgctctggtgcctaggctggagtgcagtggcatgatcagggctcactgcagcttcaacctcccaggccccagcagtccttctacatcagcctcccaagtagctgggaccgcaggcatacgtcaccaagccaggctaatttttttatttttgtagagacggggtctccctatattgcccaggctggtcttgaactcctgggcctcccaaagtgctgggattatgggagtgagccaccactcccagccccctttacatttcttagcatggtactaatcacacacagtagcactcagtatatagttagcttgattgatactatttggagataggtcaagacttacggtaactattatttatgcttctacttctgagtttctgtggcctattacagacagtataatctttctttggattaattgtgtggaaataaatgttacaaagcatgcaagcatatattttttaataaatgtattttttctttcctcattagagaactcttcttgaagactaatgctcagttgacaattcgttgcaggcagttactctctgagctttcctacatttaccctattgatttggtaagtttcaaattttctgaaaatatttttcgttttgaaaagatgatttctgtatgacatttcctctcaatgaaaaaactcattgctttaggcttaatcatatgctctgtcatgattcattcaggagctaatgtctatttaaaacatagatttagacttgtttggccttaggtcctactatttcatttatatcactttggtggtgggatgcactcatcatctgaaagactgccaaattatttttggtttctttaggatctttttacttaaccacattatccattatcaccacttttttttttttgagacggagtttcgctctgtcacccaggctggagtgcagtgatgcgatcttggctcactgcaagctccccttcccgggttcacgccattctcctgcctcagcctcccgagtagctgggactgcaggcgcccgccaccacgatgcctggctaatttttttgtatttttagagagacagggtttcaccacgttagccaggatggtctcgatctcctgacctcgtgatccacccacctcagcctcccaaagtgctcgcatatcaggtgtgagccactgcaccctgcccattatcaccatttctgacatacacatgcaaatatatgtgcactgctttaaaaatatgattgataattttcatgtattagtgttacttaagatattcctggggtaactgtcaggctgttaggtttttgagcctagtttcttagaatgaatgaaaaaaggaaaacttcaataaaattgattaggattatttttcagagaactaaatctgctaaatttgatagttttctttttaatgaaaatttgtttaaaagactaattttcagagaagaaagctaataggatttgagtttgcttatagaatcttattaaaccatttatatatgtgaatgaaataaggatatttttatgatgataattttacatggctttttccttggacatgatgtcttaaatgttattatagaaaatttcaagtatatgtaaatgtagggagagagtagaatgaatcaccatgtactcatcatccagcttcaacaattatgataatacttggagtttagaacagtgttttgagtcagcaccgacctgctgatctgagatttaacttagagtttctttgctttatttattaattttattctttaattaaattcacagaatgaacataaggattactttgtatgcggtgtcaagttgcctaattctgaggacttccaaggtattttattttttattttgaagatttgttatatattaatatatggaaatagaatatcttgaaatgctggttgcctagcactttatccaaaggaatttttggactttctgtcctttcccaattgcaagtatgtatatcagactccttgatgggagatagaatgttaggtctgatcatagaaaaataattactgaaccttatattagaaatttaaaagaaaatagtttttaaatgggctttaagcaaattagacagtcaggttcttaagaatacaaataatcgcccttccttttggtttgatttttatgaaaaatttgtgtatggttgggagcagaggaacagcaaacaaaatctgttctgttattatttagaaagtcatattactgctgacctgaaaagtatttgaaaatttaattttgtgaagtttccattaccacaggcttaatttgttatactatcatttctgttatcttttaactaaaaataaagaaagaaattacattaaaggtattatagaatatgatccttagtaatttctatattttaaaatcttttgtttttcctactctgcaaatattccaaagaatttattttctttggcatatcagtgatcatttttattgttagccaagtgggttcttttcccttagcctaaacaatgctttgaggcctactaaatatctttatagattattcccaagccagcgttttatctacttgagaagttactaaagaagagagcattgctagttttgatcaggactttcattttcttataaagaagctgttgttattggtgatcatttaacatctaagagtgttttgttaccctgttgggcccttacctgtaagtactttggacgtgataaaaggagagtgataaaccaggagttggaaaacctgtgttcaagtcctgattgcccctgtataaaccatgtaatttggaacaagtaatgtaacctttgagttgatttcctaattgattgaatgaactattaatttatgccctacctgtcttatatgattgttgtggaaaataagtgaggtataccagtagctataaatgcataagattttgcctaatctttaatactcacaaaaacaaagggatcctataaggaaaatggtattcagtgacttgcttgaggccacaaaactaggtaataatatagctaggatttgtctggtttccatttcatagtgctccctcagatatctgtaagacattcacaaaaatgtgttttgatattaattttaggcaaagttgtggtatcttgaagcccatggcgcatcattttcctcattgattcatttagtaaacatattgagtacttttgtcccgtaccagtttcctgggatacagaacattattcattgaaaaaaatgttcattgaacacctaaatgccaggcacatgatgcagaaagtaaacatgttctctccttccatggagcttattgggggagacagccaataaacaagaaactaagtaactagcaagtatttaataaaggaatatgctatcccagagaatggaagaaactgctttagataaagcagtcagagaagacctctctaaggagaaatataaaattgagggctaaaaggagccaactatgctacagctgggggaagagcatttctaggagaagggtcaccaagtacaaaggtgatgatgaaggaggaatgggcttggcatctctcaaaaaactcagcgtttggggaatgtgagaaaagacttgtattttgggtaaatcatgtaatctttcagcttaatttcttataagatatctatatctgtaatttcttgtgatgattgaatgaaatcacatttgaaaaagcttttcatataggaggtactcaataaatataattggaatttgttgcaaaagagagaggcaggaaggacagtaaagaccagacgtgtgcagctggagcatagtgagcgagggaagagctacgttagaagaggtaggagagggcagccagggccttgaggtcactataaggagttgatattttattctcgaggaagtaggaaatgcctgagggacttcaagaagcaggatggcatgagctgagttaggcttttaaaagtcactctggctgctaaatacagaatgatttgaagggggcagtcagagaagtaggaatatcaggagtggtggtctgattactctgagatgtgtcttgattctattttgttttctttgaaattccttgtctcctagtttttcatagcttttgtagttatctacacttacaatgcccaacaagctgaatacagtctccctaccctttaataaattagtgtagctttttagtgcagttgttgaaaaacaaaatgtgagataaaatgaaataaatgtttaattttactctaaggtcatattcattcccattccccattacccttaggaatcagaaattttaagaagcacatgcagtaatattggactttaaaaatcttacattggccgggtgcggtggctcacgcctgtaattccagcactttgggaggctgaagtgtgcagatcatttgaggtcaagagtttgagaccagcctgaccgatatggtgaaacactgtttctactaaaaatacaaaaaattagctgggtgtggtggcacacacctgtaatctcagctacttgggaggctgaggcacgagaatcacttgaacccagaggcaaaggttgcagtgggctgagattgcaccactgcactccagcctgagtgacagagtgagactctgtctaaaaacaaaaacaaacaaataaaatcttatgttaatatcctgcaggcacttgcatttactaaatgtattgagtgttctgtgtatgtcatccatggtgccaggtgttgagggtgtaagagatggttaagacattgatcctgcctcagtgagattatagtccagttgaggatatcagatttgtaatcaagacagtcagtaagtatttattgaattcatactctgtgtcaggcacttagaagtttatagcaggtacatggtactcaaaaaagtgagaataatcacttctatcaggagcgatcaggaaaacttttatagagaagatgatttcagtgtcttaagaaataaaatgatgttttccagtagaaaaaagagtaagaagacattttaggctgggtgagtagaaatatagtaacataggctgggcatggtggctcatgcctgtaatcctagcactttgggggactgaggtgggaggattgcttgtgaccaggagtttgaggctgtagtgagctatgattttgccactgtactccagtctaggtgacagagtgagaacccatttcaaaatagaaaataagaaagggaaataaatatgataacatggaacatcatgatgttctcacatttaccctaattctcacaactgtgagaattaattccatctgtaaggaaaggaattaccctcaatttaaaaaaggaaaaaaaaaaagaaaaagaaaattgaagctcagagagattagttaattttttcaaggagtcatattaaacagtgataaacctaaggttattcctggtctgcctgattctaagattcgtataattcttgccacaattcagttttcttcctcgctttgaataataacctctttaaacctgtgacaactttttagtattctatagcagctgctttctgggagagactctagtgaaggaactccaagctggttattctgtgatattcatgagactttgctgggatagactttatgctgcatggggtgatactgtttgagaaactccaccgtagtgctccaacattagtgtgcttttctaagtgggtaagttactgttgcagtatgccaaggagacctggacacagtgggagaaaaatgtccagtgaagggtgttcatctgagttccactgaccgagacatttagcttaaaaaaaaaatgtttgtgtgtgtgtgtgtgtgtgtgtgtgtgtgtgtgtgtgtgtgtgtgtgtgtttaagtaatccataacacgagagccttttgtggtaatgagacccagatttccttctgtgtctgtatccctttatgcaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatggtaagagcttttagatcacttattgtacttggatgcgtttgaatattaatagtttgtccaacatataaatcaaaggaacatttgaatgcatttataatgttatggccattgcgtgtttgtggaatttgttgtcataaaaattatacaaaagctacagccttgagtggttacctacattttaaaaataaaccaggaatatttattatgaggaaactgggttttaattttattttcaagccccttaaaagtttgttggaattagcatctttttcacatacctgagtcttaaggttcattcgtgtttctccctggaccgtccactcctgctccaacttctcactaacaaaactattgtctgtgacctttctaacccccagaacagcataaggtacacaaacttctgctctgccttaggtgttagggacgtcattaatgcttactggaaaagcacaccccagagagctgggttttggctgtggcaggtaaaaaaatctttcagatcttgcaatgctggaaaccttaaaccttttggttttttagctaaagtgattggcaacagaatgtgacatctgaggttgcatggcctgcaatagccataattaaccacatgagctcacattttcccactggagattcagtggtcttggggtgatgaaagtgacttccctaccaggaggtggttttccttttgagggtattgaaatacccttgggccctgtaatgcttcacccatggtccttttaaaatgctttttaatataaaggttcaatattggaaatctaacaccacagtgtttaacactgagtctgtgatggagcactatggcctggaatgggaaacctagaatttttaataggtggagtgggaagacttgtggcaagaatggtgagtgtgaataacctgaatcaaagctgatttccaatattattcaattttcagtgtgtgctatttctttttgttttatttctgtgtgtagacttctcttagagatgcctttttatctttaaacaaagttgttttgttcattggtgggaagtgatgttagaaaatcaacttttggttattttaatagagatgtggatgtagtctcaaaatatacaaatataattctttagcagtcctcctttcataatatggggaaaatgtagatgcttgaatgtttagcattagatagatagttttgaaacattcattgtttgcatttgacttgcttgaaaggctaatttaagaggcctgctcctttctggaagttttcaaatcctcttctgtcaggtcatataggaaaggaaaagctttgtataaagcacatagagggaagttgcaacttagcatagtattatctgtctttaagtcctcatcttcttcctcttcccctctctcttcaaaaggtggttattgaagatcaagtccttttactgacaggaatattttaaatttgataagacctaatctttacggaaagcacgaggcagaattcagtcacctgtgaagaaactcacagttacagctgtgactccacacctgtataggtattctggaggattgtggacacaattctttcagttacttcatcactcatagtttctacctatgtggctttgaccaagccatttataccacctgggtctcatttctctcttctccaagttggtagcatcagagtcagtgattgtgaaagtttctcttagttctattattgtatgataatgaatttataatgtaacaaatttataatgtaaagtacttttagtccctaaggtagtctgatgtacgggtttcagcagaaggaaagtgttgtagtagtattcaaggtacttgggtgggactggggcaagaggacacggtctctaaaaataattaggattctagttagttagagcatgactcagtagttggttgaaaattactgctgtttgatttttttccatgggtttgttttagagaacagacattccttgagaagcccattttctgttgagtactatgcaagtcatcgaggactctcagactttttatgtgctctttgctcttactagaaaactgtgaagaaactaaggtggtacacgtgtgtcatatgcttggtacattcgaggctcccaagttaaaaaattgttatatgctgggcacagtggcacaaacctgtagtcccagttacttgggaggctgaggcatgaggattgctcgagcccaggagtttgaggtcggcctgggcaacatagtgagacctcatctttttttaaaaaataattgttatattaatgtttaacaataaatttatgagacagtacagtagactggttaatcgtggaagattgggtgtcaagccaacctgtttactagctgtattactttggaaggattccttaatctctgagccttagtttgtttatctgtaaaaggaatgcaatagcatttaaaaggtgtttaacattgttagtgaatgaatgaatgtcatatataaagtactatagacagttctggacagaaaaaagtatatatataaaaaaatatataaatagttacctatttttataagactaccaaagaaaaacaaatagtctgctatggtagttaagggtagagaattcactgaggaatggatctctgtagtggcacttctaccataagaaggtagtgcttacgtaattaagtggaaacagaaagaagaatgcgaaaatttttattggtaattgaggttaaagccacccttagaagtcagggaatagtcaaggcatggtcattgtgatcatttcagcccttcttctctagccagatgggatattccagattatgtgttaaatgttttagtgtatgagtgcacacacgtgcacttgtgcacttttaaaagcatttaggaatactgtataccaagaagatcctgtttccttcctcttgggggaagtttaaaactttctgttgtattactcccttagcccctgaatcatcatttatcacttgatagatagtggcagaaatctggataagtttagaaaatgtaattgtctgtggctttttgaaagctagatgcttatgtctgattataagatacctgcattttttcctagtagttgcttccacctatattacataaatagggtggtatatgaacagtgtggtttttcaccttttgcttttgctgtttaaagcattttcccccttaacccatatttaacttcatagacttattatgtaaccctgtctttttcaatatcaagaacataccccataagaatgattatactatttcatttccctttagaattaataatgttgtaaaatagtacaactatattgtctaggaaattcttaatgaataaaatgtataaccactgtatagtgtgttaagtttaaacctctgaagctaattttcatatcatgtaatagactcaagtattaattcatcctgtaaaaatgctgggaaagaaagcaatggttatttggacatagtaagagttcttgctttaaggtatatatcaaatgttaatctcatcacattaattattgggaaatagtttaaaatacagttagtagatgaagtttcaagtcttgttaatgtgtttacatttgcataaaatttatataatttagataagtggttaatattttatgtaccacatatttttataaaatattctttgaaaattatttattatcttatggttatttataaggtaaatagttattttcttttcctctgcttttgaatttacagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtaagtgtcttttttttaaaaaaatgattttaacatcaagccagtataaaacatggggtataacaaaatacataaaatgtaatctaaattatgacaacttttatataacctttgtagagtgcctcattcatttaaatcaaatgtagttattatgtgaaactagttattcatataaattttaatgactcaacccctgggcttccaagaattgctaatggtggcaaaaatttacttaagtttcatttactttcttcttacttttgtgaggataagtgtcatatgatctacaaatattcacctagtacctcttgcctgccactcaacaagtaaaatgttaaaagatttgtcagagatctaactaggaaaagatataatggcagattgaacatagctgaaaagtagattagtgaattggaagataggtcagcagaaaatacaagtgtctaatatacatataatttcaggcacagagaggctggaaagattgtgaggtaaacacaaaattttaagagataatgactaagaattttcaaatttaacaaaagacatgaaattacaaattcaagaagcactaacaaaacagaatgacaataaagaaaacatacctggggaaattaaacagctgaatatcaaagagaaagtgaaaatactaaaagcaactagagagaaagacatgatagcatgaaaagattgatagtaagactgaaagctgatttctcaatggaacaatggaagccagatggtgatgcagtgacattttaaaatatggaaaaaacagaactgtccacttagaattctatacccagtgaaaatattattcaaaagtacaggcaaaataaagatatttcagaccatcaaaactgagaaaatatatcgcagcagacctgcagtaaaggaaatactaaaggaagaataaaaataatttcaaaaagaaacatggaaatacagtacagaacaaagaataagagaaaggaacaaagaataagagaaaggataaagatgtatttctaaattcattttgactataaataaatactaatgtcttcttaaatataacatgcatatacataataatatatgtaggtttataatgcatggttctaacacaaaaagtaaaaagggttgagtggggttaaagtgctcagagatcttagcattgtctggaaaatggtaaaggtactaatttatattcagactaataaacatgcatattgtacttttctttttttttgccttcagcactttaaatatgtaacatcactctctcctgtcctgttagtcttccactgtaaagtctgctgccagatgaatgggagctccattgtatgttacttgtttctttaaaaaaaaaaaagatagagctttattgtgaaaaatcatttgattgctaatgtaatccaattatttggttccactgtgttttttttgttgttgttgtttgtttttttgagatggagtcttgctctgttgccaggctggagggcagtggcgcaatctcggctcactgcaacctccacctcctgggttcaacaattctcctgcctcagcctcccgagtagctgggaatacaggcacgcaccagcacgcccagctaatttttgtatttttagtagagacgaggtttcaccatgttggccaggatggtctcaatctcttgacctcatgatccacccaccttggccttccagagtactgggattacaggccattgtgtgattttatagcattctttgccattgctttatttatatttatccttgtttcttttctcctgctgcttttaggatcttctctttatacttgacctttgggagtttgattgttaaatgctttaaggtagtcttctttgagttaaatctgtgtggtgttctgtaaccttcttgtacttgaatattgatattttttcctaggtttgggaagttctctgttattattcctttctactcctatctctttctcgacctcctctttaaggccagtaactcttaggtttgccctttgaggctattttctagttctgtaggcatgcttcattcttttttattcttttttcttttgtctcctctgactgagcattttcaaatagcctgtcttcaagaccactaattctatcttcttcttgatcaattctgctattaagagactttgatgcattcttcagtatttcagttgcatttttcacctctagaatatccacttgattctttttaattatttcaatctctttgttaaatttatctgatagaagtctgaattccttctctgtattatcttgaatttctttgtgtttccacaaaacggctattttgaattctctgtccgaaagatcacatacctctgtttctccagaattggtccctgatgccttatttagttaatttggggaggtcatgttttccttgatggccttgatgcttgtggatgtttgccagtgtctgggcattgaagagtttaggtatttactatagtctccacagtgtgggcttgtttatacctgtctttcttgggaaggctttccaggtttttgaaaggacttggatgttgtgatctaagctgtatctgcattagggggaacactaagctcagtaacactgtggttcttgcagtcttgtagaggtaccacttggtggtcttggataagatccagaagggttctctggattaccaggcagagattcctgttctctaccattactttttctcagtctctctctctatgctgagccatctggagctgggagtagggagacacaatcaccctcgtggcctccaccactgggatttccctggttcagacctgatgccagcataggactgggtcttatcctaggccctgtgtaacctctacctggctaccacctatgtttgctcaagaccctgtggctctacaattagcaggtggtgaagccagccaggattgtgtccttcccttcagggcagcaagtttcccccggcccctgagcaggtccagagatgctgtttaggaggcaaagactggagtccaaaaccttagaaatctatctggttctctattctattgcggctaagctggtgcttaaactctaagacaaagtccttcccacttttccctctccttattatacgcagaggtttctcttcacttggccaccatcacctagacccacggtgggtactgtcaggctatcactgatgttcacttaaggctcaagggctcttcagttagcttgtggcgaatgctgccacacctgggagtcacacttcagggcagagggttcccctctggaccaggacacgtccagaaatgccatccaagagccaaggcctggaatcagggaccccaaaagcccatttggtgctctactccactgtggccaagctggtacctgaaaacagcacatctcagagtctcacccaaggcccacagcttactgtctagctattactcctggttcttcagggcccaagggctttttggtcacaggtgatgaatcctgccaggacttggtccttccttttaaggcaacacattcccttctggcccagcgtgggtctagatatgtcatctgggagctagggcctggaatgggggcctcatgattgcccagtgccctatcctattgtggctaagctggtatccaagatgcaagacaaagtctcccttctcccaacaagcagaaagaaggagtcttttttttttttttttttttttttgctgcaggctgcgctgcctaaggttggtgaaggggtgtcacaagaacttccttagccaccccggctagtgtcccatgtccattgcctctaaggccagcactagcactaggacttacctaggaattgcagtcttcacagcctagactgtctttcaagattatttagaaccccagagcaccttttccgtggtagaaagttttgccaaaactcaagttctaaccactgggatgggcgattcccctctgactagggctgatctaaatgctgcctccatggatgggcattggctgagtttagtccagttttgtttcccactgtgacagagcagcactgagttgaatgcaaagtaccacaatcgctgtgctctccctccctcaagagcacagatgctctgtatctcatggccgctgctgaaggagtggggaaggggcggcgtcagcaattcaagtctgtctttcctaccgtcttcaatgcctttttcagctatatgaagttaaaaccaggtactgtgattgcttacctgatttttggttcttatgtaggtgcttttttgtgtgtgtagatggttgttaaattggtgttcctgcaaggttagcaggggaacaatcggtgaaagcatctattcagccatcttgcttcaccctcctcatggtgttttcttataatccttttcatttctgtaaggtttgtagtaatgtccccactttcatttctcattttactgcattttctttcttctttttcatagtcattctagttaaagatttgtcaatttcttttcaaagaaaagacttgtggttttgttgattctctctagtgtttttttgctctccattttgtgtatctctgctcttatctttattatctccttcattctgctagctttgtgttttattttcttttttctctagtttcttaaagatggcaacttaggttaatgagatctttcttttataatgtcagtgtttacacctataaaatagtttccataccccattcatttttgtatgttatgtttttttaaattaaagtcaaagtattttctaatttccctgtgatttctttattgaccactggttgtttatgagagcattctttggctgggcctagtggctcatgcctgtaatcccagcactctgggaggccaaggcaggcagatactttgaggccaggagtttgagaccagcctagacaacatggcgagacactgtctttacaaaaaatacaaaaattagctgagcgtggtggtgtgcacctatagtcccagctactcaagaagctgaggtgggataattgattaagcccaggaggcgaaggctgcagtgagccaagattgcagcactgcattccagcctgggtgacagagcaagaccctgtctcaaaaaaaaaaagagcattaattttcacatatttgtgaattttctagttttcctttcattattgagttctcgttttattccattgtgacagagaagcagagatgatagttttatgattgtaatattttttaaattatgaagacttgttttgtggcctaatgtattgtctatcctggagaacattctacatgcacttgagaaaaatgtgtattctgctgtcattagatgctatttatgtctgttagatctagttggtttatgatgttctcaagtcctcgatttccttattgatcttctgtctaaatgttccatttatgactgggaatagagtattgaattcttcaactattagtgtaaaactgtatatttctcctttcaattctgtcaacatttgcttcatatattttagacctctgttgttttgtgcacatatttcttgttatgtctgcctgatgaattgacccttttattggtatatttttgcctcttataacaacttttgaccaaaagactgttttatctgatattagtatgaccaccccagctctcctttggttactatttgcatggactgtctttcccatcttttcactttgaacctttttatctagaataagtctcttgaagatggcatatagttggagcatgccttttatgcattcctccaatctctgcctttggattagagtttttaatccacttacacttagttactggtagggaaaaacttacttatgccactttgctatttgttttctgtatgtcttatgctttttttgtgtctcatttcctttattactgccttcttttgtgcttagttgatattttttgaggtgtacccttttgattcctttctcatttccttttctgtgtattttatagattttttatggttatgatgggattttaattaacaccctacatttataacattctagtttgaactgataccagttagcttcagtagcatataaaaactctgtttctatacacctctcctcctccctcccatctttatgttgttgttgtcacaaattgcatcattatacattgtgtgcccataatactgtcttttttatttacatatgtaattaccttttctggatttttatttctttatacagcttcaagttactatctatggtcctttaatttcagttgaaggccttagccttcactttctggttgcactaagcctagctgtcagccagaggggaaagtgtaggcccttcaggttttttctgaacatgcatcttgtttcgggcatgaatgtagcttctacattccccactatacttggacacttttgaatgacctaatttctcaaagaaactctctccagcttttcttcccaggctttaggcaatctgttttatgtctgaactgtaatttttttgccccaggtggctctgggttgtttgtttgccttactgcttgaacatttgttagctgcttttcagttctgagtgagttcagactaggtgaggaacaagggaaagtgacttgcattagtccttcaggtagccaccagacaagttagaacagacacactttgtttttagaataagaatctgatcaaaaaatgaggtgtcatactgagagggcaggctgttgtcttcaagacctatgctgagctggagaggagggtggggccaaggcaagtcaaaaagctgcaaaactttcttcctggttttgagtttcttttttcttgatttaatgttcagacaattgatataaacctttgactgttttccggggttttgacaaagttgattttgacaatttttcttgattttttctttttagatgtttccctggagggataggtctttggctatatctactgtaccatttttgctgacatcatttggtttgtttaatgatgaaaaacatggcttataagggatgaagggacgcctagatgattttaagcaaaagagaataccatgaccagatatatacttaagaaagatcaccttgtagttctctggagactgggatatttccaaccagccttctcctagtgccgtaatgttcaaattaagtgtctttccagatttttatcaaaatttttcatgataatcagactttaaaattagttatccaggaaaatcactttgcgagcttgcaggaagggtgttccttgagatggtaaatattcttgctccagatcagttgcacactttaatttgtgaagtagcaacttaatatgtgggcaatttcaagtagcatgccccagtgtgagtagcagcagtgatttattaattgattggttgattttctcgagtgatctggtaaggccagctggttttaggtgattatgttatcccttttttccttggcagccagaggaaccacaggaattgcattttggtgaatgaattttatattcttcctctatcttcctccttttgctgaaacacaaattgtattttgttgattttgatatatacattttgggcattttaatattgataaaaatgagatgcatcttataattaatgggcatgtcatattataattgatagtacttttcttagtgttacataagttaatgatgcattttacaattgatgctgtcttagattttaggaactcttaagtgttttagctggttttatgcatttttgtgaagtacttcaaatcctttttggaataacatggatgtataaataaatatataaatagaaatatgtttagtgattatgcttatgcctcagttattcttagcctggatcactgaaagagcaaattagacatggtttttctttctcttgttttcaattttgatgtaaacctttccaggacattagatggaatcagatcttcatgggagatggcaagtagaaattgaatgactcattggataaattataattaatgtaatggccctaggaattttcagcctctcccctctctgattatctatctcatctggctattggcacttgagatgttaaagttcaaagctctatttagccagttttgctggaagagaaaaagaccgatttcttttctttgtctggccagtttgaaacacaggcctggactgatgccttgtctaaaccattacttgtgcacctgcatactgtaaagggaaactctgaaatctttgctgcgtttcactgtgaggctcagaccacaaaacatgaggaatgtaaccagagtccagctgcagtgttcctccaccccccacttctttcactgaggactgaaaagtatgttttaaagtgatttttggaatgaaattcattagtcattgttattgtgctacttaactgtctggtagataataaattcagaatggattagtgaaacaagccatgagttaggacctagctgatcagagcatatggctttttcaaggccttaaaagatgtctgaagtttgttttattctcaggaggagaaacagggggtggtataattggcaggcacttttgaaactttctggcctgctcacaacaatacttttataaatctctaaaagatggtcagccatttttctgttgtagaattattggaacttagagaaatggtaatgctgtttccttgattttgtgtacttatgtttgttcctatggaggatcctgaccttaccaaaaccccaagagttgccctttttacctgattgattctgatttcaagacagaatttctaaagtataaagaaattgtgatgtgttcaaaatcagataatattgggccaagatcatagtcattgcatgtggacctgattctcattagagtggaatggtctaacaccttttttgtgactaggtgcataaggcggtcatatatcctatgtataaagaggttggccaaacaggtccccaagtcttatgacctgcgttttttattattcttgcagccacatagacaggtcaagaggattatggaccttcccgttctgcatagctagtttgcattttaccaagagggaagagacaaaggagttttcagagtagcagtgagcaggctgattccttatctctgtattccctcagcctacctcttggctgagcaacactaacttgataaataaatgaatgaaaatgtctttctgatggcctcttcttgaaacaattagaataccttgagctttatttgtataagtaataagttttctgtagaaatagtgagtggcacccagaattttattggtaaaaagcttatattgaaaacataaatgaaaattccagaactctagttttcagactgctgtaattctgactcctcatttctattattacctgcttcaggcatacttaaacacctgttgacaacatcttatattaagaattacatattccttcctataaaaattctcagcttctgtttgttaatcaagctattttagtgcagagagttcagaaatgattgttgttttcactagattagcatctgtttgctttcatggcatccaattaaatctgatggccttcttccagaaatggggaattttcatatcatgcttaggcttaaatgctatggccttcatttccaactctcttctgtgtatcctataaattagaacatttcttataacctttcatcttcattttattgtaggttgttgctcagatgttggcatttagagcactcagtagacccagaccctaaacctttaaattggatgataaatacattgacttgaggcagtggaaaagagtggaccaaatgctttggttctctatcttccttgctatgcaactttaaagtataattaagcaaatatttttcagggtgactaatactactgaaatgaatgaaaattgttagttcttttggattttccacttgattacaggaatttgacctaacttgaaaaatctctgttcatgtgaaaactttcccaaatgtctgtagtccaattctctataattacctaacagtacaccatggaacagaaatcaaggtgaaaaaaaaaaagtccatgcagaattgtagacttactgtgttttagaaccagtcggaatattattacatcatctgattgaacccttcatttcacaaatggagaaacaggttgaaagatgaagtgaggtcatacaagttaactaagcattcattttgatatgcccccctgaggagaggcaagcccagaagatgaagtgctaattattaagttttgtacttgtaaagcaaacatataggagatggaagaagtatttttatcaaaatgggtctgcactggagcctgaaatactcccttttcctgatttagggaaagcactcttgtaaagaatgcagaaatgtgaatctctgaatattaagcagttactctgttactttctcactgaaaatgttaattattcaaatcacacttattagttagttcattcgacatttgttttttctctaaaaggtatggtgcaaaatgcatctctttttttctctcttgcctccaatttaaacttgacaaaatttttgttttttatttccaattattttggactttggggtcatgttggcttctctcttattgctgagtgactgtggcaatgttctcctctctgagtcttggttctcctggcatagtacctatgtcactatgccactaggttgttgtaaggattaaataagcgcagtgcttggcatacagaaaatgcttaacaaaattttgcaactactgttatgtatacgttgagctttgcaataggaatcctaggcatgtaagtttttattctgtgtgctagatagaagatgggcctaataaagggcaaggaatattaaaaatgtaatccagtgggaaagtactgtatttccttttgtaatagtgttgtgaggtacatcatctttaagtcaatggtctaagtgcagaggactagtgaagttccccataatgcagggataaaaactggtgtaggtctgaaggcttgtctgtttacaggcatacctcatttttttgcattttacattattgtgcttcatagagactgcattttttacaaattgaaggtttgtggtaaccttgcatcaagcaagtctgtcagtggtatttttccaacagcatgtgctcactttgtgtctctgtcacattttattaactttcacaatatttcaagcttttcattattattatatctattgtggtgacctataatcaatgatctttcatgttattgttgtaattattttgggacaatacaaaccacaccaatataagatggcagacttaatcaatgttgtgtgtgttctgactgctccactgaccagctcttcccccatctctctccctctcctcaaacctccatagtccctgagacacaacattattgaaactagaccaattaatatagccctataatggcctctaagtgttcaagtgaaaggaagagttccaatatctcattttaaattaaaagctaggaatgattgagcttaatgaggaaagaatgtgaaaagctgagatgggctgaaagctaggcctcttgtgtgaaagagccaagttgtaaattcaaaggaaaagtccttgaaagaaattaaaagtgctactccagtgaacatacaaatgataagaaagtgaaaagacttattgctgatatggatagagttttagtggtctggataaaaaagtcaaaccagccgcaacattcccataagccaaagcctaatccagagcaacgacctaactttcttcagttacttgaaatctgagagaaatgaggaagctgcaggagaaaagttggaagctacagaggttggttaatgaggtttaaggaaagaagccatccctagaacacagaagtacaaggtgaagcaggaagtgctgatagagaagctgcagcaagttatccagaagatctagctaagagtattgatgcaggtggctacactaaacaacagattttcaaggtagacaaaaatagccttctgttggaagaaaatgccatctaggacttcgatagctggaaaggagaagtcaatgcctgactgcaaagattcaaaggaaaagctgactcttttattaggggctaatacagctgctaactttaagctaatgctcagtgaccattctgaaaatcctggggcccttaagaatgatgctaactatactctgtgttctataaatgtaacatcaaatcctatatgacagcacatctgtttacaacatggtttattgaatattttaaggcccctgttgagacctacggctcagaaaaaaatattcctttcaaaatattactgttcattgaaaacacacctggttacccacaagtgctgaatggaagttgtcttcatgcctgctaacatagtatccattccgcaacccatggatgacttttaagtcttcttatttaagaaacacatttcatcacatttcataagactgtagctgccatacatagtgattcctctgatggatctgggcaaaatcaatggaaaactttctggacagtattcaccattctaaatgcgattcagaatattcatgattcatgggaggagataaaaatatcagcattaacagaagtttggaagaagttgattccaaccctcatggatgattttgaagggttcaagacttcagtggaagaaataactatttcatgataaaagtttaacaatgaggagttgcatcttatggatgagcaaagaaagtggttccttgagatggaacctaattctagtgaagatgatgtaaaaaaaggatttagaatgttacataaacttagttgacaaggaagtggcagggtttgagaggaaggattgactccaattgtaaaagaagttctactgtgggtaaatgctatcaaacagcattgcatgctacatgaaaggcaaagtcaattgatgccaaaaacttcattgtcttattttaagaaattgtcacagccactccaaccttcagcaaccaccaccctgattagtcaatagctattgccaagtaggcaagaccctccaccagcaaaaacattatgactctctgaaggctcagatgatcattagcattttttagcaataatatgtttttaaactaagatacgtacgttgttttaaactatatattttgtattttctttaattttttccatgaacacatgttcaaagatatttttaaaacataatgctattttcatatatactgggaaacaaaaaaaaaactgtatgagtcactctttattgagatactcactttatttatttttatttttatttgtagagaaagggtgccgctatgttgaccaggctgatctcaaactcctggcatcaagcgatacttctctctcaccctcccaaaatgctgggattacagctgtgagccacaacacccggccaagatactaacttttctgcagtggtttgggaccaaacccacaatatatccagtgtatgtctgtacttcaaataggccgagagttaactgtctacagtctgctaagtagtcacgtaagcatgtgtgccttggaagatacgggttagtgaatgctgaagcccttattcttacaaggaatgcagagcattttcaaactaaatagttctcaccctggcccactatttacttttttagtcatatccccaggttccttcccagttcgtaacctatgcttcagtcagactgaacaattggttgttttccaaacacatcacagtatttcctaccttgatactcattgtccatgctattctatttgtctggaatgccctccctagccatctctagcatcaaaactgtgcttgtacatgaagccctcccttattatcaaaactttcatcgtaagctctttcttgatttcccatagtttggtaaactgtaattcttttggattcctgtgaactattctctctatatagtatcacagaaatgaagttctttatatgtactttaatttaataacagcccaactcaatgatgcaggtagtgtatttgagttatttatccttgtctgaaatattttcagggtagaaactgcatcttacttggtgtcagacttccctgacttgcagagaggcttgtattttgtagacactcaataaatatttcttgaattaggagagtaaaaggaacattcagtttttgcaaattctattaggtaatctgacactctactctgtgacccattgttttaactctggatgctctggccaggacaatcattatttcatagagtcccttgggactgtggcaagctattaacttctgtgctgttgtaatccaaggcacaggcatcagcactgatggggttatgttcaggggtgtgagcaaagaacatgttttaaaataaggaatccccatggaaattcaggcagtaaagatcaacaaaataaaaatgcagaaggtggctgctgggtgagacaggaaatgaacaccttgtgaagattaggcattccgctgagagaggagaaatgtggaaaatgagtcaagagaaattgtgcagctatttcatcactgacacttggaggtatattgttgtgtgtgttgtttttaatgaagtgtgcttttatagtgctgatgttattatctggatgaggaagtcttctctagtattactgtcatctcagctttctgtaaccaactaaattaaaatacagtaatgtaatgggacagtgggataagaaagaaaaccagatgactctgacatgtgaccccaacctgaacttactgcttttctagttttcggtatactcaaataaaaatagagtccagtgtaatgcttgcaggggctggggggactggacagaggaataatatatttagttaatagtggggtatgtcccacattcaatactgttacattattaatatatgtgaaatcagtgtttctcaacaggactcccaacacatcagtgagcgtgccagtagttcatggactatttgcagtccattattatttatcataggacagcatagatgctttgtgttctgatatgaagtaatcattgaatttaataaagctttattttattggtgttgcatgaaagtagctctgttcttttctttaattcttgtatgtttgaattttttggtaagcaaagaatgggagaatgagggtaattatatcaagccagagagtttgcagtaggtaatttgggggaatattttggtttcctgacaaaaatgaatggaaggaaagagtaaaaattatttttaggtagatgtgaaattattttaacttccaaaagcatctcataatagttctctagacagttttctaaggataataacatttatgtcctgggtaatggtatcattataaaacaaatttatgtcactctttaatccagatagttttaactaccatatttttatacctctcttttggatgatttacaattattaaggatgatcaccaaaagtagtttctgaatcagattaaatgatcaattagtttttaatagttgcttttcttctctaattcattgaaaatgaaaaactgatataacatttaattcatatatagttaaatcataagagagttcagttgtaagaggggacatcgcaagaaagccaaccatgtttattgagcactaggacatactagtcactgcacaagatgctagaattaggtaaagttacctggctctgaactggcatcaggatgcacagcaagtcagcagagtcattctccacataataagacccatgctagagatcagcacagggttgggttgcaggtagtcagcagaggcatgcttgatgagatggcccctaagcatctgagctgctgagtatggaataggattaggagctgtccaagtgacccagatgtaatgaaacacgtacactggcacaaagcagataatacacctttccatggaccaaagcctccactttctcaccttgcctcataagtgaattcactttacactgctgaacagttaacattgagacatgtataagagaagagtattaatatttagtctaagtataaattaaacttaccttcaaagatgattagctttaagtggttaatattaaaatacatttgttcaaaggatagaaacctatctataaagtatttttgatcacggattggttgtaataaatatatgactaatttgatttaaacagagtttcttccacatgtaactatctaacagagataagccatgttggcttttaaataataaaacttgtatattctaaattaggaaaggaaaaatcatggctttcctgtttcactcttctgaaagaactttggcatcagatacaccttgaaccagtttattccacctctctagcctcagaatactcttttggaaagcaaaaataatggcttcacagaaaggtggagaagaatagagagaatttatataaaatgacctttgcatataatagtcactcagtaaatatttgtatactgataaatgaacctagtagtcacgatattaatttttcccttctagttgaatttatcttatattattccagtagaaatgagactcataagtttttagaatttgaaaaatccttggctttgaatttagaaaggatttcttaactaaatcacagaaacaagaccatattatgagaaatggtctataagtttgatttaagaaaaaaaaaccttgtctataattcatagcttttagattaactaaatgtcaggatccagaatatatatttttaaaacctttatttataaacaagtaaaggagcaatcaacctaataaaaatatggacataatatatgaagaagctgttacagaagaacaaaccctagatgtttaataacataagaaaaatactcagcctcactaataatcaggaaatgcatgttaaaaccagaaggagatgccattttatatccatcaaactggcaaaaattagaatgtctatttagtaccagatttagtgagcacatagaggaagagaaactctcatcctttgcttgtgagagtttcagttcatttgtttcagaaagcagtttaacaatacagttaaatctgcaggaaccccactcaacctaagaacctcaatcctggttatatactagtctgttgagtagctgttacatatatgcatcctacaaatatttattatgtctgtattatatagatatttaaaccttatatcttagttaccattattgtgttttggaattattcataattatatagctaatatttaattgttttaagagcctgtgtcctcttgtactatccctttcagagccattatttctgtgcaacattattttctgtctatttctatttttttgaaacaaggtctcactctgtcactcaggctggaatgcagtagtgtagtcatagcagctttgacctcctggtctcaagcacatctcccacctcagcctcccgaatacctgggattatagtcttatgccagcatgcccagctattttttctaattgtatttttttgtagagatgagttctccctgtgttgcccgggctggtcctgaactcctgggctaaagtgattatcccgccttggcctcccaaagtgctgggattacagtcgtgagctacccgcacctggcccattattttatttaacgtttttttaaaggctactttttaaaagtctaggatatatgtttctctgtacctagcttctttctttttattaacataaggtcaatgtgggtggttacttttttcttataattcatgtcattttcatacaccagttctggcttcttgattggttttaattttatagtagcagtttgccatatttccttttgagcaaagactggtgttaataatgcctagaattttgagtgctattcatttatattattggaaacctttaaaaagacttacaaaagcattaattcttcccatgatgctcattagttactcccattaatataaatgatggctcccaggttcatgatgtggagagtctagtgatgaaatactagaagtattaactgtagctagttatgggaatttactgttgtaaattaattaaacacaccaataagcaacggaaactttttattattttaatttgtataaatataaggttggtaagctaatgagaagtggcaggtctcttggagttgattgacacctatacttaaactcttttaaatgtgtagatgacgaatttattgagacaacttctgttgtaagatgttccatacagcgaatatttatttttgagtgtgtagtacacaattttgtcatttccagctttaaaaacttagttactaggagaaaaactttttagaagccacctcctaatattgaatttgctgagtcatgttctgtgtgagagatataagaattttgtattatattctggtttctgtattggtggtttctgtataaatcacaaaatgggaggttcatagttgcttagaaggaatttggtaaatagcatgttatttcactcagcaatttctatgagaaaatgatagatagtattcctttctaagatgatgcagtttggtttaaagaaatttccttttctatttttgtattattttaattggaaactgccctgttttgtagtatgcaatttggaatagacacttaactcagttttgtattattaaatactaattcaaaatcaagagtcacagtctcagaatgataaatatacaaatgaacctgttcacctattcatgcattcattaaatgtttaattagtacatagtatgtgacaggtattgttctattgataggtctttgtgatttagtaaagaacagtaacaacaattaaaaatgttctgtctttaaaagaaatggacagtttaaagtaaattctgtaaatactgctgaatatctaccatatgaatatacttcatgccatatatttttatgaaacagactaagaaagtgagcatactatcagcttattatctagtttcagagataacaaaaatcgccttgtttcatgccttttatttaataacactcctttctttacctggcatgcccttgtctcatgagtaaatacattgcaagattcattaggtatccctaggggtagaaagaagtacaatctgattttaagcaaaaataaggttggttcataggtggtttgggacctgtctcaagtgtcaatttgtcattaagagtaaaggctcgataattgactggaaagagctttttaaagtttcaggatcaacttaaaatttactttgctcagaatatctatttaatgtttagttctcactcctgcaaaaatatactaaatcaggatctagttgtttgacaaaactgaagcaaaggaacagtgagtagtgtttatcctctcaactagccaatgaaatgaaaggttaaaacgttaaattaggctgggcacggcagctcatgcctgtaatctgaacactttgggaggccaaggctggaggatcacttgagcccaggagtttgagacttcagcctaggcaacatactgaaaccccatccctaaaaaaatagaaagattaaccaagtgtgatggcacccagctactgaggaggctgaagtgggaggatcacttgagcccaggaggtcaaggctgcagtgagccatgatcctgccactacccgacttcaacttgtgcaatagagtgagaccctgtctcaaaaaaaaagaaaattaaattagaaataccatgcatgattcattgtcatgagtttcaaatgtggatgtgcataaaagaagttatgggacatggaaaatgattgagaggtgtcaacatatatctaaggggaattctaggaataaagattagaagacatggcaagaaagaaatattcaaaacatggtggctgagttaaaaaaaaaaacacagacaatattaagaacaaaaaaaggagacacatgtgccacacagattgaaaactcataagaacatactgtgaacagtttttaaaaggtaggtggaatagtcttttttagaaaaaaatataaaataacaaaattgatccaaaaagaaatgggaaaactgaataggagctgcttccagagtatagtagcatagatatcttgaccaacactgaaactgcttgagaaaaacaaattctttaattatatttattagttcacaagaaaataaagaatacttaggtcaaaaactgagtaaaggcaagaacctaaagaaataaggtgaacactgaagccagctttttccttgaaggcatttaataaactgaataagtgtgaatttgataaaacaacctgaacaggacaatagaagaaaacaaaagttatagacaaatatctttcatactaagttgccacttttgtatgaaagacatacaaaacaaaacatatgcaagctgaatctggcaattcaggaatgagtcaatggctcagcatttaaaaagctttccacataactcacccattaacagattaagaaaaatatcatatcatttcaatagatacaaaaaaagcattcaataaaattagatacttatttagaaaggcaatatacgttttgattaggaacatacattctcagcagggcgcagtggctcacgcctgtaatcccagcactttgggaggttgcagcgggcagattgcttgatcccaggagttagagaccagcctgggcaacatttcaagactttgtctttacaaaaaaaaaaaaaaaaaaaaaaaatcagctgggcgtggtggcatacctgtaagtcccagctactcaagaggctgaggtgggagaatcacttgagcctgggaggttgagactgcagtgagctgtgttcacaccactacactccagactgggtgaaagagcaagaccctgtcgcaaggaaaggggtggtgggggcgggtacttaaattctggaaccagataatgagagtttgaatccagactgttatttagtgtaaatggtaggcagaatttgaaacagcactcaagattcccattatcctggtgtacatgtccgtataaatgtcttccccttcagtgtgggcaagacttgtgaatatatagtcggccctctcaatctgcagattcaaccagccacggatagaaaatatttagacaaaaacaaacaaaaggtaacaatacaaaaattttaaaaatacagattttttttttattttcaaagtatttaggaattctttaattagaaaattaaaggcaatgggattatctattggttctagaagtacccatgaattaaatcacttacatctcccacttaaaaaacaaaacaaaaccttaaatcacattgctgttaagctttcatacagtaagaaataagaccaagctatgctggagtacaaaaacctgaaattgtgagcatgaaaataatttattgattagacatcttgcttactcaagcattaggtctactggagatagaattaacacagttcatgaaaatggaaaaaaattccattcagcacctgcttcctttcaaatttcctggggacatggtttatgcaaaaaaaaaatacaaattgcaaaaaaaatacaaatttaaaaacaacagacataactatttacatagcatttgcattgtattaggtattataagtaatttagagataatttgaagtatacaggacttatgtacataagttatatttgtaggttatattaaaatacaaattttatatcaggggcttgagcttacttggattttggcatccacaagggtcctggaatcaatcctccacagatactgagagatgaatgtaatagaattttcctcccatgattaaggttcccaaccatttgactttgagttaatttaaagcaaaattatctgtgtaggcttggcctaatcaagtgaacccttgagagccaagaagcagtagcagatgctcttctgctagcccacaagaaagcaaacagaactcctcatggagggagccatgtggctaggacctgagggtggctcctaagaactgggagtgaaatatggctgacagctagcaaggaactagctcagccctaccaccacaaggaactcaattctgccaacaacctgaatgagcttggaagatgaccctgagctacacatgagaagcctggccaacaccttgattttagatttcttagatcctgagcagagaactcatttatactgtgcctagagttctgacctacagaaaccatgagatagtaaatgagtgttttaagctgctaagcttgttttattttttaaagcagtcatagaaaactaatatattgtgtgactttggacaagttacttgatcaccctatgtgccttactgtcattgttaaatggagagataacagcacccacttcatagggtatctaggtggattaaatgagtgaatacatggaaaatatatgtggtacttggtaaagcatcaaatgttggccaataatagtagtagtggttgttataagaactcattgtaaagtagaaaatgaaaggaatttccttaaaatgccaaaagatgattatcacaaacctatagcaagcattagacttaatagtgaaactttgtaaggactccactaaaatcagaaggcacataaggatgccagttgtctttacaataaaatattgtatttgtggccctggccaatagaattatatgagaaaaagaaatgaagtttacatatttgaaaaaagggaaaaaaagcttacaaactgaaaatgaatacaatacaagcacctagcaatatggttaataaaaagggtgaggccaggcgcagtggctcacacctgtaatcccagcactttgggaggctgagtcaggtggatcacctaaggttgggagtttgagaccagcctggccagcatggcgaaaccctgtctctactaaaaacacaaaaattagccggatgtgggggtgggcacctgtagtcccagctacttgggaggctgaggcaggaggatcgcttgaacccaggaggcggaggttgcagtgagccaagattgtgccactgcactccagcctgggcaatgagagcaaaactctgcctcaaaattttaaaaaataaataaaaagggtgaaagacctttatcaaagaaaaatataaaacattataaaaatgatagtgaaaaacacaaaagttctgaataaatggatgcacacacatatatacataccttgtttagctatgccttatgcttctctgatttggcataatactatttgtatatatatttttaagttgtttttgaatttgaaataattcattgcagtatattgtaaatctttttttccctgggcattatcaagtgttctctgcctatagccaagtagaagaactttgacccataaagactaactaaagtatgcaaataacagcactagatctgcagcaaagaagtagaagaagcggccgggcatggtggatcacgaggtcaggagatcgagaccatcctggctaacacagtgaaaccccgtctctactaaaaatacaaaaaattagccgggcatggtggcgggcgcctgtagtcccagctacttgggaggctaagccaggagaatggtgtgaacctgggaggtggagcttgcagtgagccgagatcacaccactgcactcagcctgggcgacagtgtgatactccatctcaaaaaaaaaaaaaaaggaaagaaagaaatagaagatgcacaacacactggatttttggttttttgtttgtttgtttgttttgttttgttttttggttggggcggggacggagttttgctctgttgccaggctggagtgcagtggcgcggtctcgactcactgcaacctctgcctcctgggatcaagcaattctcgtgcctcagcctcccgagtagctgggattacaggcacgcgcaaccacacccggcttaatttttgtatttttagtagagacgaggtttcaccatgttggccaggatggtctcgatcttctgactttgtgatccgcctgccttggcctcccaaggtgctgggattacaggtgtgagccaccgggcctggccaacacactggattttaaaatgcaagtgttaagtggaaatagaaaacacggtaacaatcagcagacaaggagggtttggttgaagttacttgacaataagaagaatatcatgcacattactgcaaccctagaaagactgattaacaattatatgaaagtatatcagaaatgagtttgtgagtgaaaattttagcacataaatagcaaaaaaagaaaaaaaattccaatgcaagaacccttagggaaaatggttaaaagacaaaccactcaattaaaaaattatcaaagggtattgtatcaatcatgtttcagtcagaaaagcagaattagtgtgaatattatggtctgatggatttattgggacaagatcgtacgcaattgtggaagaagctacagaaataagagtgcaaaagcagggcttggagatcagagaaaagtcactaccccagcccttctgaagctctggtgcaggtagacaactcaggcaaagaagtaggaagtgaggtatatccagctgctgcgtggaaccccagaggagagcaggtggagacatctatggaaggctgttgccactgcatctgatagtgggaagggagttggtattggtcagcagggccagcagctgggaagaagagctagatgcagaatggaagcacagacaccaaatggaatctgcaagcagccttgcatctgtggattactgtgtctaacaccatgccctgccaccatgccagtgtagtggctgctgccatggccagttattatctttggaagacaatgaagtgaattctatcttccaaatcttacccaaatttatcttttgttcatctgtaacctggatccatataggcagtcgtcttctggtaaatacttccagcttagccaggttgacacagttaaaaaattacagtggatataaacaggccttatattatattctagtaatacaaagattaatagcaataatagtaatcactcagaaaattatagttgctcttgcgatctttcaggtactgttctacacgtgaattgtcacaaaagcagtatgagattaatgatattattatctacattatattcacaaattgtgtcacagagagttcaagaaaaaatacttccaagactacatgttgttctctagggttagcagtaccaacaatttgtcagaatctagtaaaacggtttcgagtacatactgtttagaagtttgtcccctagagaaacttgctcaaaggagggcatataaagatgtttagtacatcattacttgtactggtgaaaaaattagaaacaacctaaatcccctttagtaagggagtggagaaataaaatattgaacatccataagatggaatactaatcaggagttcaaaggaatattttagatacacacacagacaaaaatagctttcagaaaacactatggagtgaaaaaaagtaagttgcagaatggtacgtatggttcattgtttttcatagaaacacttgtattttaaaagtataaaaagcagtaaacacagatattaaccaaattataaaaggagtggcttgtggagagaagatatgacaggtgctgttggttacctaaccatggtcattcctgtttctcaagaggtccctattgttagtaattaactctcttcttgggtatgtggaaagtgggttccagtctcagtgccagggagtgaactacaattggctttttactaatcatgtgatcccactgcactcaacagtgatggatttaggagttgattcacaattctggccagttctatggggtactgctgggaatagttttatgcactaagacagacacgtggctgtgatgctggtaatattcaatttcttggtctgggtgctggtttcataaaagtattaattctgtgaacattaagggagtttgcccttacctatctgtatgttatacattaataaaaagtttatatattaaaaaagacacacaggagaaaagtctgccattttctactagatgtctctacagatgagagctgattgtgtaccaaccatcctgtgatcatgaatgggccttgcccaattttctaaggatggcagagtggaaagatgggaagacctgggtcccaattaatgtaataaagtttctgagttagccatttctttttcttctttgaatcagtgatttggtttttctgtcacttgaggttaaaatgatcctaactaatggaggaagggggagtccctgaattggtaaacaaagaaggctcacttgatctgtaatgttttatttattttaactaaaaaataatatctgttgtcaactctgcgtagtgagtatgtaggtcattattctctaattttaaaatgaagtgggtagtattatttaaactgttctttaattttttttaaaaaaaggaagaaaaagtatcagatgagttgttgctcatcaggaacaaaaatgagggagtgattattttaagttgaggggcaactgggaaataatatttctcagcaaatgaatcaaaagccaatttgtttatattcatttaataaatacttagtgggcttttactgtgtataagctactgtgacattctgtttggacctatatttgaaatcactaggtttttgtaaagaacatcttgatatattggtatgtgtcttcaataggaagttatatgttctagaggacacccatatgtctgggttaaagtctgtattttaaattagagtgtctctagtagtatattcaaatttggcaaaaaacttatgtaagtatttttgtatgatacagaaacatatgtttccatcatttagctaagtaaaattcataaaacaaattattcttatgtctagtagaagtgtacatagaattctgactcccaagtttgtattatttcttgagatagtaaccatgctcaaccctcaaattatgacatacatatgtatgtgttccaagatacaataatttaaagaaagtctttggttaaaaatacacactgtggtgtaagacctgagttagaatccagctctttgtcaccttaaccctgggcaagttacttctctaagcttcagtatggggaatagtgtcattgtggagtttgtatgtaatggaaacctcaaattaacaatgacttaaataaaattttattttcaggcataaaaatccagggatcagtaatccagggctggagtggcagttccgtaaatgcttcaggaaatgcaggctgcttcaaggtctctgctctgccatccctggattgtggccctcatggtccaagatggttgttggaatgtcagtcattatgtagccaacaggaagtgggcattcctccctcctctaaggactcctctaaggacctctgtaggaggttgagaaatgtcttttttctaagtggcttttaaacttcaggggttctgttaacaacagaagaagagaatgggcattggggcacaatcagcagtctctgtcacagggttgttttaagaattaaccagtacatataaagcccagcacacagagcctgacatggaaacaaaggctgctattttaatcactagtagtaaatgtcaaacttctgactgaacaaatgtgcttatcttttctcaccaaaatgccaatgaaataacagtatacggattaaaatttaaaaagcaggccaggcgccgcggctcacggctgtaatcccagcactttgggaggctgaggcgggcagattgcctgagctcaggagtttgaaaccagcttgggcaacacagtgaaaccctgtctctactaaaatatcaaaaacattagccgggcatggcagcatgtgcctgtagtcccagctactcgggaggctgaggcaggagaattgcttgaacctgggagacggaggctgtagtgagccgagattgtgctactgcactccagcctaggctacggagcgagactccatctcctaaaaaaaagaaaaaagaaagaaaaaaaattttaaaaagcataagtaaggaacaggagaggcaacctccagagcagagaaactgtgaaatcaacaaaattgtgagaactgaacagcaggtgaaagtagcaattgacgtagcagactggaaaaatgaaaatctaagagctcgcaagggggaaggttaagaagcaagctgattcatgctgcagaagtccagaaagtctcagaattggaggccaggagtctttgaaggtgagtcgggtatgtctggaagtctgtattagaagccagtataccctgacaacctctctcaggcaactacctttcacttcaccagcagaaaacctgatgtttactctagagaggtcgaactagactaatgctggattcagagacagctagcataactgagggcagaggtgccagctgaaaaaaggaattgattgtacatataagaacgtggaaaactgatccaagagaagatacatacagcttcttagagttgtacatctccatatgaaatttccagttctctgctaataaccccagagtgaaacctgccttttggccagttctgtcaatgcacatctttcaatatgtgtgctctttagtgccttgcttttaaaaatgattaaccaaagaattaccagacatttgaggaaacttgagaagccaaaatcatgaaaaagaaatgtggaggaaagaaagaatatagggataaataaaaatcaatagtttgttgggattttttttaggagactttaaataatatcctcagagagacaagggaaagtactatgtccaagaacaaaaacaagatgatataaaaatgaacatttagaaaagatgaagcgtggcaaattaaaatgaaggaagtgttttaaaaattcaacagaatgctggaggtaaagttgtttttctcttaaaaaaaaaaaaaaagccggagatcaaagataagaaagaaaagataagaaattagaggatttcctcaaatatttgatgatccaacaatccagatagcagtgagtacaaaaaagaaacagaaaagggaaggtaggaagttatccaacaaataataatgcaagaaaattctaataattaaaatacttgatttcaaatggaaagagtcgagcccagtgagtgcctagcacaataacattttaaaagcccacactaaggtacatcactgtgaaattatggaattctagaggtaaagtgaagattctaaaagcttgcagagaaaaaaaaatacatacaaaggaataggagtcataatatccgactcctcaaaggcagcactgaaagttagaaagcaatggaacaatccttcaaagtactgagggaaaattatttctataacctatatttaaatcaagctatcagtcaaataaaagggtagaaaaaagacttttcaggcatgaaagtcctatgcacctttcctaggaaacttctggaagatgtgctctattaatataaaggaataaaccaagtaagaagaaaacattattcatggaaaaggagggatctcagggtgaagggaaaccatagatgatcagcccccgcactggccaatggagcaagagatcgaaggcaccaagaaagagtgaaactgaaagaggatttaaccatagcaagagggaattttcattgcttccaggggttctgggaataaattagtgagaggtacgtaaatttagcaaatgaaaaaactaggttgttattaactccagggaaaaccaagtttaaaagaattaaaatatgatacattatatggctctgctcaaaaaaataacatggttataatactgtaatgttgcatactgatttaaccaaaaattatgatgttgaccctagtgaatggattggaggaaggggaagtgtaggtattttggaagaggtggggaagcagtgtgtaagagagctatatcctcatcttccccagtatattgtcagtagatcatttttaaagccatagggtcgagaaacaggaataaaaggatattaattagaaacatagagggaaaataccagggggaaaaagcagcctaaagtgatgagaataataagcttggaggtctaggaatggagataaagctctagggtattttaactaataaacatgtaaactaatgtttttagtatcaggcttgtagaacattttgttttttcaaccatgtatatgttttattttgataaaaaaacattgatttttaagtgtgcttttggtggcttcatttgtacaaagtctttgcaaactaacaatacaattcagtgaacatttattcaatacctgctctgttagaccattgtacaagagacagacatgtaaacatatgattgtaaaacaaagcctaatgtgattacctgctcccaaatgatgaataaatactgatatctcatagaagcacctcacttcttttgggactaggggaaggcttcagagaggatagaacatttgcactgggccctgaagggtgggagcaatctgaagaggaggttcagtgccagctgtggccagtgttgtccaatcccaccatcactggaaaaggagatgtgtttaggaaagaagtctggtggagctgtgggaggctgttttgacttctctgcctctcctagacatttatattagtcatttcttcctgaggattttctcctccctgccctatcacccagacacccttaattttagtattgactttaccatgctgagttatattgtggttctctccccactggcaccctgcctcttaaacttttggtctaatttagagaaggacaagggaagggaaaagaaaatattggtttcacctggccagatgtagattcccgaatataaagataggaactctctttcctaacctcataggctactaggtatagctgttatcttttttgaggcactaagattaaactgtcattttcacagtttgaacgtaatttttagaaccctcaagagtaatataggacacatctaattttttcaaagaagtataattgtttcacaactataaaatatttctctgtgaagatgcttttcagaagtaactgggcaagtcattatggtgtgtgtacatgtgtaacatcctccaactttagaattttgtgccctggatttgttttcttttatattgttgggtccaaaagaggaaaggctggcttagaactaaatagcagaactaaaccatatgttttataccaaattagaaacaggtgaaggttgttaaaatccagcaagcacttagaaaagcttgagacacaagtttgtattaaaggcaggtggttatatgtacaataaaaaacagtcaccagcacactggctgattgatacatatgtgattgatctttttggataaaaacaaggaggagttaataaatcactgcacatagctataaagatgtttgggcttgaaagcctagcctgtaagagcaaatgtgggccctgaaggaaatttatgaagcctagatccttttagctttacttaacagctaacatctgactgacccagggggaccatggaaatttattgctgggccattcaaatatttaagctgttgtgtgatgcagaacaggtaaagattagcccaataacaaatatgaggctataaaataaaatgagatttcgatgacttgtaagtacttgtcagaggtcagctccaaatgactggtcagaaatggtaaaaacttgttgataattaaaggggattgactatgacaacctagatgtttgcattggttgctgtcagatcagtgatccttggaatttccttctcctttgaagtccatgcttaacaaaatgacttaggggcctctaaattgtctttttgtgctctgaaattgggcaagatgatgaattgaggtgattccttttgcaattttatcattgaaatatgtctttctcaaatacattctgaatataatgcaattcctagacagcatattcactttagaaaactgactttagctaacttatgtgtgtaattttgagcattgacatccagaaagcaggtaaagtttttaggctttttatgatagatgatctaaaatcagcctttaaaacttaagtagtttaacagatttatgcacaccattattgaaaagttgatttagtggaattaagtggatgtaaggaacatggctgtgctgcagccaagcaggcatagggcagcaggcataagccgaggtaaacagcccacatgactcagcgggattggggcgcaagcgcacagtatcatatcttatataatcatagccatgtagacacagcatagagaagctccccacctggctctcagccgctattgtttgtgtagtgtataaatgtaacactaaccctgtgaaggggctgctgaataaagccatgtctcatctacctgctgtctcttgagtgttcttccagctccctgccccacatccacccactccgctcagccctcagctggggctggaatctgaccctgagcatgacagtggatttttcaaaaactttccaaatattctacccacatttatttaagccccaaaagcaataatgtatataatattgttaataggactatggaagttacatgaatgagatctacagttattggtattgacaatctttgcctttttgactttaaacataaaatgtagatttgatggttttcagagtgccagcttatcaaatcacttggtaaatttggcagtgatttggcatatgaacatctgatttgtggggagaagaaatcccttagtttttaatagaaatcttgtatgaaatgaaatttacaaataatacagctttacaaaatggggttattacttgatggagagcatggaatagaataaaaagcagaggcttagaagtcagacaggcatgggttggaagtagctccgccacttctacttcacccatacattcacccctccctccattccacaaataaatgtgttccagatgcagggctcttggaactgggatacagcatcagtaaggacttcggctcatagttcacattcctttggaagattcaaggaataaacaagcaactacaatacagtgtcaaaggtaccctgttagggattgtacagggttcgtgaagacacatggggagaaataactgattcaaacttggggcaggggtgaagtgaattggagatgggtggctgttgtggagtgttaggaaacgctatgtgaccatgggcactaaattaatagtgcctgcaggacaattgctaggattgtatagataaagtataataagtacaatacctgctgcataataatattccataaatgcaatccagcatcaacatcattgttattgctgtcatcttatcagtactcactggcgtttgctctaatagtagacggctctacctgctgttaatctgtggcaaacaccattctgtaatttaggatcttctctcaaccaaataatttttcttttgagcagaactcaaagcactttctaaaaataagagttggttgtctaggtatattaaaaccaagaaagaaagagtaataagaacatacctgaatcttgaaatcttccgtattgattcctgtgttttgttttttaattcacagaactatatgttacttagttctccttcagtatttacttaatatattcatttgtttaatcattcatttgcagatatttgttgaatacccactttcaataagaatctgagcttaacacccatgtcctcaaggaaattgcgttttaattcaggaagtaagacatttgtataaacagacatttgtataaaatattgagtagaaagtgccaggtgcataagaatactttttgatttcagaaggcaacaaaatgaataaaatatgctgtctctcttgagacacttacagataggagtggaggaaaagaaaagggaaatcaagcataccgttaagaaaggtaataataataattgaatgcctgctgtatcctactaactgtgctgggtcatagattttttttaaatgcattttgttatgtagatttgaggttgagtcatagattttcttgtttaattttcacagcaatccttaaagattgctattattaaacctattttagagttttggaaacaatttcagagtagcatgttctagttcataccacaagtgaataacaaagttctgtccctctgacttcaaagccttaacttattgtacctaaatagcccttttgcctttctcctcttctcatctcaaaataggtatcagcacaaaaattaaataaacaatttttatataaaggattgagtacctgttatcagcactgtataaggaagcaatttatagacaatatagaattaggtgtcctgatacgtttaagcaaatcaatattatatgcacacattgtgaagtgttgtctttagatatttcaagtggtgaataggttttcttccaaatttatgttccagatggaaaatatcttctggcattaccaagtatttatgcaccttgcatgcttaattgtggatttggtgtttttttttttcttaacatttacagatttttgtgggaaacaggtgctgttaaatccaggcaaatgcaggatggctgttaatgttgtggaatgtgattttgatttgcttggcagaatttttatttaacaaaattgactattaaaaaaagacatggtttccatcctttaattttactctgttcactgaaatttgcctgtggactgtttttcaacagttacaaaaagggtgtggaaaaactggaaggtttctataaggaaattgatattgagttctttaacaatttccacagccctgcaacttacaagtaaaaaaaaggaggggggattatttttaaccttcttactaaaattacctggaattcaatttccctgaaattccattctttttttagtatagctctgtctaaaatattgtatataatattggcaaagagaatgttctggtgtaaatcttctcattacatgatttctcctttaaaaactttggggtgatattttatttcctgttatatcaaatttaacctcttttggttggcacatacgtctcatattttctcttttttcttcccccaaagaaggaggaaaaaacaatcactcctctttttgttcttccatgaggacttttaggatagagatcagcccatggtctggcgtggtgtgtgtagagggccctacctaatctgtcacataccttcctatgcaacttcaaagtcgtcccttgccattcctccttcagtccagttctgttggccttcttgccaatccttgaagcagcatgtctcctccttccacagggcctttacacaagctgcttcctctaaccagaacatttcttcctttagcacctacccatctcatttattaggctgattatatgagcactatctgtctaacccactggactttaacctcatgtttgtgtttgcccagccttatatccctaccacctaacaccatacctggcacatagtatgagttctttgaaaacttgttgaatgaataaacagcatccacagtggtcattttccttcatccccccggttatgatgaaagagttgcccttgtctcacctgctgtctaaggcagacccttctgtactctcacctgtgtggtaaggaagctatcctctttcacctcaggacatgtttcctgctgtgcctcaccacatccctgcagctgctgagctcccctctctctatgccaggcttcccaccagcttcatttccttacctctagccactgctgaactcataccagtcggccttcatcccctgctacttcagttaaactttcatttaccatattatcagcgctacctaccagtgaacccacagagtcaatccagtagacgtttaattttgagattcgcttgacctgtctgcagcacttaactgttgatagcgtccttcttacattagcagtttgtctgagcttttctggtgagatacttcttggttttcctcatatcttttaaccagtccttttctggctccttctccccatccttcgttcatattctcaaggctctgaagtggttctcttgtataccatttctttaggccatctcattcatacctatggctttggtttccatctaaaatgtttataattccctattcgatattttcggcccaaattttgtcacctcatttcatttatatataataaatatactttgtttatattatagagtatctatatactatagagtatataggtataaatatatatagtttataagtgtattatatttatatataataaatatatagccaggcactgtggctcacgcctgtaatcccagcactttgggaggccaaagtgggtgaatcaccgaaggtcaggagttcaagaccagcctggccaacatggcgaaaccccatctctactaaaaatacaaaaattagctgggtatggtggtgtacacctgtaatcccagctactcaggaggctgaggcaggagaattgccccaacccaggaggcagaggttgcagtgagcccagatcataccactgcactccagcctgggcaacagagtgagactctgtctcaaaacacacacacacacacacacacacacacacacacaaaaataaatatgcacctgctccttctcccgtgtttcccatcacaattcacagataccgccatctgcctcgtttctcaattgagaaacgaaagggtcatctttgactcctcccctctttaccattttgtaacaatcaatccatcacaaaattctttcagttcttcccacatatctattcacatatcttcctctctacttctggaaccctaaccaaaactgttatttctggcctggattttgcaataacctcctatccaggtcctgttcacctttatttaccacactgtagccagtctggtctttaaaaaacataaacacccatgctttaaaaagttattatcctcccagctgggcacggtggctcacacctgtaatcccagaactttgggaggccaaagcaggcggatcatgaggtcaggagatcgagaccagcctggccaacatggtgaaaccccgtttctactaaaatacaaaaaattagccacacatggtggcatgcgcctgtaatccctgctactcgggaggctgaggcaggggaatcatttgaacctgggaagcggaggttgcagtgagccgagattgcgccactgcactccagcctggtgacagagcaagactccatctcaaaaaaaaaaaaaaaaaagttattatcctctcattttccttaaggatacagtataggtttggttttcttgtggtttataaacccttgcatagtctggtacctgctgatcttagcagcctaatcttacggcacttcacccctcacactctttttttaaccctagctcctagctgtttaatttcacccgtaattttataaaaagatggcaattccattctgtcagttgcttaggtccaaaactttgaagtcatccttgactcctcttcctctcacacctcatagaagatctgtcaccagatcatgttggctctgtcttcaaaatgagagaatccaaccacttctcaccacctccacagccaccatcttggttcaaaccgctgtcttctcttgcctaaatttttgcagtagcctccccttgtttcttttcttgctcccctgcagtttatcctcacagagcagccattaaaccctccagtgcttctcctgtcattcagagtaaaaactgaagtccttgctgtgacctccaggaccctgcatgatgtaaaccgattcctttgctgacctcatctcctggtcctttttcccttactctgctccaggcactctggtctgccttcacttccttgaatgtgactataccaggcattcctgtctcaaggcctttgcacttttcgtttcacctgcctggaacactcttccccagatagcttcaagactttctctcacttccttcaggtttttgttcaaatgtaatcttctcagtgaacctcctcttatttgtcatgtctctctcactgaagtgtaagcttcatgaagacaggaactttttttgtcattttgttcactgtgttagcacctagaagagtgcctatcacaaggtgatgatgcagtaactattgctaaacaagtgaatgaagaatagtatttgctttatttgtccagtgctcattagagtctttggtataaagtaagtaaatcatttattgattgaatcagttcttttactctaatttcaaatgctcttacgtcttctctctttcaaatttctgacctttactttcttcaaaactagttttaaattttccacctataggaagctgcctacgattaatcctgtcactcagactggagtgcagtggtgtgatctcagctcactgcaaccttcatctcctgggctcaagtgatcctcccacctcagcctcccaagtagctgggattacaggcatacaccatcatgcctggctaatttttgtatttttagtagagacaggattttgccatactacccaagctggtctcaaactcctgggctcaaaggatccacctgccttggtcccccaaagtgctgagattataggcatgagccaccgcaccagcctgtttttctcttattatttactattagctaaaccttttgtttgtttatttatgttgtatcccaagattttattatgaaaatttctaaacatacagaaaagttgaaagaatcttgtagtgaacacccatacacccaccacctagattctgcggttacatttgctgtacctgtgttattgtatctttccatttatctatctgtttatctattatatcaacctatttatttccgtgaatcttaaagtaagtttcagatatcagtagacttcccctcaatgcttcatcatgcatatgattaaccagagctcagtatttgtttatggttcttttttcttttgaggtaaaatttatatgtaatgaaatatacaaaccttttttttttgagacggagtctcactctgtcacccaggctggagtccagtggcaggatctcggctcactgcaagctccgcctcccaggttcatgctattcccctgcctcagcctcctgagtagctgggactacaggtgcccgccaccacacctggctaattttttgtatttttagtagagatggggtttcactgtgttagccaggatggtctcgatctcctgaccttgtgatctgcccacctcggcctcccaaagtgctgggattacaggcgtgagccactgtgcccggccagaaatatacaaatcttaaatgaactattctgagttccatcaaatacataggcatctgtgcagtccagcacgtcaagatacagatcattgactctcccctgaaacttccctctctcttttttctagtgaatcactgtctttcccagtcccctgcttaaccattgtttaaccgtaagcatgcagtatgaacttctttacataaggcttctttcacttggcatattattgtaggttctttcatcctcaacacttaggtggttttcagtttttggctattgtgagtaaagttgctgtgaacatttttgtacatggtatttttgtgggcaaatgttttcatatttcttgggtaaatacgcaggaacagaattgctacatcataggataagtgtatgtttagttttataagtaactgccagacctttttccgtagagcgtaatgtacattttatactcccactcaacaatatataagagttctggttgctccacatcttaagtctcttttaatctgaaggttctctccttctttatttttccttgcatttttttccttgttgtataagttaaacttactctgcagatccctgtaaagttcctcacattttgaattttgctgatggtattaacatgtttatctttcccctgtgttacctataaactggagataaaaacttagttgatcatattcagttttcttggcaagaatacttcataggtgttactgatgctcccttttatatcacatttggaagcatattatgtctagttatcttttttgtgtgtgtaatgttaaaattgattagtacccctggccactcttagtctaatctgccctcagtaatctttctgaggaaggattttagattgagtgacctgcagtggtctctctaagggtgattctgatcaaaggctagaatgacaggaaagtgtcagctctgggaagatttaaggagcaaacacttaaaaaacagagaatagcaagttcaaaagtcccaaagtaggaaacaatcttggcatgttcagggaacagaaggaaaaccagcatgacttgagcatagtgagtgccaaggagaatgacatgaggtagcagtggctttagccacgtaaggccctgtgggctaccctgtgtggtttaaattttatttcaagtgcagtggaaaatcttttgatggttctaagtaggagactgggtgccacaatcagatttgattttttaggatcagttggctatgggaaagagggggaaaatgtccattgttaatcatgcttttcatagattataactttagcccgaaccaatggatatctgttactttctgtgttactttaaattgattatgatgtttaaaatgagatatcacttatgggggaaggttaaatggcccttagtgtaaagttattaatccaaagaagaatggaaacttaaaaaatagatttgaatacagttaaaatattaaatgataaatggaaacagaaatattattttaaaatggcttattttttaaagagtacattttggactggttaataaatgtaactttttaacatggaaacagatgctgaaatattttcagtccccagtgtaaccccccacagccagccatttccatctcacgtgcctatggcctgccttatgctttcacagcattaccatcaacagttaaaacttcagtgacactatacaatgtagcagaaaaatgcaagatgtttttttttttccccctctttagtcttggcagggtaaaacatggtcctttttactctaccaggtgctttactttggccataataatttagtatgggtctatagcttttggtcacttcccttactcgatcatgggggaaaaataggggcagcttgcatgctgctggcattttacattaacatttttttcacaggtttttgttgttgttgttgttattgtcgccctggaggacttgaatgaggctcgtgtggttttttttgttgttgttgttttgttaattgcttctttgaagtgcatgtagccttaacacttatcatagccaaccaagaactggttgctcctgatagtaggtcatcccaccagttatacagactggtattccacaggaggagcccagtaggtattcatgttataatctatcccaatttctgaacccctaagcataccagagttaactcacaatttactatagttgttgtaggggggactttgggaaaataaacattgaaaaacgtcttttaaaatgagttttaggtccgggcatggtcactcatgcctgtaatcttaacactttgggaggctgaagtgggaggattgcttgagcccaggagttcaagaccagcccgggcaacatagtgagaccttgtctctatcctcccgtgcaaaaagttagccaggtgtggtagtgcacacctgcagtcccagctacctgggagactgaggcaggagtattccttgtgcccgggaggtcagaggctgcagtgagtcatgatcatgccactgcactccagcctgggagacagagcaagaccctatctccaaaaaaaaaaaaaaaaaaaattattgtctttggcagataccctgatttaattttggtcacttctttaaatgtgatatagctgtcaaataaagcatgaggcagcaagaacaagaattatgcacatgtgaatgtgaatcatgaaatgtgggaaaattaatgcactaccaccagagcatgagataaatgaatatggaaacaactaccaatcaatctctaggcattaaatgggcaacaggaaggtcaaaggagaatcattgagtcctggagtggtcaagggcaatttaaaaaggaatgtgacaacttgaactagatctcataaaggatggaatagtatttagataggaaagcaagaaagatggacaccttcgagaagtaagtaaaggcagagaaagaaaagtgaacttgatgtgtttgtgacactgtgaggaaacctcttgagcaaaaggtgacagataaattgggcagatgggtcagatcacttaggcctcgaaaggtaggcagaggagttgaaatttaaaacaataactgattatgaagcagggctgagaagtgacatgataagaggtcttacttaaaagaaaataataacttatatttgtgtcatgctttacagttgcagtgtactttctcaatcttgtggtgttgtatcctcacaagatacttgtgaagaaggcaggaaagatgatagtttctccactttacagcttaagaacttagcattaaactagttatgatttacccaagttcatataacaactaagtatgtaatggagctgagactagaaaaactatgtcttttctgttgtaattcagtttttagaaacctactgggcttcctaaaatcaatctgacagtgatatggagaatgaactggcattaaggattctggctaggtagtaagcaaattgataagagcttggaccaatgattctcaactggaggcagtttgaactcctttccccacccacccaggcaacattgggtgatgtctagagacatttttggttatcacagctgggagtcgagtgctattggcttttagtgagtagaggatagagatgctgacctttctaaacatcctgtagtatataggacagcaccccacaacaaagaattatccagagtggcagcaggaatggagaatgttacagaggggaaatgatttgtcagcttggtgaagcactgcatatgtaaaaggcaaatcaggtgggtaaagttgaatgccactctaagtccaagtaattgatagagaaaagtagtaatggcaaactagtctggacaggagaaagtataccgagtttgaggtaaagtcattgcctcagaatatattgagtccatgttgtcacattttctataaatacgaatggcagaagtaatcttaatatgtatgatttaaaaatttgaattaactatagccatgtcctcatccccagttgccatcaaataactaaatctggatgtgaggctctgaaggtgaaggcaagaaactattagcagcttggagtcctttgtagaaatgtctgggttggtggggagagggtagtgtttataacagtgtatcttttataaatatttaaagtttgaaaatcagtttcttttcacagtttttttcaagttgtgtgtgatctatttttcatgtgttgcgtctctgtaggtgtgtatatgatatatatgtgaattagtaaaaaagaaaaatcctgctcagactcagcctgtacataggaatttctttttttggtactttacttaccagatttcagtcggtctactttgcaaccttacctgctacctatcatgatgactctttggcattagagtctcaaatctttcttggttcctgaaggaaaaaatgaaattgaggggtgacagcgtgctgacagccctcactcgctctcagcgcctcttctgcctgggctcccactttggcggcacttgaggagcccttcagcccaccgctgcactgtgggagcccctttctgggctggccaaggccggagccggctccttcagcttgcagggaggtgtggagggagaggcgcgagcgggaaccagggctgcagcacggcgcttgcgggccagctggagttccgggtgggcgtgggtttggcggccccgcactcggagtggccggccggccctgctggccccaggcagtgaggggcttagcacccgggccagtggctgccgagggtgtgctgggtcccccagcagtgccagcacaccggcgctgcactcgatttctcgccaggcctcagctgcctccccgtggggcagggcttgggacctgcagcccgccatgcctgagcctccccctcctccgtggggatcctgtgtggcccaagcctccccgacgagcactgtcccctgctccatggcgcccagtgccatcgaacacccaagggctgaggagtgcgggcgcatggcgcgggactggcaggcagctccacctgcggccctggtgcgggatctactgggtgaagccagctgggctcctgagtctggtggggacttggagaacctttatgtctagctaagggattgtaaatacaccagtcggcactctgtatctagctcaaggtttgtaaacacaccaatcagcaccctgtgtctagctcagggtttgtgaatgcaccagtccacactctgtatctagctactctggtggggacttggagaacctttgtgttgacactctgtatctagctcatctagtggggaggtggagaacctttgtgtctagctcagggattgtaaacgcgccaatcagcgccctgtcaaagcagaccactcggctctctgtaaaatgaaccaatcagcaggatgtgggtggggccagataagagaataaatgcaggctgcaggcaccagcagtggcaacccgctggggtccccttccactctgtggaagctttgttgtttcgttctttgcaataaatcttgctgctgctcgctctttgggtccacactgtgtttatgagctgtaacactcaccgcgaaggtctgcagcttcactcctgaagccagcgagaccacgaacccaccgggaggaacgaacaactccagacgcgccaccttaagagctgtaacactcactgcggaggtcccagcttcacacctgagccagcgagaccacgaaccccaccagaaggaagaaactcccaacacatccgaacatcagaaggaacaaactccggacacaccgccattaagaactgtaacactcaccgcgagggtccgcagcttcattcttgaagttagtgagaccaagaacccaccaattccggactcaaaattatattcagtatgtttagtttcacatattgagaattataacatcttggagttggaggagatactatacctcattgagtccagtggatcatccagtatttgattcctcctgtgttagtctctcaagctactgtaaattaccagaaacttgatgagataaacagcagaaatttgcctcacacagttctggaggccagaagtccaaaatcaaagtgtcatcagggccacactcctttctttatcctttccagcttctggtggctccaggcattgcccggcttgtggctgcataactaagctctgcctccatctgcacacaacctcttttccctttgtctcacctctgtgtttccttattacgatacttactagattgagggcccacctgaataataaaaaatgatctcaactcaagatccttaactattttagatcttttcatcaaataagttaacttaggtcccaaggattagaatatggacatatctttttggaggccgccgtgtaacccgctacatccactgaatacatgtgcattgtttgtgtttgtcgcccttctctacttggctgcctgtaaccaagatctttaggattttgaataactctgtagtgaaatcaatctcctgtaacgcatataccattcactttggttctccctgcttgaagccatgcagaaaaaaacgaattctttttctctctgaaagtccttcatttgttgtccctgagactgctatcctccaggacaaacacctctggttccttcaacaatttctctcaatactgacttctgttcccctaatcatcctgggtttgcttctctaaagcattcagaggcagtagagagaatactggatttattattgaagacctaatactgaagccatgtctcttccacttcctacttaggtgaccaagccaaatcagtttattttaaataacaataatactgactacttcattgtttcactgcatgctttatatagttaaatgagattgttataaacgttctctagaaacataacctttaagtaaggatatgagtgttcttctgtctatttataaaatactttcactcccagaactgaacataggtctctcggtacagtctaacctagtacaaagtagttatcactatcacgttccccagctgagctgctctgcttctgttaccgcagcctgggatcgcattagcttttttggtagtcatcgcataattcttaactcatattgaaactgttctgtactaaagagttccaaatatttttcacaaataatcttttttaaaaaaaattcaacaaatatttattgcgttctgctagtagcagtgcgtagagacttgacagagaggcaaagaggaagaaaataaaatttctgccctcttggagcctacagtatcataagggagacacacatgaaccaagtaatcacacagtgagtgtaaatttacaatctgagacagactggaaaaagaaagggttgcaaactgacctaagccagtttgatagttcacaatgatacaagtatttacagtagataaaggtgggctctgataattaagattggatttctgcagttctccccactaacctcttcaccacctgttgttagttagagtgacagtaaggctcagatggaattctgtcacacacgtaatctatttattgctttctaattccttgatttttctactatttatagaaagagctacaaggtatggttcaaataaggccatttgaagacagtagagtcggtgaattttcaatgtggaaatttaatttaatttgaaaataatattagccattttaattgaatataataataaattgtattgaatcttcataggaaatatatagttcatcctccagttatttaatgtaatactcctttaatgagtcctctttgtggtgttatggacctgcttctggttgtactttaatgaccacattcttatctaaagcttctatagcttgctaatgtaattctccaatataagatttgtatcttatgttctgacgataataggttttaccctttaaaatgggtatttttcaagattgatagatctataaatacatgtacttttgtaaagtaagatgaatgcatgatagttataagctattatactattcaacttcaagtgacctaagaatttgaaagcaatataaaatgtaaattctgtcctaatattcgatctgtctttgcattgccttatccgaaccataccttgtggctttttgtataaataagtcccactgaagtcataataaagtcaaatgttgtgaaatcaattttttaggaatgttgaagcttggttttcaatgtatgctgatctcaatttactcttctaacatacgaaacagtttctagatttataccttgaaaatagagatagctatgggtttggagagctgttcagatagtctacatttgaagcttatagaataacagctagacagcacagaggtttaggaccgtagtagattttctctaaagtgcccctgttgggtacttgcaaatacgtcgtttctttgcaggctaccccatctgaatttgaatgattcccagacatcttgcaacagcctggtgttacactttgcttatcctgaatttgctatgctgtcatttttatgcatctcaatttgaggccaaaccacatgtcctagtttattttttactgtttcaattaaatatgaagctctgtcttcttgatgggtgtgtgaagcatttggtgttcctttagtagagaataaatacagttcaggaccttgctcagtccccagtgcctataattttatagtgtaacaaatttacctttggatactatatagccagcaactcctgagaatttaatataaagcccttaaattctatttcctttattttattttctctagaaaataatatcctctaggctttatggaatgtatcttttcctcaggcaattaaaagacaattgaaattaagactagtaattgtcacctgccattcatttcaataagattattttattcttgagaataattgtatatcgcagaagtaaggaagatgaagttttcttcttgaccctaagtaataattgatctgtttgtaaagaaatctgtatcagatgctaaaacttttgcttgatcttaagaatcagaaaacaatgactagactataggtatgctctaaacttttcttcatttgcaggtgtaaagaaggggaatagtgaggggagttactctctaaaataactcattatctttatgaagatccagatctcatgcctttgttgctccagtgaggcaggttaaaatggaaattcatgtatgagagccttatggcatgagcacattgccttagagaagttgcatccaaatagccatccctgtaaatgtgaatgaatattttaatgaattttggctcatattggcactgttgatttcactggtcaccttaaaagaaacagaaatcttatatattgcttctaagtctgatttcttttccttcttaatcttcctctcccatttagtagaagttgagatgtcaggtccaagatattagagggaaaaatttctggtatcttaatcttagctaaggtggcaagtttatgatatgtaaataggaaccagtggcctcaactccttggggtgggttggtcactttcttaaacattagttccttgttctgtgacctgttcactttttcttttgaaagaaagcagccgttattctgacttaattaatattatgaagatgtcagtagattgcaatgactatagctaggtgacttagtccaattcagatgtttatgctgtatctaagaaacttcagcctctgttgacaacttggaggttgtatttactcagcttttgaaaatatctgatccttttttacctttcttaggtttccactgtatccaaaaggaggggagaagttgcagtttgattatggtgtctatcttctgaacaaaaatatagcacaggtaagtctctgttcttcacttctctcctacttcccatgcacagcctgtttccttagattgccagccttttttctttataaatatgcactgcagttgaccctcgcatttaaccagttacattagtaatacacagttcttttttttgatcacagtctttttccgtgcccttaaaatgactacagagaagcaatgaatacaaattggaatcctcttgctacttgctaaactcagaatctttttttgtatttttacttgctggtagactatacttcgatgtgtgggcttcatcatctcttgcctctgcagcttgaccaattgtaattttcttagactatttctagggactcaatttgcattgttgtttatggagtaaaagttcagtgcctttgcaagtacttcatggtctcctcactttattattcagggcccgaaggaaaagaccaagcacatgacccttccagtctgtcttagatgtttgtggcactctcaacatcacatcagttagtatgccacttaaataatgtctttccgtatgccgtagtaagactatcagatgcctaggtttgtattttcctgaaagaaatatgtagcatttctttagaacttctggccctacttcaagatgtaggcattccacaagttttctaattataaaggaagactaacttcctttgttttttatttttttttgtttttgtttttgagatggagtcttgctgtgtcacccaggctggagtgcaatggcgcgatctcggctcactgcaacctctacctcccgggttcaagtgattctcttgcctcagcctcccaagtaggtgggattacaggcgcatgccaccacgctcagctaatgttttgtgtttttagtagagacggggtttcaccgtgttaggcagatggtctcgatctgctgacctcgtgatccgcctgcctcagcctcccaaagtgctgggattacaggtgtgagcctttaaaacacccagcctatttatttttataaataacaagtgttttgttttgttttcattggacatccttccaactggaatatcacatggatgagtatccacaatttggcttttatttaaatacattgtgagctatatcctcagaccttttggttttaccaaagtaataagatttacgatgcttttgtttttgttggcctgtgttgccatttatccacatgaacctaacgacttgctaaacattcccttattcatttctgatcagtctagaattattcctctatgtggtgtcatctgccactcttccccttaaccaacctcagtttaatggtggagatttttttaatttgttttttattaagattgttgttctcttctgaaattgggtcagatttctggattgcaatcctcagtttatcatttgcttcatccttcacactcattgtcctctcaaccatactacttttactgttacttccactccagctccaggaaagcagccctctgacagtctctggcccatgactcacctttccatgtgccattcttcccacaactgatgcttgcccattctgcatttttggcagacaagtatttcattcaaagaagcagggctttaattccaagactgccgagctcccactccgctgatcacagttctgtcatgccatggaaaaggcagtgcttaaacagaacttgtcaaaagtgctcagactgaggccaggtgtggtggctcatgcctgtaatcccggtactttgggaggccgagatgggtggatcgcttgtggccaggagttggagaccagcctgggcaacatggcaaaaccccatctctactaaaaaatacaaaaattagccaggtgtggtggcatgcacctgtaatcccagctactggagaggctgaggcatgagaacctcttgaacccgggaggcagaagttgcagtgagctgagatcgtgccagtgcacttccagcctgggtgacagagcaagattctgtctcaaaaaaaaaaaagtgctcggactaagactgcactaaggaagaagtaaattagagggctcctccagcgatgtcagccgtggtggaaagagcatgtagatactacaggatccagtttgagagtaaaactggcatcatttagtagaactaagttctgatttgagttcagaacttctcttcttgccctattttctctttcttgctctaggcacttagatcctaaggtcagaaggctattggaagcttcctggtgaaacttactcctgctgaaatgcctgtatttcctcatatattccagcttcaaacatacacacaatatgcacatgtgtacagatatacacacacatgcacaaacacacttctttcttctcaagggcccaaaaggatggtatgccaaaagatcatataaagtgttgctaagaataccacagcttgctttgggagcaagaccaagatggaggctatgtgcaggggaaaacttagcaaagtcagccctcctcatcagactctcaactctagggcctgtttgatccccacttcccaagaggcctctgactttattattaactgaaccagggccacaagtatgctgacctagttttactcatctgagaaatggattgcttgtagtaattgtgtatcctctccagctttatatatgctctttgaaaattgagagaacaatcaataggttaactactctgaatccatagggagcaagtatcctcctctgtggattttctttttttaatcacactggaggcagttttaaaaggaggggacagtaaacttcttaaaaactggcttttttatatttcaaaatgtattcgggaagccctttaagcagttagaaacttttagaacagttgtgacctttcactttttttgcttcagctctgtctgttctgtctctcgctgtttctcagggaagctttcattttgtctttgaccttactgccatcactttttcacgttttgatttgtaacaaatgaaagaaccattaattgttatggctcctaagcgagcattgtagcaatcaggtatttccagcttttgaaggtttatttttatagacatatagactaatatatgttgtcaaaggggagtttgtcttctcagccagttccatatgtacccatcttttaagatgtgaacaaatcatactattaaaatggcctcacctcagtaatttataagccacattagtggaggtggatgaaagcattggcatgtgttaaagtgccagagaaaaaggagtgaagtcatttaatactgcatccataacttggttgaggatttgaatagtcaataggacctttcatcacaaccagaagtagtagtaaaatcacttttttggtagaggaaatgacagaatttagtaatatttgttacttcagtatttgggatcagtccagcccaagttttgaaagcacaagcttagagagacaggccttcaagtagaaatcctcaagtgttgtttgaagagctgagagcactggtaaggcctgcttgccctcttcatgtcactgctgtctaaaggtgtgtgtgtgtgctggattaagtactgagagtgagtgaagcaaaatgccttgttttcagcaccatatattaatatttgttaagtgccagcctcttcagttagaaatagccttccttcttggctagcatgtaatgctataggaatgggcctgtcaaaattcaggtgcagtataattgacgttgactttaaaaaccagatcctgccataatttcagttagttcataagtacattatattagaatttgtatagagaacagaaatttgcttttaattctcagagcataaaaattaaatggaaaacaaaaattataatacttttatcttatatttgtgggagccttatagtttgtaaagtacatgcatataaattcacatgatccctatcatcaccctgcaaagtaaaaagggcagatgctattaaatcgatttgaggacagcttggcttttgacatttgtccctccagtgtcatatcacataatttgataagtgtggcagagatccccttacttctatatacttcactgttctatatatttccatccttaaagtgcaccaaatcaaagaagacgacattcccagatagaaaaggaagcaaacgttttttgagaatggagacaaaaactattttgcacatcataatttttccattagcaagcacaatgccagaaacactgtaagttctaaagaaattaataatgaatggtgatatagcaccatcacacaagaaactaagatctagaaaagttaagtgactttaatgaattttaaaaattgtgatacacaaacacaacgcacacacacacaaatagaatattattcagcctctgtaaaggacatactgccatttgtgacaatacagatgaacctggaggatattatgctaagtgaaataagccagacactgaaagacaaagactgtatgatctcagtcatatgcagaatcttaaatgtaaaagttgaataactagaaacagagagtaggatagtgattcagtgggagggagaggaggaaataggaagaagcaggctaaagggtatacaaatttgcagttagataggctgcataagtctagggatataatatacagaatgaggattatagttagtaatattgtattgtgtactgaaaatttgtcaagagagtagatttctacagtttttatcacacacacccatgaatatgttaatttgtttgactgctataatcatttcactatgtatatgtatatcaaaacatcatgtataccttcaaacatcttgtaccccttaaattgatacaatataaaatttttttaaagttaggtgacttgcttataattcattagtttattcaacagtatttgttgagcatgtactgtgtgctgtgtacgctgagttaggttgcagtgggtagagcaatgaataagatacactagatccctgatccctgcctcgttaatatgctagacacaaaaggacaaatattgtagcgttccatttatataagtatctacaaaaagcaaactcatggagtcagaaagccacattagagggctgggggaataggagagctatattgcttaatgattacagtttccgttggggtgatgaaaaagttttggaaataggtggtgacaaccattatatatcattgtgtatgtaatcaatgtcactgaattttacacttaaacatggtttaaatggcaaatttgagttgtacactttaaatgggtgaattgtatgttatgtgaatcatatctcaataaagctgttttaataaaagaaaaagaaagatccctgtctcgttaagcttataacctgatgggaagagacatacaataaacagagaaagtcattttagattgcaataagtgctgtgatggaaattaattaggtgatataatagaaaataagtggaaaaggacctactttagattaaattgtcaaataacccttattgaggaagtgactgttgagcttagatatgaatgatgacaaggaactagccatgcaaccagctaaggaacagaaagttcctgaaggtcatgggaatagcaagggcaaagtccctgaggtaggaaagagctatgttgaggtaacagatggaaggctgatgtggcaggagtgtagtaattgagtggcagaggtacccagggagcatagcacataaaacctcagagaccacagcagagtttcctaaattattctaaatacaaagggaaaccattgagggaagatttaagcaggaaagtggcatgatttgatatgttttttcccaacgatcattctagctactacttttttttggccccacccacccatctccacattctagctactttaatggattgcagggaactagagttgaagcagagttaccagttagaaggctatttcagaagaccagattaggggcaatggtggtttggatcaggatggtaggggtagagatggagagaagtgaacagatttgaaatatattatgggacatgaactagtggactgaacgtgggagatgagggaaaaaaaggaatgtcaagaatgactcctaggttttgtgtatgagcaactcctttaatgttactgccatttattgagatggagaaagatccaggagatgggagtggggcaaccaaaagatcttctttgcaaatgttaagtttgagttacctattagaaatccaagtagacaacaggatatataagtctggatctcaggactggaggtcagtacagggtatagaaatttgggactcatcaacataaggatggtatttaaatccagagaactagatgagattacccagggagagaacgcagagctgaaaagagagagagacaaatacagacacacacgtacagtgggatttaatcctgggaaattacatttagaagttgaatagaggaggaagaaccagcaaaaactgagaggaatggacagtcaggtagggagaaaatgaagagagagtagtaatttggaaactaagaggagtaaatttctgaatagaagaagtcatcagtatgtccagttatgggtttgtaactggagatgactatgggattaagggaagtttctttttgtttttgtttttgttttcaacctgtttgttttgtgggaatgtagaatggtttgtttgctttgttttttaagatggcagatatcaaggcatgtttatgctgatgagagtgagcctttgctcttgccacttatcccaaattgcctttttcagatgcatgaaggatggtgggctctgggtaaggaagagaacagggaaaaagtccagctcattatttatcttataaaaggaagacttttgataggtatgatataaatgtatagttcttaaccacaactcacaccatactgtgaatatatttttaatgtgaagatgaattggccatctatataggcattgaattagtttaacttttgaatacagtgaagagagctatactgaaactaaataattttcttccagattgttggtactgagcctttagtagattttctgaatagtttcacatgagtgtgccaactgtacagaatttaagtgacagattcctttttcttctagagcagcagtgtaatcagtccctggttccttggggatccccaacaccctcagtaggtctgggagggcggaattattttcataataatactaagacatttttgcctgtttcactgtattgacatttacatgatggtggctaaaattgctggccacttagaacaaatcaaggcagagggactaaactcagctagcagtatttgtcttctgtaagactgtgtactcatagtttatatatatatatttaaaatggggttcaattaagaatgtccttaatgaagcagtaaaaattattgattatattaaatcatgacccctgagtgcacaccttcttaatattctgtgtgttggaaagagaatatgcataaatcacttctgctgcatactgaagtacagtggttgtttcaaggaaaagcacatgtgcaatcgagttgctaagtgaactaccttcttttttaaaagccttgtctttacttgaaagaatgactgacaaattatggttatttagacttaagtatttggcaaacattttctcaaaactgaatgaagtgagcctgtctcttaaaggaaatcaactgatgataaaattcaggattttaaatgaaaattagaattccagatcgcttgtgtctgccaccatgagattggcagctgcccaatccttaaggatttttttgataagattggtagtgataataacacatgtgatttttaaatagtttataatggaatgtgtcagcattaaaaatatatataactcaatgagccaatgttttccaaatgaccattgtataatgctatgaaatcatacgtaggtaaagatcctttcaaagtgccagaaagaccaatggattttaatgtaaaagagtatgaaaactttattgatagggtttcagattctgcattgctactagtacctttaaaaagctattacttaatgaggttgggagtagtatcaaacaagaatatccacaaccatctgaaaaagcacttaaaatactcctttctttttcagctgcgtatctgtataaggctggattttcttactaaacaacacatggtaacaatgagtgcagaagacaatgtgagactccagctggcttctattaagctagacattgcaaaacagacttgcaaaaatgtaaaacaatgtcactcatctcactaagtttcttttttggaaaatttgcttatttttcattaaaaatattatttatattaacaagtaatagattgctattgctatttttggaagaattcacaaacatgcaaaagttttcttaatttcaatttttaatatgataattattgatacatatgacccatataaatgaaagccctttggggtcctcagtcattttaagagtataaagggatcttgagactaaacttttgagaaccactgtcttagagaatgtggccatccagattttctgtgaaactcttcaattgctccaagacacatgtgtcatttccccaaatgtggaaacataatatgagagacctaccaatttgcattccaggaatgatatgtagtacaagtcagaaggctagcagctatcagtggattcttccttgttgcttttgtaagccaggcctcttctctccttttctgaaagctcaatatttaagagtattactttgagggtatattgtacaaataataatgatgatttacatttgtatagaatgtaatggctttggagtgtgtatttttatttgtgtagctcatttcatactctatgaagtatgttgaccaagtctgtctttagagataagaaattgagctgctgctatgctgatttcctggggatgacaaagctattaaatggcaagcaattcaaaaccaaatccagttatatcctactaacattatttgtttttctttttaatttgggccttcctacaattctgtgagttagacagggcatagacaattatctgcattttacagaagagccccctgagacagtgagttaagtagaagagctaaaattagaacctggggatttcatgactcccttccttttaccctattacttctcttccccttcaagttaagacttcatagaaagtaaaaatagcttctccatccaaaacagctgggaacccctgttctgccaaggacgtgatccttctgtaaatctttactcctggggcccacagtgcacagctatttagaagggatcaatgccagcttctacccagcagcttaaattcatgtatatttctttaacatacagccaaatgtatgtgacacatgagaagaaaatatgcttttattttcataattcttggaatcaaaaatataaattccaaggatgttttaatagtcaaaatgcctttccccaactactgcatacaaaatttgccaataataatggtggaagctctttataaaaagtactaaatttaaaaaaaagtttactgagatatatttcacataacatacaattaacccatttaaattgtacaattcaggccaggcgtggtggctcacacctgtaatgccagcactttgggaggccgaggtgggcggatcacttgaggtcaggagtttgagaccagcctggccaacatggtgaaaccctgtctctactaaaaaaatacaaaaattagccgggcagggttgcagtcgcctgtaatcccagctacttgggaggctgaggcaggagtgaaggagtggcttgtacctgggaggcggaggttgcatgagccatgccactgcactccagcctaggcaatagaacaagactgtgtctcaaaaaaaaaaaaaagtatatagttcagtggcttttaatatattcaccaaattgtgcaactatcaccacggtcaattatagaacattttcattgcccccaaaagaaaccctgtacccactagtagtcattcctcattccctcaggttccccatccctgggcagctaccagcctactttctgtttctatagatttgctgttctggacatttcttacaaatggaatcataaaatatgtggtcttctgtaactggctttatttgctttccataggctcaaggtttatccattttgtagcatgtatgagtcattcctttttgtagccaattttttttgcagttggaagatgtgtatgtatatacgacatgttatttatccatttacgagttgatagacttttgggatgtttccatttcttggctgttataagaatgctgttatgaacatttgggtacaagtttttgtggggatatagttttcattattttggggtgtatacctaggagtggaattgctgagccatatggtagctatgtttaaatttgaggaattgccagactgttttctaaagtggcaacaccattttacattcccactactaatgtacaaaggttctgtattagtctgttctcatgctgctaataaagacatagccatgactgggtaatttataaaggaaagaggcttaatggactcacagatccacatgactagggaggcctcacgatcatggtagaaggcaaagtagaagcaattttactgtgttacatggcagcaagcaagagggcgtgtgcaggggaactcccctttataaatctgatctcacatcagatcttgtgagacttattcactatcacaagaacagcacaggaaagacctgctcccatgattcaattacctcccactgggtccctcccatgacacgtggaattatgggagctacaattcaagatgagatttgggtggggacacagccaaacggtatcaggttccaattgctctgtatcctcaccaacacttatttttcttttttattatagccatcctactagttgtaaatggttttgacttgaattttttctaatggctaatgatgttgagtgtcattactcttttatgtacttattggccatttgtatatcttctttggagaaataactattccaaccctttgaccatttttaaattaggttgtatttatttatttatttatttatttatttattagaggcagatgacaagaccccataataaaaaaattagcagggtgtggtggtgtccaactgtggttccagccacttgggaggctgagatgggaaaatcacctgagtccaggaggtcaaggctgcagtgagctgtgattgtaccattgcactccagcctgggcgacatggcaaaccctgtctcaaaaaaaaaaaaagatgtctattgaaagaatgaatgatgaatgagtcagtcagagattgttctttcctctttaaggttgataattaaacaactcatttctgtttaatgtatattatatattgtatatataaaatatataatatatgtaaatattatatatacacacacacacatctcttgtatctatttaatgttttaattgaggtcaaaaaattatatttatttatacatagttttttccaaaagttctattctgtgtttaaagggataacatactgcatttttctagttgcaaatgattggttaagtgttcatgtattaatttttctgagagccatcattagctattaaccaatgtgctagacatttttaatgtcattgactatgattactgtactctttgattgctgaaagtgtaaattgataaaactttttatctcagttggacattttttccttttaaactgaaactacaaatacagtgccaaaaatatatttccaaatgaaaaataaaacaattgtaacttacatatatagcttattttagggcacagggccctttcacatatattatttcttttatcctttgcagaaacccttaaagtgttggtattattatcttcattttacatttagataaactgagcctctgaagggtgagtcttttgctcatagtcacacagctgttagataaacaaagaaattcagaccctaatatctgactctaagttcaggagaccgtacttgctgctttccttttgtcagacaggaagaaacatcttacataacaggcttccctttttttctgtggctaatagctcaatataaatttagcaccttacttggcttaccatctttgataacatctatctcttcctttatcctagttgttttaaaagattcactttagcctttttacttgttcagtaataagattagccttttccaaagcaccaccatgagtgacatcttttgctgggaggaaaatatttaaagaatgtacctcaactgaaatgaaatatgcagtgctagctagttcagagaggatggcatataaattctcactatactttttatgattaagcatcatgaaatgaattatgagctatatgaaaaatgaatttggtctgattttagttggcatcaaagtgaccggcatagcttaggtgtaagctctttaaagagatgagctccaaaaaaatggtttatattgcctgattcaaaacccaaagtctctagattttaggggaaggtagcacagtagatttgaaattctaaattttggaacttttaatgatgttatgttttgctaatttatctttttgaaagagagactactttcaccaacatacccacagttatctgtggatagacccatatcataattctgtatttaaaataataactttgtagatatttctgtaaattattggtttaaaaatatatatattataaatgcagactagcactttacatttaaataattaaattatttaggtagatgcaatgaaaggaatgaaattttgtcatccacagatttcaaaaaggtggatgaaatgatttaatggaaagaacataacaccaacaattagaaatttcaaggttagaccgggtgcggtggctcacacctgtaatcccagcactttgggaggccgaggtgtgcggatcacgaggtcaggagattgagaccatcctggctaacacagtgaaaccctgtctttactctactaaaaatacaaaaaaaaaaaaaaaaaaaaaaaaaaattagctgggtgtggtggcggacacctgtagtcccagctactcaggaggctgaggcaggagaatgatgtgaacccaggaggcggagctggcagtgagctgagatcgcaccactgcactccagcctgggctacagagcaagactctgtctcagaaaaaaaagaaatttcagggttatattccatcacttttaacttgccagtaccttgggcagatagtatctttctgctgtgtctcagacttctcatctaaagaatcaaaaagttgagtattatgtgccctgagccccatgtcagcaccatgttctttacatctctgcttcttaactttaccactcttataatttagtctgttcattgctttttcaaaatcacttttaagttgtttgactcgcgacagcatgatcaaaaaggttttaagattcttgcaaggtgcagtggctcaagcctgtaattccaacattttgggaggccaaggcaggaggatcacttgagctcaggagttcgagaccagcctgggcagcacaacaagacctcatctctacaaaaaattaaaaaaattatccggacatagtggcttgtgcctgtagtcccaactactcaggaggctgaggcaggaggattgtttgagcctaggtgttaaaggctttagtgagctatgattgtgccactgcactccagccagggcgacagtgaaaccctgtctcaaaaaaaagaaaaaaaaaaagattaagatgaaatgtacaaatagtatgcttatatattggtgattttgtttttagaaaatattcagagatttatggagtaccatactaggcttatgtaagtccaatacaatatggacttataaaactaatgataatactatcttacatttatgtagtgccttacagttttcaaagcattctcataagaagctcatatacttaccctcacaattttttctctgaagtagaattagtaagaatttctgcctttgatttagtagttcatcttgggaactctagcataaggaaataattctaacttcctgaaaacagttaaatatgtttatcataactgaaaatagttatctgggaataggttaaataaatgaaggagcattgccttcattcgttttctgctgctataacagaatatcatggactaggtaattaataaagaaaagagatttgtttggctcatggttcgggaagctgggacgtctgagagcatggcaccaacatcaagcaagcatcaacccatggcagatgtgagatggagagaggaaaattggactgaattcacccctttattaggagcccactcttgtagtaatggcattaatccattcatgagggtggagccttcatgacctaatcacctcttaaaggttccaccccttaatactgtgacagtggcaaccaaatttcaacatgaggtttggaggggacatttaaaacatagcaagcattcactgtgattaaaatttttgtgaagattaggtagcatagaaatacctttgttattagtgtagaaaagagagcatggggttgaaggcacactgtggttacagatattaaaataattttaaaggcaccaaacaaactaccctgtatataggagggaaaagactgcctggttgtataccaaaactgtgttacatgtttgttttgtgggacttcagataatccttctacttacctttttatttatttttattgagcacatattgcttttataatagaatatatatatataaattatttttttcagacaaaaactgaatcctagtgaagttttttgacattctcaaaatggtacaaatggttaatggtgaacctgggacaagaaaccagttttcttctcttaatctattcgttagtacgttcaaattatagaatattccagcagatacagaaatttcagctttaaagaggctggtcaagctatgtattttttctcagtaacgtgtacttcctctttaagattcattagcccatagtcaaattgacaaaatcagtgttattttttcatactttgtaaaacacagctatattccctctagctgagtatgtttccagacagtatatgtggttaggagaacaagtacagacagacatggattcacttcctgatcagtgttgccacttgataactgtggccttgtgagtttctaggcctcagtttccctacttaaataatgagattcacaaattccgttgtaaaacgtaatgctaacttttctaaactgccctaaaacatttctgtgtctgtccccattgtgttcacatttataaatagtagttgtatttcattgtttccagattcccttgcaaggcagcttaatgccttggaaagagctctagattgtgttctagcttcagagttgcttctaactctttggttttctaactcattgtccctcttattcactgtaacattgagccagtctctctctttttttttttgagatggtctcgctctgttgcccaggctggagtacaatggcgcaatcttgactcactgcaacctccacctcctgggttcaggccattctcctacctcagcctcccgagtagctgagattacaggcacctgccaccacgcccaactagtttttatatttttagtagagacagagtttcaccatgttggccaggctggttctgaactcctgacctccaatgatctgcccgcctctgcctcccaaagtgctgggattacaggtgtgagtgaccgaccgcacctggccaagttagtctctaatttttctaagccttggctccttctaaaataagaaacttgaagtaaataatcttttcatttccttctaacagtaatattctacaatttctcccagtctagttttgagcacatgtatgattttaaaaaaaaacaataataaaccggttactcttaaattagaggtgatgggagggtagattgatcatttaaaaaaataatttgacattatgcagtgaaattgaagatttgtatatgagaatgtttatagcaccactattcataatagctgaagattagaaacaacttaaaatatatcgacaatatgttcatcattaattaaggtatatttatgtaatcaaatactgtgcagccatgaaaccatagcaatgatagggacgaatttcaccagcatgatgtagagtaaaagaaccaaagcaaaaaaaaaaaaaaaaatccacaatcatcctctatttatgtatagttcaaaaccaagcaagattaaacgatattatttaggaatgaaaactatacaaaaaaacaagggtagtgactaactacctctggaagtgagaaggggttataatgagaaaggggcttgtggaaggcttctggggcaccagcagcattgtatttcttgaccgagtggtggtaacacaggggtttgctttataatcctgatcctttaaacaatgtgtatgtgtgtttcatttatttttctatatgcatattatatcttgccattaaaaaatcataggtggctaggcacggtggctcacgcctgtaatcccagcactttgggaggccgaggcgggcagatcacgaggtcaggagatcgagaccatcctggctaacacggtgaaaccctgtctctactaaaaatacaaaaaattagccaggcgtggtgtcgggcgcctgtaatcccagctactcgggaggctgaggcaggagaatggcatgaacccgggaggcggagcttgcagtgagcggagatggcaccactgcactccagcctgggcaacagagcgagactccgtcccaaaaaaaaaaaaaaaaaaaacataggtaacaattttttaaactgtataacactatttcatcaaattcttgtcatctcttgaaaaataattgccattacaaaggatggcaaggacttcgtatttcagcatcatatatcagaagaaaaagaattttcagctagagcgcttaagcattgtcttagctttacacataagaatatctactttgggccaggtatggtggctcatgcttgtaatcctagcactttgggagaccgaggcagatggatcacttgagcccaggagttcaagaccaacctgagcaacatgatgaaacctcatctctactaaaaatgcaaaaaaatcctagctgggtgtggtgattcacacctctagtcccaattacttaggaggctgaggtgggaggattgattcccaggaggtcaaggccacagtgagctgagattgcaccactgcactccagcctgggtgacagagaccgtgtctcaaaaaaagagtatctgcttttgatcacacaatatatccttgtaacaaatctgcatgtgtaccccctgaatctaaaagtttaaactaaaacaaaaaagaatatctgcttttattgatacctatatgcaaagagtgtcttattctttattcctagtcttcacaataacctttcaggtttttgttattatcctcattttacaggtgaggaaacaggtatagaatattttggtggatgaggaatttttaaaaaataattgaaacatctgcatggaccatttttggtatttttttttctccttcatgttataaaaagataaattacaaacaagatttgtgaccattttagggatgtatactattaaaataagccctaaacaaaagaatagactgagttttggctgttttttctttcaaatgtacctggaagtatgtaagatttcccaaatgcctaatagtaaacgagcttttgggtattggggcatttgccacttataggtcaagcccctgcactgagtgttgaaataaagcctaattagaagagaaagtgagagaaacaatgtctacatttttaatacactaattgtggtggtcactctatacaaagtttgctgaactatgaccactaagctaaccgggaagaggaaattactttgtataaccaagccaaaaaatttttttttagatttagttcataatgtcacttaagattcttctgaaaggcttgtgaacctttgccttcttttaataagccttcataatgacaaggtcccctgagaatgaaatcatctgaacggaatgtgcctgtgtcttaaaatctgataaacatcacttcatgttattcaggagatcaaaagagacttaaaacacgtaaatgttactttcaggttattataaccaaggaagcctgtggcccagctatcaaaataacttagctttagcaagttctaagcagtgggcttagccaggttggttagtgctgccttaggactgaccgcactgtcttttgagttgacctgtaactttcaatgtagaatgtaagtgcttcatctctgaggcacatttatgtgtcccttagctcctgacactaattcatcatttgctttatagtaattccactcagacatcatcatcaagccccagtggaggctactaaatgatgtgagtggatatatttcctaatcagtgacattagtttatatctccttattaagatacccattaaattcataccaggagagataacatgaacgctaatgcactttacatcttccatcagtgctttcttatttatttctataaaggcggtattaatatctgaatttaagagtccaagagaatgtaccgcttttattaatggtctaagatcttttattttgttaagaaatggaagatgtgaaaagcaaagacatttattatcatgttgtcatttttattctctttccctgcctagaacatagccattaaaatatacatactatcatttatttttaaagttgttaatatattttatatactttttccaataaaatgtatgatccgagttttcctgtattttatctttataagttatcttatttttctcattttagtctgaaactcagaatatatatagtgttttgtggacgttttggatataccagccaaaaagtattaattgaatatactatactaggctctgggtggtggtggagggaaacagaagaagttgctttatgtgacaaatagttcacatgtgtataaaatctaattgttctggccagtcgcagtggctcatgcctgtaatcccagcactttgggaggctgaggaaggcagatcacttggggtcaggagttggagaccagcctggccaatgtgaaaccccatttctactaaaaatgccccccaaaaattagccaggcatggtggcgggtgcctgtaatcccagctactcaagaggctgaggcgtgagaattgcttgaacctgggaggcagaggttgcagtgagccgagattgcaccattgcactccagcctgggggacagagcgagaccctgtctcaaaaaaaaaaaaaaaaaaaaaaaaaatctaattgttctgatgaatcccccaccacattgccttaaccagaatagtttgttcaacagatatttcttcatttattatatccttttgagacatttggcaaagttactaatgtgatttatcatttgaggaatccataaattactgtgttcaggaactatagcaacatcatggcaatgtggtcccctttgtttggctctggctttttgctgttattgctttctcagaactgataactttttttaacaattaaagtataaattgtgctgggattgtctgtgtcagtgctcgtcaaagtgtgatccacaggccagcaggcagtctgtagtccatagagcttgttgtcagtctgcagtaagataaggaaattgtaccaaatgtgaatcaattgtgtcaccaaacacactacttagttcagatgcaaatttttcttttgtatcaagacattctggatgaaggaagcagggcatttatttatattctctcactagcttctttgttacatactggcactttagccttggagtttaggcaaatataaaaagcagaatataatatccttttaaaaatcagattttctttttcaccttgcagggactttattatatatacatctgcttgtctgctacaggggaaaccactctaagctgggcattggcaaatcacattacttatgtcagtggaaggcacatttagcatttttcagcattaggtcttgtgatcaaggtaagcaggtttgtcattgtcatatttccacgtccttttccatgtgtgtttttcacaactcatctatcagcttgtatttctggagctctttctacatgtcagacaccccatgcctgctgacacccagtgccctcattctactctgttaaagccatgagccctgaagttggtgcaccaccaaaatccactttccctcccagttccatagtatgcaaagttccattccctcagtaagcagatagctgactaactgaagggaaaacaacctgctttaaataagtaacacgggtaattcaccttctgcttacatatttgtaatttaaaattcgggcctgttaatggaactatataagacatatttttgaaccatggatgccctcgcttaatcatgaacttaaatctttctttagttttttccatcatgtattctagaaagatttgtctttacacatctgtaaagctgctcactcctgccctaaagtgggtattggattttcccacaaccttttactttgtttggtaaccttcttgcatggaataaccttggacagggagacatgaatccaggaaaccaatcagaactattcttcgtatgtttaaggatttaaagtattggctgtattttgttttcagttgtaagtatcctttcatatttgaaattaattagatagagatttggtctattttttaatgtgttcccagatctttgatggcttgttaacatgatgtagtagactaggaacttctagttttgctttcatacttttaaaaactaaagtgcatgtttcataaaattaaagtgcctcaagagtcagctaatataaagtaatattttaccaaggtcataagtgatttaatatgaaagatcatattttatcataagcataacagacttaacaaaatctagacagacaaattgctagtttagaaatgatctgaacttatttttcccaaaaaaacaaagacccgcaagactgtgtatatatggcaacaggcattatttcattgatccccaaggctgtggatctagcagcagctattataacatgctttgttttcattattgcaatgcttagttagtcatctgaattctagctgttgctgtttatagcaagaaatagcatcccagctgaggcagcacagctagtcatacctttttattgatgtaatttaacttattttgtttcctttcctagtgtctaacattttgtgaagccctaacataaattattggcttgtataacccactgcatcaacttcacttggagatttgctgcctatgcagttccttaattttcaagtgtgagagatttatttttcctcagtgagtcctaatgtttctacatgcgcacacacatacatgtgcttgtgaatgtgtgtgtaggtacataggaatgccagtgagaaagtcaaacatattcttggttaattcctgcatgatattctggagaagtatttacaattacagatatgagttgccatgttctaaaattgaccggtgagcagtatggtaggtagtgtttttaaattttgtccctactttgttttcttttccttagagactctgactaattaggactctgcacgcttcatgtcctcagtgaatacttattgactgcatcacagaccaattgatttatcatacaccaatgtaaatggctaaaatactgccacagatgataatcataattactgtgtgtcagacaaggcacttcagtcctcatagcatgaggactgtaatatagatggaattctccctggtttacaaatgagaacttcgaagctcggaaaaattaaacaaattgcccttgttatacagctttataaatgaaggatcaagatactttatcaaagtatttttatgtgtattatttcctttgatccttatagcattccttaaggtggacagaacaagtccttctctattcccattttagaactgagtaaagaggtttagtaatttacccatggttactacagcgggcctgattgtcaggactatcctctgaaccctgatactacttggcatttgtaagcgtttagttgttttggttttttgttttgttttgttttgtttttgagacaagatctcactctgttgctcagactggagcgcagtggtgcaatcacagctcactgcagcctagacctccctggggtcaggtgatcttcccagtagctccctggggtcaggtggctactcctagcctctcgagtagccaggactacaggcatatgccaccacacctggctgatttttatatggttttttgagtcagagttttgccacgttgcccaggctggtctcaaacttatgggctcaagcgatagtgatgggattacaggcatgagccaccacatccagccccatttgtgaaaattcataagccagtaatgacatcagtgataccattatagcgcccctatagtagtttccattggctgatttttgtcacttaagtaattcttcattgcctctactaaggtagagtcctgctgaaatacttggcatttaggtaagcacttttataatgagaaaaacgaggacgaggggtgggaagtttgcaaatctgttatgtccacccctgcttaaaaccttgtcatcgttttccataggctaccttcccccaaatcccatcttctcctatgccacccccaacccccacttccgcccacccgcgccccctcccccgccttgcaacaagactcttttgcatggcaaagtcttcacatgatctatctgtcttctctctcacgtttcagcctcaactcctgcaaccacttaccccaaaacctccgccactggccctttatgccaggaaagctgaacatcactgaaaggcccatcttctgcttttgcttttatattccctttgcctgaaatttccttccccttttgtccatgtggtaaactcccactcattctccaggatccaaccaggccaacttctcttctgtgaagcctttctttgccctcctgaacagagttatcacccatcttctattcttcctgctcaccttgttttaaaaaacaagtaatcgatcaaatatgtgaatattcttacatttctgttgttattttgcatgtatgtctcccctactaaattaataagttccttaagggccagagactgaggttcattcatctctttatccagacacagtagctagcacataacatggactcaggaaaggtttgcacatgcatgatagactgaaccagtgaccttcctgcatggactaaaaacttaagaactcatctctgaaaggaatagccttccatttaaaaggcaaagggagttcacatttgtatcaaatgaaattacagtcttacttatagatatgcctggctttgcttgtgtctaggaagataatgcagggctttgagaagtggggtgagattaaggagaaattatacagtaagcgaacattttccccaaaatatatgcctgtggtaataagttgttatatgttgagtgactttttctcttctagtcagagagctgacaaatattttcaaagtgttatagtgttttctaagtgttattctttcactgacaattttatttaataattttagatacagtagtggctctagagctaactgaattactggcttatatgtaattcagctagtatattcatattgacagtataggagagatgattaccagctcacaaagaatgcatgacgcgatgccatttgaagaattgaaaatggaaggaagggggtatgtgaatttagataactcaaccctagagttctggcctattagccctttggttttagttttataaaattatacatgctgttaaagagtcaaatagatccttaaggctaattgtgagaaacagtatttctgcttgtttcccagaggtaacgactttcaacaatcttagcagattatgttactacttgcctctaaataatttgataatgttgatgcttcttggattttgttcgatttcttctgatttcttcagtaggagatgagactttagttccctttcacacattcatatcccctttctgttcccccattctacctgagaaataaaaataaattcctaagcctcccaaccaactgaacataccccgttttggccagaaggaccctggagaaaccctaaaaactgagtttccagctgtgatgggataggaagttggacctgccttattctacctccgccctcgctagccaccattcggtgttctttcccaagggctaaatggaaaccagccctttagaaagacttcctgcacctctgatttcaaccaatctcctgactgcacctccatttttatgtttcaaatgcagcaactggtcagcatttcttcctgataagagaccacactgactgtggagtggttctgccagtctacagaggctgtgcacagaggcctttcatgtcctcgctttaccttttgatgtacagggcctacttgtaatacatttaaatgttaagtctctaccccaaagtgagcatggtgtgcagactgtatacatattagcctactacgcctgcttgtgcttccccttcatgaatattcataactcctcctataacctgttgaatgtatatacttagccaacccactcagcataaattcccattccctttaaccctccctggcagtgcctatttccagcttctggccagaggctatccttcccagtctgtcagaatggctacctgcaggctgcaaccctttatgagaaataaagctctcctttccagacttaggaaccttgtcattcttcagttgacctaccgttataggttttcaaattactttgtctatataaataccactcagataagccatgtagtatactgtgattactttttttcccctaatgttttttatttcctttggagcttattttcttattttttctttgattagttttcagtgtgcttataactaatttcatcctaaattctctaccagttatctaatcacctctcaagatattcagacatgttagatatacaataaattacatatcgggtattcacacaatttcatctttgggagaaatctctcctagaacttctgatctgctgcagtctgtcatattgttttctatggctttaccataatcctagggatttccataatttctcttatgttgaaacctctattttctagataaatcctcacaaagaatgcatgacatgatgtcttcctctttctcagtgttctcccttgttttgttggagcatatccttctatagcttcctaagaaagcatgcatggagataaatttttgagaccttgtaaatctgaaaattatctttattcttctctgactgaaatggaatgttaggctggaaacaattttccttaagattttgaaatcattgttctattatattttagcttccagtgttactgaaaaatctagagatatttgattccccctttttgtatgtgaaatattatttacttattttgctttgccttgctttttatttttagaaatttgtaggaactgtatttgtgcccaatgttctgaaatctcagactgataagtctgtttttatctgttgtgctcggcactcaatggatctttttaacccaaaagctcaaatcattaagttctgggaaaattccttgaattacttcattaatggtttactcccttttatttttttttatatctcttcctggactactatcgtttagatattaggtttcctgtactgctcctgtaattttcttacttcttctctcctgttttctatctctttgtctttttgttctacctctggagagatttgcttaccttcatcttcttgcccttgtgtttttcattttggctttcatatttttaatttctaagagttctttttctctgaatagcatcttattgttctatgtgtgtaatatcttctcttttccacttgagcatattaatgatttttgaaatttttattgttgtttttgttttggacttgatatatcatttgtattagaagcttttcttagaagtttggagatacccgattgtatatttgttttttttttattattctttaagttctagggtacatgtccacaacgtgcaggtttgttacatatgtatacatgtgccttgttggtgtgctgcacccattaattcgtcatttacattgggtatatctcctaatgctttccctcccccttcccccgaccccacaacaggccccggcgtgtgatattccccttcctatgtacaagtgttctcattgttcaattcccacctatgagtgagaacatgctgtggtgtttggttttttgttcttgagatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcagtaaacatacatgtgcatgtgcctttatagcagcatgatttataatcctttgggtatatacccagtaataggatggctgggtcaaatggtatttctagttctagatccttgaggaatcgccacactgtcttccacaatggttgaactagtttacagtcccaccaacagtgtaaaagcattcctatttctccacatcctctccagcacctgttgtttcctgactttttaatgatcgccattctaattggcgtgagatggtatctcattgtggttttgatttgcatttctctgatggccagtgatgatgagcattttgtcatgtgtctgttggctgcataaatgtcttcttttgagaagtgtctgttcatatccttcacccactttttgatggggttgttttttttcttgtaaatttgtttgagttctttgtagattctggatattagccctttgtcagatgagtagattgcaaaaattttctcccattctgtaggtcacctgttcactctgatgatagtttcttttgctgtgcagaagctctttagtttaactggatcccatttgtctattttggcttttgttgccattgcttttggtgttttagacatgaagtccttgcccatgcctatgtcctgaatggtattgcctaggttttcttctaggatttttatggttttaggtctaacatttaagtctttaatccatcttgaattaatttttgtataaggtgtaaggaagggatccagtttcagctttctacgtatggctagccagttttcccagcaccatttactaaatagggaatcctttccccgtttcttgtttttgtcaggtttgtcaaagatcagatggttgtagatgtgtggtattatttctgagggctctgttctgttccattggtctatatctctattttggtaccagtaccatgctgttttggtaccagtaccatgctgttttggttactgtagccttgtagtgtagtttggagtcaggtagcgtgatgcctccagctttgttcttttcgctcaggattgtcttgacaatgcgggctcttttttggttccatatgaactttaaagtagttttgtccaattctgtgaagaaagtcattggtagcttgatggggatggcattgaatctataaattaccttgggcagtatggccattttcacaatattgattcttcctatccatgagcatggaatgttcttccatttgtttgtatcctcttttatttaattgagcaatggtttgtagttctccttgaagaggtccttcacctcccttgtaagttagattcctaggtattttattctctttgaagcagttgtgaatgggagttcactcatgttttggctctttgtttgtctgttattggtgtataagaattcttgtgatttttgcacattgattttgtatcctgagactttgctaaagttacttattggcttaaagagatgttgggctgagacaatggggttttctagatatacaatcatgtcatctgcaaacagggacaatttgacttcctcttttcctaattgaataccctttatttctttctcctgcctgattgccctggccagaacttctaacactatattgaataggagtggtgagagagggcatccctgtcttgtgccagttttcaaagagaatgcttccagtttttgtccattcagtatgatgttggctgtgggtttgtcataaatagctcttattattttgagatacgccccatcaatacctaatttattgagagtttttagcatgcagggctgttgaatttgtcaaaggccttttctgcatctattgagataatcatgtggtttttgtctttggttctgtttatatgctggattacgtttattgatttgtgtatgttgaaccagccttgcatcccagggatgaagcccacttgatcatggtggataagctttttgatgtgctgctggattcagtttgccagtattttatagaggatttttgcatcgatgttcataagggatattggtttgaaattctctttttttgttgactctctgccaggctttgctatcaggatgatgttggcctcataaaatgagttagggaggaatccctctttttctcttgattggaatagtttcagaaggaatggtaccagctcctccttgtacctccggtagaatttggctgtgaatccgtctggtcctggactttttttggttggtaggctatcaattattgcctcaatttcagagcctgttaattggtctattcagggattccatttcttcctggtttagtcttgggagagtgtatgtgtccgggaatttatccatttcttctagattttctagtttatttgcatagaggtgtttatagtattctctgatggtagtttatatctctgtgggatcggtggtgatatcccctttatcattttttattgcatctatttgtttcttctctcttttcttctttattgtatatttgtttttaagaggaaagaactagaaaattaattggaagcttggagcatgtggacagggattatcaactgtagagttcactagagtgtaatttggctgggctctttctcattagggaacacctgacatcattctatttaggtctttcctcttcagcttgtcaaggatgttccagtcatcccgctttaaagtacaagccgattgcttgttttctggaagcagagttgggaaagaggactgaaggttttggcacttagtatgcgtatgttcacttaatcaccttgttttcagtaaagtgcctttgcccttaattgtacctgacggttccctctccaaggaataaaattctagtgtatttgtcaggatggaaaaagaactgttgcctggctcacggagtttgaaaggaaatctggggatataattgtataacagattttcaaccggtcttcctattccccaactttactgccaattccagaagtacctagggccaccagttcttgagcctttgtggattctcagattgcctctcaactttccctacttctggcttggaattcaactttttcaattctgctaaatttgttaccacttatctatctgctttttagcttgcaaaacattgttgcagttatatattttcctattctttgtctttgttaagctaattaagccattaaaaaagcatgttattaaatttacatatgtaaaaaaatttgtgatataaatatatgtctcatatatcatatattcatatataaatatatgtcttatatatcatatattcatatataaatatatattttttaatcccttggagctgggtgtggtatctcttgcctgtaatcccaatgctttgggaggccaaagtgaaaagatcatttgaggccaggagtttgagaccagctcgggcaacatagtgagaccctatctctataaaatattttttaaaaattagctgggcatggtggtgcccacctgtagttctggctacttgggaagctgaggtggcaagattgcttgagcccaatagtttaaggttgcagtgagctgtgattacgccactgcactccagcctgggcaacagggcaagactctgtctcaaaaaaaaaaaaaaaaaaaaaagcccttagagggagatgccacctctgcttttactgagtagctcctatcagatcaactctcccacagattaaaaactgtaaacaaaaatataataaaacaattatatgaaggcagtagagaatgaccaggggagagtcaaacctggaagcagagggtagcacttgctaagtgtcatttgtgtagcttgtagcctgagggcaggccccagtcagaaccatgcaaggcagctaagattcttgtagacactcatagtctctctggcttgaaaaaccagaaaacaaaataaggagacacaaaacaaagattcactggggaaaccaaggatcccttctatgttgaaatttatttaacatggcttttttgtggcttaataggatagagaataaaattgtaacagaagttattgataagcctgaaaaaatgtatgttaaatataaaattattctagataagttaaaaacgtaagagtacgtccaagggaaggagatagctgtctttatatttggaggactgtcagggagaaggaaaaaaattaaaccttgctgagggaccaacttaatacaaatagctagaaaggataaatttttagctcacatgagaaataactttgtttaacagatagagctgcccaacaatggaatggaaagcctgggctaaattaagtgtctaagtcactgaaggtgtgtgtgcgtgctaaagtgaggtcacagtcaaggatgctgtagaaaaggagtctgctctgtggaaccgtaaaacccgaatgccttttaagttatgctctactccatagaattctgtgcctaaccaggcctcttgctgtcatctgggtggaaatcttgcatcagattttgccaccagagcctgttccacaagcaaataccctgaggcgccccttccttgagtcagcagtttcagctgggaccttaacccgggatttggaagtcctgttgaatgcagtgagacaggcctcatccaaatgaagcctttgctgctgctccaaggacctcaagggcatcctcgcccaaactgaggcctccagacatgttgaggcagagcttgttagccccttgcaaacttcctggtagccatagcactctttccttctccttcccttaactgaagcgtgcaaccccttctgttagaggcttgttttctggcactccgcaagtgcaagatggtgatggaggtggagagtagaataggaagtttctccatgtctccagaacattgcgtttccctccttgtgtaaaaccatcatccttctttgagcctgtataactgctcgaccctctgtcacacctcgtcactgtcatcaggcatgctcatgacttctctggggcacctggaattcagaaccttgcttaaaattttcctctctaggctgctgctcctctagtaacctacattactctctctcctccctgtctccaccaggccacaccacgtgctgtttctcacgttctctcgtgcttctggggatttgcacatgcagtttcctctctctggaatactgtgcctccctgccctttcactcactgaaatccagctagtatgccacagtccagacaggttatcacttcttttctgaaccttctagtctcactgagacttaggtgttccttctctgcgttcctgtatattcctctgatgtggtccttactcatttttaatgtgttctttactcgtttttactgtacttatgtttctgatttttaaatgtctttctattatattatggaactgcctcttccttatctttgttacctcatagaaggggttcaatatctattgattgaatgaatatatgcttctaggtgcttgtcttctttgggcctatacaagactgaaggtggaacaaaaagaaatagtgttgttaccatagctagtttatatagctagttgaaattctatttgaagtgtatatattcattctgttaaacatatatatggatgaacttaggttcaaaatgtaagtctactccttaccgcctatagttttatatcctctacctgataaccctgccactatcattccatttttgttgttctatccattttctaaccctattactttaatctactttcatccacagaaatttggcatttcttatcttcaaaacgctgtggatcttatcgttcatctcggatggtttttgtttgtttgtttgtttttttgtttttttggtgagtcttatctcttctagacacgcttgaatcagttgagatccaaaatagcaacatatagtcttaactgaaagaagttagaaagaaaaattaataataaattaagtagaaaaataaggtatagcattaatggtttagtttaagaaacagtgtccttaggaatagctactgagggaaaaggaagataactaacatttgtaagatacttagaactcacagactgtgtcgggagttttccaaaaattactttaattaatccacacaataattctgtcaagcaggtgttgttatatgagccagaggctcaggcgggggtaagagacttgcccaaggtcatacagagagtaactcgcaaacctagatgccaaccaaagaccctttcattttgttgttccttctcctgtaccatctcatatattttaaaatggctttttattagattgtttttcagtcaagaatttttggagttagctaggaagttaatgtgtaagtggcagtttgaagatagaagaccacatcattgtttaataagtgtggcacagtccttggaaaagctgattgatttgatgggggtagttttgtatcataatgtgctcaaagatgaatagcacaaagagtaatatttaaataccaaatggagccctcatttaccagatccttgatggaaattttaatacacctaaaacaaatttatgctgatttttttcgtacccccaacacagttgtccaaaattgttcatgcctgcataggtgattcacacattatataaaattcattttcaaagcaccttatgcaaacaaaattgtattcctgctctgttgttcgaaattaaataaaatggttcctcagccagtccactactcccagacatgcatccacacacgttcatcatacatgcttacctgcctctgaactttgcttagagtctttctaagtctccactcactggcctcctttcccagttgttaatgcattcagctcatcttctttcagataatggcttaggtcctaacacctcaagaaagcttttccaacaaggatgtattcatcaaataaggaaatgtggatttcacccttgcaatttgcagtgcagttcccccaaaaaagtctattaactaccacacacttggcatgatattagctgctgggcatttaacagtaagtaaaataaattctctgtcattgaagcatttacagtcgtcttgtaggtcttgtgtagggatcataggagcaaattattttcttgttctgtgcctccattttttcatctgtaatacgaggaaaataacagtacctgctttgttagggttcttatgataattgaatgaattaatatttgtaaagtacttaaaacagggcctaatcaatagaaaatgctttatttactaaaacaagactaaactttggaataagtgttctagttctaaaaagatcctatttgtatgttaagtaggattatagtaaatgtataggttagtttgtagagaaatgtcatctttatagtaacaggtcttcctattcaagaataggatatgagtttccacttactaatatcttcttttacatccctcaatagaatattaaagttttcttcatatagatcttgctattttggttatgtttatttccaggtattttatctttgtttctgtttaaaatagcaccacgtaatattctaattcattgttatttatataaaggaaaatcattgatttttgtttttcaattttgtattgaagtattttattgtttgtgatgagttttcatttggtttgcatggactttctaaatgtataatcatatctattaaaaatgatcatttgcctcttattttccaatttttatagctctagactttttttcttacctaattagtattaactgattatggtagtagtgaacatctctgtcttatgctgtgatttttgacttgtgaccattatacttgaaatggattattatatataatgttacgcattcccaatttgataaacaaaatcacaatgtgttttttaattgtccagtctgctttccataagcttaaacatccaaatttggctcttaccctgacaaaaatcttccagaatattttagagaactataatctatggagaacaaaaactcacacttccaaaaggagataaagtcagaaatgattcttcagtgttgctaaccctttcccctgagcacttaaattagcccctggggagtgtgtcctaatatgtttaatgttcaaaatatctgctaactaaaaacctctatactattgttaaggactaaccccattgtgcctgacacatagtagatacacaaaaatgtttattggaagtgttgatgaaattccagaaactctctccactggcttacctcatctaaatattacctgtccatcagtgaactgcttaggccatgttctccccatgaattctctcctaatatcttcaggtaaaaggtagatataatctttttcacttgaattagttttctgtgctttataacaaattaccacaaatttagcagtttaaacaacattctttaaaagaaaaaacgtttaggggtacatgtgcagttttgttatataggtaaattcttgtcacaggagtttgatgtacacattatttcatgacccaagtattaagcctagtacccaatagtactttttctgttcctctccctccttccaccttccatcatctggtagaacccagtatctgttgttcccctctttgtgtccatgtattctcatcatctagctcccacttgcaagtgagaacatgtggtatttggttttctcatcctgcgttagtttgccaaggataatgatctccagctccattcatgtgccttcaaagaacatgatctcattattttttatggcggcataatattccatggtgtatatgtaccacattttctttatgcagtcttccactgatggacacttaggttggttccatgttattgcagttatgaacagtgctgcaatgaacatacacgtgcatatgtctttatgataaaacgatttgtattcctttggatgtatacccaataattgaatttctgggtcgaatggtacttttgtttttagctctttgagaaatcaccacaatggttgaactaatttacactcctgccaacagtgtataagctttccttttccccctcaactttgccagcatctatttttttttatttttaataatagccattctgactggtatgagatggtatctcactgtggttttgatttacatttcttagatatcagtgatattgagcttttttcatatacttgttggttgcatgtatacttttgaacagacacttttaaaaagtgtctgttcatgtcctttgctctcttttaatggggtcgtttgtttttctcttgcaaatttgtttaagttccttatcagatgcatactttgcaaatattttctcccattctgtaggttgtctgtttactctgttgacagtttattttgctgtgcagaagctctttagtttaatttgatctcatttgttaatttttgcctttgttgcagttgcctttggtgtcttcgtcatgaaacctttgccagttcctatgtccagaatggtattgcctaggttatcttccagggtttttatagttttgggttgtacatgtaagtctttaatccatcttgaattcatttttatgtatggcataaggaagggggttcaatttcagtcttctgcatatggctagtcagttatcccagcaccatttattgaatagggagtcctttctccattgcttgtttttgtcagctttgtcaaagaacagatggttgtacgtgtacagccttatttggggggtctattctattccattggtctatgtgtctgtttttgtaccagtacgatgctgtttgggttattgtagccctgtgatatagttgtgaaggtggacagcgtggtgtctcctgctttgttatttttgcttaggattgccttggctattcagcctcttttttggttccatatgaattttaaagtagttttttctagttctatgaagaatgtcattggtagtttgataggaatagcaattgaatctataaattgctttaggcaatgtggcctttttaatgatgttgattctttcaattcatgagcatggaatatttctccatttgcgtcatcttgatttctttgagcagtgttttttaattctcctactagagatctttgacctgcttggttagctatattcctaggcattttattcttttggtggcaattgtgaatgggattacgttcctgatttagctcttggtttggctgttgttgggaatgctagtgatttttgtacgctgattttgtaccctgaaactttgctgaagttgtttatcagcttaaggagctttggggccaagactgggggttttggagatataaaatcatgtcatctgcaaacagggagagtttgacttcctctcttcctgttaggatgccctttatttatttctcttgcccagttgctctggccaggacttccaatactatgtcaaataggagtggtgagagaggggatccttgtctcctgctggttttcatgggaaatgccttcagcttttgcccattaagtatgatgttgactgtaggtttgtcatagatggttcttattattttgaggtatgttccttcaatacctagtttgttgagagtttttatcatgaagggatgttgaattttatcaaaagccttttctgcaacatccatttttatctcacagatctgcaggtcagaagctgggtgggctcagctggtttctctgctcagggtttcacaaggccagaatcaacgtgttggccaggctgagctcttatctggagtttcttggcaataatccacttccaagctcatctaaattgttggcagaattcagttccttgcagctgtaggtctgaagttcccatttacttgctggccttcagccaggggccactctttgctactagaagctatccacatttcttcttacatgaccctccatcttcagaccaataatgtcccatcaagcccttctcatactttgaatctctctctctgtcttctgctgccagccagagaaacctctgcttgtaaagagtttgtgtgattagactgtcccaccaaaataatctccctttgctgtaaacataaaattatcaaggaattaacacgagggggtgaaggtcatgggggccatcttaaaattctgcctactactcccacccatcaaactctctctgcactgtatgaggaggtaacctccttcagggtagtattcatggctgagtcattttgtgatacccaatcacacctttcacgtatatttattacatatctaatgaattcattactttttgttaaatgaattgtgagacaaaacaattatttacattatttgaaaactgtgaggaacagtgtgcacttgaaaggtcattgctgttttggttttttttttttttttttgaagctacatttatttatgatcaaccagagagactaaacagtggactcatgggtttggactctattgcaattcaagtgaggtcagaggaattccacagaaaacttaaaaggcatgaagtagctattatagtaaaattaatattttaggggaaaaatcattaatgagagaaaagagcattctggaaaactgtgttccatttaaggcacctcattaccagattctttaaggaaaactggagggagttctgagacacaaagaatgattaagaggctgtagggattaacttagaaacaacgattttaaaagactaaatatgtatagcttagctgaacagtaactaaacagagatgtaactattgtcaaatttctgaaatcaagagaagtaatgggcttctctgattaaaaaaaaaaacacttgagggtctcctttatgattattggagtaaatgaggaaaaagaaaacaaaatcttaaacaacttatatgcaatatttagactgtgcgctgcagtgtaaactatcagagttgaattcaaatcccaactcctttattttccacctggggaatttcaggcaactccttccaccttttaaactttgtcatatgtagagtgggaattacaccacctacctttagggttactatgaagattaaatgagatgacataagtaaacagtctagttccatgcctagcacagattgcaggttgagaaaaagaatagctgctattgatatcaccattatcatcatcgttcttaagtggttacgagttcaaagtgctaggattcagacaaacctagaattcaaagtgcctgaattcaggcacattcaaactgtatcatttaattctgtctctacctcacggtttctttaaccgtgatagtgttgtagtgaggacttaatgaaataatataacataaaatgcttagcattgattcctggcacataactaatcactgaataaacacattaacagctgtagcactattttcattatcgttagcaccatcattattccatcatagaacctggacaaaagcctaacatatatttagattatttccaaatttcccgttacaaacagtgccatgcatgtatctccatttctgccattatcgtcaccaccacacatatacatgcacacaattcagtaattatttattacttgttgaattaagtaatttcttctaatgatcctgtcgggtatttgtggtcactatacgtggctggggaggtaccagaatgctcctgtatgtttcttatgtaatccaatttatagcaacagatttaagtgcattttttcatttcagtaaaactgatatgtagatttatttgaatttttataaagaatccctgcacttataataatattttcatttgtgttttccatacataggaactccctgtagctacacattgcttataggattgtgttactgcagtaaacagaatatactctagctagattaggcagaaatggtatcaattagagggttgctaattagaagatattaagattaatcagagggtataaatcatatgtgttaagtattcatcagagctacctcacatttaccattagatagatcacagaaactgtgggagggccagtagagatacagatggcaaataaacatatgaaaaaagtgctcagcttgggcgacattgccaaacccctgtttctactaaaaatacaaaaattagccagacgtggtggtgcacacctgtagtcccagctacttgggaggctgaagtgggaggataacttgagcccaggaggtcaaggctgcagtgagctgtgtttctgccactgcactccagtctggatgacaaagcaataccttgtcttaaaaaaataaaaagctcaatattattagtcattaggaacatgcaaattaaaaccacaatgaggccaggtgctatggcttacacctgtaatcccagcactttggaagaccaaggcaggcagatggcttgagtccagggattcaagaccagcctgggcaacatggcaaaatgctgtctctacaaaaaaatacaaaaacttagctgggtgtggtggcacacgcctgtagtcccaactactcaggaggctgagatgggaggatcacctgagcctgaggtcaagactgcagtgagctgtggtcacaccactgcactccagcctgagtgatagaatgacaccctgtctcaaaaacaaaaaataaataaataaaataaaacttcattgagacactactatacaactgctagaatggctaaagttttaaaactgacagtatcaagtgctgataacagtacacagcaactgaaacactcactgaaacattgctgctgagaatgaaaaacttatataatcactttggaaagtagttcgcattttaaaaataaagtttaagatatatctgccattcaacccagcaattccactcctaggtattggtccaagagaaacaaaaatataagtccaattaaaaacctatgtccacatacttatagcaacttaattcttaataataaaaatgagaaacaacccagatgtccctcaactggcatatagataaatcatttttggtacatccatagaatagaatactactcagcagtaaaaaggaccagactactcacacatatagtaacctggatgaatctcatgtgaaaaaaggcagacacaacaggctaaatactctatgattccatttctacaatgttctggaaaactgtctctgttctattagactgtaatcttgatctgagtgtatagttctttgcaccaagattgcatcaaagtcaatgaattggaagcagaaatgcctatttttttttttaagatggaatcccgctctgttgcccagactggagtgcagtggcgtgatctcagctcactgtaacctccgcttcccaggttcaagcaattctctcaccttagcctcccaagtagctgggattacaggcacacaccaccatgcccggctaatttttttgtatttttagtagagacagggttttaccatgttggccaggctggtctcgaactcctgaccttaggtgatccacctgcctcggcctcccaaagtgctgggattacaagcgtgagccaccatacccagcctcagaaatgtcaaatttgatcagtttagagagtaagctttagctgtgaagggaatcaaagatccagattgggccaaaggtcaatacagggtattttggggtaaatcgaggtacacaggactatcaacatgagggcaaggagcagaagttgggcctgctggacctgctgaacagcatgaatatctacattaatggatcctactcaagtctactgactcatatagcctttagcctccagagaacatagcccttctttgatgggctgattaaactgattaaaactgattgcagttgcatccaaggttgtgatttacctgcttttgacaaatttgcagttttgctttgattgtttatttgcaatgtgcgttactaatcctccttagcaactcacaaggattggaagtgatagagactacactaacaggttgactccagagttgcatgagtttaatagtgcttctagttgctttctggccaatataagattccaaagcaaaggaccatcttaattgaaatatttttaatatggcagattttataatggtaaatttaactcagatataatctgtgccttgtgaatacaataaagcaacatatgatataaagaaaagagcctgtaagggtagaacttggcagacttggattctggtccctggactcaacctgttcaaccttaggccatttaacctctcactttcttcagaggtgccattcagctctagtattaattctatgattctgaaagcagttgatagtgtgactggaaggagaaatgaaagaagctttttcaattactagactttaaagcttctagttttgacttctaggcttcagtcctcagaatggtagacctgagctgtgtccagtgtttacattataacatatctattttggaaaagactggcacgtgtttatagatgggattggaaaagtacttaggttgttcttgcaaccagaggcccataatcgagtttttatatttttccttagaggtatatattgcaatgactcactgtaagaaacaatattattgctcatattaaatattctttaagtagcttttccacgtcttgaaagaattacgttttcttctaggaaggcagattttgtttttgacatggtggtactcttttttttcaagcgcataatctagttcttttcatgtcagtgaaacttagtagtacttaaaaatggattgaaatagtggtaactagttccacagagatgtttgcctacataaggcaaatctctaaagttaaatctttgatgcatatgtgcatttttcatttcgtattttcggttcctccacaccatttctttgtagtcaaattcattgtaatcccatcatgaaagtgttgatcttttagtaaccttttttgaagcattgtattaatccacattccctcacgataacacacggtttgtatcaaacatatcatgcagcttagctcaggccacatatggaactaataagtcaggcaataagtggctttgtgtgaatgaatacagtttggaagggtggggacatgtgtgtgtgttgtctaaactgcatttctcctgtgccaaaaccgaaatgacacaatgattcctgaatccccagaggctttcctggcctggaaaaattgtgtttaaaaaataaaaataaaattgagcactttgatattaaattaaacctctcagctcaataggaggatgcttactgggtgcaagaacacagcatttatttctcagcagtaaaatcatactacgttttaaatgtgatctccagagctgcaagtggtcttccctcatcaatggagcaacatttatcaagctgcatgaactagttaattccaactgcaagagctgtgacgtcatagttgatctgtcttatttgatgaaacacaaagtggatgtatagtgatttgagaagaaaccagcatgtggctttggaaaaacactatatttttatacaaaaagggggtataggagaggaaaacagagagaacatagacagttaatggaattgacatggccgtagttgtctgttgtggtctgaatgtacttgttgcttgggttttctttctttttgcttgttccggtaactataaagccagatcttcctgggtttttttagcgtaaggattatcttttgctaccagacaatacagtttgttaatttttccagggaaaccactgaacattgtttctccccacttcccatctaacttattatctaagtgtaattttcatcttggttgcctactagccatagagttgaacaaaatcttaattgcccccatggagtcctaaatcaatcaaagtaaagctgaaattcaaactaattgaaaccaaaattccacttaaagactgcttagactgttttggtggtggcggtgcagtaggaagttgttacaaaaggtgtttatttcagaggctaatttgaggcagttatacagacccaaagcaatattttatttgcctagttttcttggcatctgccttccccaatcaaaaatgagagcagaaggagccgtaatgtttagggaagtgtgggattgataatagttggtgagggcaggtgttgatggaacctgaagtaagatttcttagagacaagagtacttcagtcttttagcctgtccatagctgcctttgctgttgtttccctcgttcactctcttgcttaaaaccctggagtaggttcttactgctaaccagcaagataaagttgaactcttcagcttagcactcttagccctcagcagttataatgactaccctgtaaaagtcaggcctcaggaacttctattctctgtaaaattctaattgaactcttacaactatcttatgagataaatattgttggtcctgtttatagacaaggcatagattggttatgtaacttgctcaaagttatacacattatatggtgagaataggctgtgagtccaggcctctcattccaaagacagagagctgattcacattgcctagcttagtggacactcaataaatatttgctgaatgaatgaatagaacgtgtggagacttagtaaatgtagttctttctcccctttccctatccttgtcctttcctcctcgacctggttccttcttttcctttctatttttactaatatcttaccagggagttaacttgttgaagattattgaaatttttaaaagtttgcccaagcaaggaaggagtttgcgtgaccatacagcagagctgggtctttcaccaggtcccctgaccactcacatcatgtatcagtctttccatttcactatataattattttaaagatactgacatgtgtgtgtttattcctgcttctctggagtgcatgcagtcagaagcttaatgaaaattagcatttaaaaaagtgaacagtgtacttaagattttccctttgatttgaagtaactctttccttcttccttttctgccccccattcttagtagttaagtggtaagccattattgaacaccagctttatgcccagcctagtggtagatactgtgatgatgataatgtggagaatatatatatatctggtacatatatatatatatatatatgtattagtaatgataacaggtattttatattgagcacttatgatgtaccagatattattttggatagtctatatactttatcttatttaaactttacaacagctctgcaaggcaggcaacatccccattttacaagtaaggaaatggaatctcagagaagtgacttattcaaagtcaaacaactagtaagtgacagtactggtattcaaacccagctcttctgcatttaagcctatcctactgtgtcgtgatgcctctcatttcttcctatactgtattaatttaacttgttaattaacaagtatttatcaagtacctatccagttggttaaggctttccaaaaagaacaaatggaaaagtgcgtatggggaggagtttagggtcaagggtaaaatgcccacttacctgcagtaatcagagagcttccagtggaaaatggaacttctgttggttctttgagaatagataagacatgagatataggatgcctagagagagacatagagacaagaaagagagctttctgccagagtaatgagtactgtgtaaaaagctatcagaagagttgttagccagtattgaaaagctggttttttatatataaaatcccatatatatatatgagacttttatttgtttgtttgcttggagtcagagtctccattacccaggctggagtgcagtggcacaatctcggctgactgcaacctccacctcccaggttcaagtgattctcatgcctcagcctcccgagtagctgggaggcgcacaccaccacacctggctaatttttgcatttttagtagagatgaggtctcaccatgttggctaggctggtctcaaactcctcacctcaagcagtctacccgcctgaatatgtttgtttaagtcacttctctactaaaatgctactaataaggttaaataattttaaaattttaaattcacaaggatgaaaagaatagataagaccaagaaaatttagaaaacttcaaataaacgaatgagtgataaactgacttggcagaagcctttacgaagcaatataatccaaaccacagactccagaaggatgtggtggtaccgagtatctcatgaagtttagggataatatatagagctaaacataggagggtaggttgacagtctatagaaaaagaagtaatactcccagttcacttttcccactctgtgtagcccaataactacgttcccacatgccctagtgggaaaatgaaggtttacttgctgaaaaagattgagcccaagaagctctgaacgtaaactgcttgatatactgggaacaagaaggaaggtgccttaccaaaaggtgattacgtgaaagtgtaacataccaacacagagttccccaactgccttttccaactttattccccaaataagatccagattatgcctcaagacagaggattctttctgaggaaaaaacagaggcagcaatgaaaagtcctggggctgtagtactaacctttccccgtgggaaggctggatttccatccactcattctgcaatgaaccctccccccacagccagtcatcaagcactgccaatgcacagacttccttcacagctttttagagtctcacagtctcacctgtaaagataaactaacggccaaagattacgagacattagaggaaagcctctaatattaaaaaaaaaagtctaaaataaagtgaaaaaaaaaatccagagggtaaagtgaaaaaaaaaaatccagagggtaaaatgaagaaggaggaggaggcaaaataataataataggagaaaatgatcagaattaggcaataagagtattcatattgaaaggatgtactaagtgcttggcccagggaatgaaaacagactgaaaatgatgaatgaaagaccgaaatgaaggcttatcactatgaaatttcagaatactaaggttaaagaagaaagtcctaaaagcttccagagagaagaatcaacttacattcaaaggatcaggaaccagcatgttaacgggtttctcagtcaccacgtgaaaagctaaatgacagtaaagaaatactttggaactacctaagaaaaagtatttgcagccatgagttctatacctaggcaaactatcattcaagtataagaatggaatagttatattttcaaatattcagggtgtcatgaaagttacctcccatgctatcctttcccagaaagatattataggatacactccaccaagatgaggcagtagatcaagaaagaagacaatctaggaaataacagcttcagcacagaagaaaagtaaacaaaatttccagcatgatggctaaagaagcttgtaggaatataatgcagcaggcctagctagcagccagttcagttgaagcagagagaggaggcttcaggaaatatatctctaagagcaaaatggacttgatcaattttatggtgtgtttagttagattgagaagagttttaaggttttttattctatttcttttttcttttctttttttttttttgagacagggtctcactcttatcacgcaggctggagtgcagtggcacaatctcagctcactgcagcctcaacctcccaggctcaagcaatcctcccacctcagcctcctgagtagctgggaccataggcaagcaccaccatgcccggataattttttgtacttttggtagagacagtgtttcaccatgttgcccagactcgtctgaaactccacccgcctcagcttcccaaagtgctgggattatgggtgtgagccaccacacctggccagttttaagatttttgttagagtttggggagtatctagtgacaagtacatagaaaagctcaactggtggaaaaaatggcagttatcacttccagtgaaacaaacaaaaaagtacaagaaaggaataatacattacatggctcagcagtgaacagtgtttatgtaggtatagtgaggtaaacagtaaatattgatttaatttaaaatatgatattgaatgtattgagaagatgaggaagggaactatgtgtgggagagtagagtcaagttctcatattctttaagaaaaagctagtagataatgtatgggaaaggggataaagtgtttgtgtgagagcaaagtggtataagagtgctaaattctcttctttcatggtgggagcatagtagatgatgtctctaactggaggggaagggagaataagaaatcttaatataagcatattattcagaaatatgaggtaaagaagaaacagctaaaaggtgttctcagagtttggggtagatagtagagcagagaactgctttttttttcattataaatcttgtagtggtttagacttgttaaaccatacttatactttattaataataatatatgtgttatgtatgcatttatttttgagttccctatgtggaaaattaaaagggtaatatggtagaatttggagctgttattaagcggttctagccttggctttgtcccttatcatccctgtgactttgggcaggatgctcttgtcttcctgggccttagtttcttcatttataagaggaagaaggttggaaagatggtctccagggtctctttaagctgtaaaattcaaagattctatgatttaaaaaaaaaatagtactatgcagcaaatggagagttaagacccagacagaggcttgaaattcccacatttttcttttttttggttaaaatcagacttggagagaaattttcactgtggtctctgaaaacagttcaacacccatcttccgttgtggaacctggggcaggcaattgtctgtgtactcactcggagacacatagcttagtgttatttcagtaagtttttttttttccttgatgtttaatatttttcggtatgaatcacaggtaaaatttccatgccatgtgtaaacgatttcacttcttattgaaacaatgaattcaggaacgtcatgttgggatatcagccattttgcttttatcaatgtatggaaaaatgcatttatattaatacaagaaatgatgtcatttaatatggggtagatcttataattcaaggtctgcaaatctcaggaggtgatttaggtcaccaagctaggtttgaaaaaggaaaaaactattttccttctgctttctcaagtattgttaccagttttcgtctcagactttggggtaggtggtagagagtagcatggtttgtgaaaaggaggccctggctgataatatctttgccattgaaccatgcggccctggataatttacttcccctttctggggttcagttttcccatctgcaaaagaaaaggattggctgaaataatattcaagataccttttagttttaacattgtatgtttctacatccttactttatgtgtgtattcattcaaaccattcaggagacccagttatgtttggaggtttttcttaaaaagcccagaatcagtgagagtgaactctttctctaagtatcactcaagcagagaaaaatcagttgaattctagagtcaaacaaaagaaaactgactgtttttagtaggtgtttatttatgccccctgttgtcttactctgaaggcctgctttctattcacatgatttgtggttttattctttaagagagggatatatttaaaagtttgacttagccactcttaaatttaagtgctaaaagagttaaaccttaagaccgatgccccttcacatttgtacacagacatacattttataaagtctataaactttcttcatgtgtaatatgtcatttgaaaaacacatttttgcagagctgtgttgtccacttactgtgtgtttgatgtgtggatgagcatgtgtgagaatatgcacatccacttacttcggctctcctttatggtcagttacggaagcaaatggtgatactcagagacacagtgaaaggaagtgaagaacagaccgatgaaaaccattagcaacttatccagagtactcagaaggacacttaattttagaaaattggcctctaccagaaataaatcaaacaaagggcagatctagcccacaaaccagcagtttccctgtaccacctctccagctatgtgctctggtctggacaaagaggaacgttagagactcaagagaaatacagagcacagcctctgtcaaaagtgagttgcaatgtatttgtttaataagcattgaataagtaccagcactatgccagacactattggagtcagagatgaatacaagatggtccttacccttgtttatacaaaggggagggctgaatggaagctggcaatatctaaaaagaaacactggttttctggtatatgtccctggagttggtgttagcaaaccctaccagggtctgggggtagaaaagaaggctagatacaggggtctttgaaatatcctcattccacagttggtcactcttagtcttctctaagtttagggggcaagagaacagtaagtagatgaagaggctaccttaaataccatcgtaatttaagtgggtgtgcatactcatacacgtgcttatctatatgtcaaatacccagtaagtggaaagtactgtgaggctgataatagtatcaaacatttacatttcctcttttagagttcaaaaaaataacttgtttagtggttcatttttccgaagcttataatctgccaaaatatctttaattctattttttcaccttcacagctaagatatcaacatggactagggactccagacttgcggcaaacccttcccaacctgaaaaacttcatggagcatggactaatggtcaggtggtgagtacctttatctctgataaccagaaactgtaatgtggataggatcctgaaaatcttttctgacttccacattgctccacacctgcctctgagttttcttctgtaatgagatatgggaggaaaatgaaaggcgccatcacagttggggagatctaagctcccgtctggctaaggaggatgtagcccccttggagggaggaggggccaaggggatattgcttgaactttgggaaggtggctgagcaaggagcccttgagggcattgctgagacaaactggaagacagccagtatgattcatggtaagggagacccagagccccttggacctttccaaagaacaggtgaagggcctgattatagaatgagcatcaggaccatggctgtgagcattaaaggaagaaagcagataaggaataggtcagggggtcaggacttagtttgagaccagtaggtacattctgaaatgtttcttgtgtgtggtgtcagtacctgttgaaccgtgagggcaagctgctgctgaaagtgctccgtcaggatagacatggacctttgaaaagagaaggagagaggggaagtctgatagaaagaagacattagattcattcacttgacctaaatggaaagttgttggctgtatccatttagtaattcttgaagtttgaatccttgggtagtgggcagtaacttacaaaatcacgtgcctggaaagcaggcctgtagagttagacagctgggggcagcactggcttctgattccaggtatttttctcatcatctgctgtgtggatttgaaattctacctctctgaaatttgatttgctctgctgatgtgccttcagaaaagtaaaaaaactgtggttggtctttactttgattttcaaaacggcaagttccagatgtctggtcttagataggactcctgttaagcaaatacacaactgtttaaagaattccactcaaaacatcaaaataattattaaagcttggtgttgatatggacccggatgccttcaggaatatgagagaggaattaagttttaaagtaaagtaataagaataataaaagtgagctagcaggtatttatttagcttgtctctgtgtaaagctctgtgataggtgctttagagagatgagaaagctcaagccctgtccccaagagatttgtggtccagttggaaacaaggcacagaattcatgaagaggttttctaacacaatggtaaataacctaaaataatgagaaaattggcaacctacaacactaattaatcacactaaatgaatcttgctcagtacagatagcagattgtccctgaaccatttactgaagtgtctgtcttttctccactgatgataatggcatctcttttgtaaaccaagttcgcttatccatagagatccatttccaggatccctattctgttctgttgctttatttggctagccatcgattagtatgacatttttaattattgtaagatgtaatttctaaaagtgttgttgagatttgagaatgaaataaaaatcaaaatgtccattttactattgataaagctacttggaaaatggggctttagatctgaaataaaacgggcttgcaaagatgtcactcaaaattgaacttatcctcataatcacaatgtaaactggagagccataggctttccctacagaggcaggcccttaactacattggcagacagcgatcaggtgacttttcttcaggagcccagatagggctgagccaagaatacccagttgctattttgccctctagattcaccaatcaggaaagtccctcctcctctgagagagtgagaggatggagagagccaagagtgttaactcctaaagccatgttccttcataggaacagaaaaggaaaatacctccaattttcttgatatctgttagggaaaagctaacctccatatctgttagggaaatatctgttagggaaggctcttcttcaaaactcttggcttttcttgacttgagtctttgagtgatttcacagttttatgacattgggtcttcctaactatgaacatgttacatcgcttgcttttttaaaacatacctccatgaggtttataattttcttcataaaagtctatgcatcttttattagatatacttagtcctattagcttacagttttggttgctgttgtaaatttttttattataatagttaacattttctggctgatgtacaggaatagcactgatttttagtattttgagagtgtgttctggctaacattagttacaatagtttgtttcgattctcttggattttttgtgtatacaatcatatttttagtgaataatggtattgtttctatttttataacttcgttactttttcttgtcttactatgttttattacagaacaggagcagtgatagtgggtatccttgtcttctgacttcaaagagaatgcttctaatttttcaccattaagtattatatttattgtagattggggtagatatcctgcattagcagaaggaagaatttttctgttctcaggttactaagagttgttttttaatcatgaatatgtgtattttgaattttaccatgtttattctgaatctgttgaggtaacactacatttttctaatgttaaaccatctttgccccctggtcatgtgtattattttttcctacattattggattccttggctaatattttagaatgtctccatctgcaaactgaaatgagactggcctacagtttttctttcacataaaatccttgtctgattttggttagaattgagcaaacatgatgaggttataagagcttcataaaataaattgaggatctttaccttcttttctattctccagaacagttcatataagataggaggaagtatctctatcttaaaggtatggtagaacctagaaaaaaactactgttttttgtttgttgctggggagagtgtagatttttaactactgatttaatttctgtaatgcttacaggtctgtttctgtttcatttctccaattcctagttaactcactccagtctgatttttagttctatgagtatactgaaattccttttatctagcttggtgcctaccgaattctaaacatagacccaaactcaaaggtcacttttcatccttatcctgttcagtggcacctggccttgctggccattcctgccttcctgaaacactcttccttgttatcttccacaggactgccctctcctggctttctgcttctagcttctccatggccccatcttaggccctcttccctttttctctctgtactctcttctctttttttctttcctcctccgcctcctctctaccctcttcttaagtgttctcacccattcccatcattttgaaagctgttatgcttatgactcccaaagttttgtcttcagtgtaaacctctcctgcacactctggatagccaggggcctacttgactctgcccctgggagtattagaagcatctcagcctcaacacagctaaaaccctccttccaccagcataattcctgtcagctaatgggaccctgtctacccagttgctcaaaccagggaatcatccttgatccccttcttttctccactcacatcagagctaatcttattcatcagcaagccctgtcatcactatctgcaaaatacatatcaatctgttcacttcccatctctgctattgccactccagtccaagccaccaccttttcttacccaaacagctgcaccagtgcaatttgtctccttgtcttgtcctgcctctgtccactctccaaagtagccaggatgatctttctaaatgttggctagatcttaatcactcttcagcttcagtggcaagagtgaaatccaagttttcttccatagtctacttggcctctgcctcatctgataccactccctttccactctcacgtcctgtcgctgtactggcctctgtgtagtcatgtgaataagctctttcctgtctgagtggttgcactcactcttcctctgtgtagaatgtgctctgtctcttccttctttcctaccaccttcctcacctcatcgcctcatagagagggaatagtttaagaaaagccgctttatgaacacagcagctttattggcaatgaataggcaccttggctggaatgcaaattcattttaagaatggggagaatctgggctttgtggttccttggcaatcctttttaagaaaaagaatacaaaattacaaatacaaaattagagatgaaaaagcatttggaatgagaaacaaatcacaacaaattactggaaccttagggattaggtccttttcttctgagatgtctgtagacaatttactcaaattatttacatataaatgcttcctcattgcaacctgactgcccttctactcctaaaacactgtaatttccagcaactctcagttctaaggtacggagaaattaattgactttccaggcataattgacccatgaacctgtagcaataaaagtagaatctaggtgtcctggcactgttgcagcaaacccattaagctccaagctcatacatttataaatgtagtgcccctctgtgccagctgtgccaagcatattaacactgagtgaacaggaatgtgtcactttatggtactgtaacgtaaaataggctactaaagtagatgcaaagcactgcaaaatgaatgctacatatcagttccaagtaaagatcacggcaggaagccaggctggaagtcacaaagctaaacaaagccggagcaagcactttgagtctcagaggaaatctgagaatttccgagagcagccgtggagtgaggagttacctctcaagcctgtgctccttagggcaaagggtaaaaaaactcaggttcctaagggaggctcttacatcttttgtaaagcaaaacacttccattttctgtgtggttgttaccattcacagattggtccctgtggaggcagattgctgtatgttcttttggtgttgaggatttcatactggctgaggatcagtgcattcactgaattcctccttatggtaagcttcaaagttatgtgacagcttgttttgttttattttgtaaagaaaagctgtgataaaaatcctcttaataaagtaattctttttcttgcacagtatggaattcttagctaatatgagaatgatcgacctgattaatcctaaaatgaacccccattttttatgaacacagttgcacagggcacagctctcagtgatttatgccaggtctttccaaaaggagtgcccattttttcatcctaagattataacctagtcgtaactgccaagcaacacaattttgaaaagcagaatttcagcttagaatctgtgctcttttgaatactgtgattgaaagtcaccagaatgtcatttaaacatcctagttttcttttactattgcctgcatagtgatctgagactcagattgacatgcacaggcaccactgatgtgggtgctgaagaatgtgcacctaagctgcagcctaatggctgcctgtaagacaacaagtttagaactgagttgaagagattatgtgcgaggttgctgtgagtgggctgtgtgatggggccccagcatccaggtcctcaggcagtgcctcgattttgtctctccaccactctcccaccctttctcaacagacccccaggcatagcactctcatttgtgacctccgttctttacttaggcaagttcccactacccagaatagcctgccccttcctctgccctatccagatgttgctctcacttcaagacccagctcatatcctatctcattcattcactcactcaacaccacagtggcagctacagagataagtgtgtattccctcagtagcttagagtcacttctttgccgagtcttacccactaggcttttgagcagcttgggtctggggaccacgtcttactcatctctgtggtcccagcctggcattacagaagccagggaggctagagaagggaatgaagaagccatctgagctgttctactcatggaatatgctccttgagcttgtgttcaaggagcttacagtctaattaaggtggtgaaataggaacaaaacaacatgtactgaaaaaagtaaaaagtacgacatgctataagggagagttattttgaacattcagaggaagccctttagttcccggtgtgaggggtgtagacaaaccttcactaaggagataacatttcagtggagagtggatctggagcaaaagaagaatttggccacatgaggtttggggtataggacagagtaggttaagaaacagtggcccagttaggtggaaagactaggactatgaatttgaataccagcaccactatttactgtctctgtgacctcaaacaggtttaagctgcctgcctcaatccctttccctataaaatgagggtaatagtgcgtacttaatagtgtggtcagaagaattaaataggtaagtacctagcatactgcctggcacttagtaataaataagcggtagcttttataatgagtaaatgaatcgtagttactgtctatatctttttaaaatcaaatgcatcctttgctgtaggtgtttttactttgacatctatagtcatcttacagctaggtatagaatatggctcttgttcatattttggctcatgctctcttgtacattaatggtacggaagatttaccatctgtctacctctcactttccccaagtcctttataagaccactctgaggccttagagataagtaccctaaaacctgtttgcctacaaactttttttggtacctgccttcttaggtaactctcacccatagttagaagttacgaataataaaatctcttacttgcaaaactttctatgtttttacttaagcttgcaagaaccttgtgagagtagctgggcaagaagaatgaccactgttttacaaaccaaaaaactgagactcagtgtgccaagcgccttgccaagatcacgtgatactaaatgatggaactgggaccagaaacccagattatctgactcctgatcccatattctttttaccatatcacagtgcccattattgggtaatggccattctcttccttctctgcccttcccctgccctcctgtctctgtgccacctctattctagtgcctcctaccttcctcagggaaacccaccagagtcaaatccagagcgctggaaagatacactgcgaaatcaggcagcaggcctggtggaaacattcctggttgtttattctacctcatttacctccaagagggaggaaactaaaagtaataaaactttgggaagaatttaagaactttaagactgaaagaaacaaaaatgatcacgtttcaacttcattggttaagaaacaggaacactgaagaaggaagcacgtgggtcgggtgagtagcctaaagcatatttgcccgtagtgtttgtggaatgcttcctggaatggcatgctctttttttctgaataagaaaaaggaagaataagaataagatgaaagcaagatttcaaagccatctgtcctgtttttttcataggatttttttattctaagtttaatttttcctgattatagagcttaaactatgtaacatcttcatgcaaggtagtataacacagaggaaggagcactagatttgggaatcagaaaatatgggttccagtttcaacgctatcacttaattttcataagttgtttttgagtatcagttgttttgttttgttttgttttgttgagatggagtctcgctctgtcactcaggctggagtgcagtggctcgatctcagctcattgcaacccccacctcccaggttcaagcagttctcttgcctcagcctccccagtagctgggattataggcacgcaccaccacgcccagctaatttttgtatttttagtagagacagggtttcaccatgttggccaggctggtctcgaactcctgacctcgtgatccacccgcctcggcctcccaaagtgctgggattacaggcatgagccaccacgcccagctgagtatcagttctttaaatggagttaataccaccagttattgggaaactatttcccaagcatagtttttgtaggccaaatgagataatgttcatcaaagtggtttataaactaaaatgaactgtgcaaagtattattaagtattgtttttgattattattaagtattaaagaatttgacaattcattaagtgtctattctgcgtatagcattgttcaggagacaaagaaagattcaaaagtgtaagattttccctgccattgcttagttgacagtcgtttagtttataatctaaattattagataagacaaatattttgaaggacatgacttgcaggaatattcctatacattgttcactctcgctgtcatgtgggacttacaacctgaggcccatcattagtgtgtagtctgctacaatgatggagggcaacgttgggccaacttattttgttttagggccaagcaagccatttttaaagagacagaatcaatctcagtgaccttagtaaggatagagcactgagaagtatccttggctgttcaacagcaagctagaatatttctccagagtactttagtgtttaacaaacaccggtgtttaatgttgggagaagtaactagtggctttatgtgaggccatcccattttagtggtaaaatctccagatagtccttctgctgacctatttctaatgtagtcttccattccttttggaaaatagaatcaagctatagctttaaataaaagtattagaagaagaaaatacctaagaactttgacacattttaggaaaatgttttttcagtaaactgagaataatgaaaatttagaataagtgagccaatctactttccttaaaattgagtaatgatatggtagttctgcttttacaccaaaccacttaactcttgaaaatgaggcagtatccagtatttaaatctttacaaagcctcactttttagaaacagatctactctcttcctttctgtccatcatccttatgctgaattcagaactgaaatctggcagatgaccctctagggaaatgaaaaacatgttgtctagctgacgttggtttttaaatttagatcaaataacattgtctttgaagtctcaagagtcctacttaaggtagctgtatcagataggctcgcctttgagagcatttcttgcaggccggcacccctaatatgaaaagttaagcctagtcaaaaataagtgaaaaagaaagttttattggagttattttctctaagatagctgtttcagaagaaccttgacgagtcatctccttgtctctagacaggaacacacaaggcatatgggtatctgtagtattttaaaagaccttaggggaccaggcttcttccataactcattccagagtttaaacaccctcacttcaggaaattcttccctatatttaactaacaggccccctcctgcggttaacacccatttccacttttttctgcctccagtcaggatggagaacagctggccaacatcctttgtgcactaaccctccactggtgacagaaaggcacttgggtatcccggcgccgcctctcccctactccagcaaccaagtctctgaaccaaattgagagctcttttcccattgtttttacttgggtcttctttatttctatttactccttttgattataaaatagtatgggctcaatgaataaaatttggaagttgtaaaaatatgcagaagggaaacaatagccccataattcaggcacaaaaaaatcactattgtattagccagttttccttgtatttcttttctaattcagatcttaccatctgtaccaacacttttcaatagaaatataatatgagccatacatataaatttaaatattctggcagtcacttttttttttttttttttagacagagtctcgctctgtcacccaggctggagtgcagtggtgcgatctcagctcactgcaagctccgcctcccgggttcacgccattcccctgcctcagcctcccgggcagctgggaccacaggcgcatgccacctcacccggctaattttttagtagagacggggtttcaccatgttagccaggatggtctcgatctcctgacctcgtgatccacctgcctcggcctcccaaagtgctgggattacaggcgtgagccaccatgcccggcctggcagtcacatttttaaaaagctaaaaataaacaggtaagctaattttaataatatattttatttaattcaaataaaatccaagttatatatccaaaatatcttgtagacatgtaataaacattttaaagattattaataaatattttacattctcttttttcatactaagccttctaaatccagtttactcttgtagcacatctcaagtcagactaaccacatttcaagttccagcaaccagttcctagtggtcatggtggacagcacagtccttacagcttttttgtataacgtaatgtcttaagtattttatcagtgccctttaaaactttttagcatcatttttaatggctacgtagtatttcatcatttagatttactataacaatatattgaggtagttgtgtttttctcaacacattgccaaaaaacatcacctaaatgtttccttttgcacacaactaattaaattcatttatacataaaacaagtatattcactgaatatctgtgtgctctgtactaagttatattggaaagcggaagagggggtttccagaaataaagactagatccctcccatatgctgtttacaagacttggctccacagttggactgcacacaaataccgtattttattctgccttaaatgcccttcccttcatttcttgctctacctcacccccaacacacacgtacactgcctggttagcttccacttatccttcaaggtgccaatcaaatacaacctcctctgatgagtcttcccactgattacttgattcccttcttcactgtaatatacaaagtgtgtattgtattcagagcaccatggtgttctggttattggttaactctctgtcttctctactagagtgggaactccttaatgataggaatcttattttatacatctctttatttccagagcctcaaaaactgtcaggcaatgaaatgtggatttcggtaatgtctgaaagatgtgttgaaaatgcaagtgatcacattaagcatcagttggatggtaacataagtactaccttcagagttcaaagagatcacttagattggcatggttaaagaagacagaatgaaggagttaaagaaatgagttaaagaatgaatgagggccgggcacggtggctcacgcctgtaatcccagcactttgggaggccgaggtgggtggatcacctgaggtcaggagttcgagaccagctgaccaacatggtgaaaacccgtctctattaatacagaaagttagccgggtgtggtggtacacgcctgtaatccaagctacttgaatcgcttgaacccaggaggtggaggttgcagtgagccaagactgtgccattgcactccagcctgggcaacaagaacaaaactccgtctcaaaaaaaaaaaaaaaaatgaatgaatgaatgaatcaatgaggcctggcgtggtagctcacacctgtaatcccagcactttaggaggccaaggtgggcggatcacttgaggtcaggagttcaagaccagcctgaccaacatggtgaaaccccatctgtactaaaaatacaaaaattagccggacgtggtagtgtatgcctgtaatcccagctacttgggaggctgaggcacaagaatcacttgaacatgggaggcagaggttgcagtgagccaagattgcaccactgcactcaagcctgggcaaaaagagcgagaccccatctcaaaaaaaaaaaggacttgaattgggttttagaagatgggcatacttaaatgaattggagagggaattagtacaaaagccactgagataggcacactaaaaaagcagtgcttttcagtaggcattcattagcactggggtccccaaccctcggccatgtaccagtagcagtccatgtcctgttaggaaccaggcctcacagcaggaggtgagtagaggatgagcgagtgttacccctgagctccgcctcctgtcagatcagcagcagcattagatcctcataggagtgcaaaccctactgtgaactactcacgcgggggatctaggttgtgtgctccttgtgagaagctaatgcctgatgatctgagatggaatcgtttcatcctgaaaccagcccccctgcccacggcccatggaaaaattgtcttccatgaaaccggtccctgctgccaaaaaggttgggggccactgctttagcatatgttgataagtgtcagtaaataagtatccttctggatcgaatgcactgtcctaagtttcaagaaggcttagcaatatggtctttgcccatcaaaagctggtaagtgtcagcagcattagaaatgagcactggctgtttcagtatgaccttgggtgccaggcatgggaggtattttttgtttgtttgtttgtttgttttgagacagtgtctcgctctgttgctcaggctgaagtgcagtggcgccatcatagctcactgcaacctcgaactcctgggctcaagtgattccccccacctctgcctcccaaagtgctgggactgcaggcatgagccaccccgcccagctgtgacctttgggtttaagctcgatttagatataattccctgtgttttgttttgttttattttgttttagcctctggatccatctgaggaaatgccttgtgttttaattttaaagagtttaaatatcattttatatgatgtttattctataattcttctcttaatggatagcaatctataataatagttaatatcattgtagctaatatcaagtgactattactgcaaaccaggcactcttccaaagcactttgaacatagtattcagttaactcatttactcctcacacagccctgtgaattaggacctactaacctctcccatcttagaaatgaggaaactgaggaactgaggggttacataacttaatgtgacacagccatcaagtggaagagctaagatttgagcccaggcagagcagttttagaagtcctgctttaaccattacatggacaacctctcctataactatgttaagaataaagtgttttacacaagggatcatttagcatctggtgattccagaaaaggaatcttgttattacagccttctcctggttttcttcattcctctctgaatgctccttcttatctcattcggagggtcctcttcctctacctcatcacgaaaagctggagctcctaaaggcttagtcctaggcccttttttctctcactttattctaagtggagataagttctgatatcagaaattgcctcctgtacattttcacagcacattctaagtgcccatgcgtttttctaccagtcttccatcccagtcacgataagctctttgctttctgcgaatgaaaccacttttcactcttttacactagccaggaagccaggcaaaaacctttgttcctccttttcttcctcacccttatatccaactctggcaattcctgccaatttctcctgctatttctgtttgtctatgtctgtacatttccattctgatccatgcctccattacctttcacctgtactactgcacagcctgcagtctcccaccatccactctggacccctccattctgctctcccaactgcagccagagtgcactttccaaagtataaatgtctctctctctctctctctctgcacctctgacacacacactcactcactctcacactctctctcgctctctctctctctcgctttctctctctctcttctttgcctgaaagttctaaacatggcttgtggcttctgcatggtccagactttgttttcctcctcagttttatcttctaccatagaactcttcactcattgaccttttgggtcctcaaacattgttatctttcttgataaaaggtcttagcaaatgctgttcctgctacctggaagatactcttccccaccaacccattctttacctggtgaagaactctactagcccttctaatcttgtccttttctgtctgggtcagatctctgctacaagctctttgagcccgtgtcctctcctgcatagcttgggtcagaggtggttgtttgacattgatgtatgtgatgtatgtgtacttgtctgtcctctctcactagacaataaattccattaaaacatgaaccatggcttttttccaattattatagccccagagtctagcgcagctagatactcaatacatatttgaataagggggtaaatcaattaatttgttttatactctgcctcctttaggagtataggggactacaaaagataaggttaccaagatgtcatctctagagtcccagtctcttactaaacagtaattaaattgcggcaaattgcaactcaaacacttctgcccaaggcctccagcatctctgaaaatggtggcagagctatccatttttcttttaaagtaacaaacaactaaaccctcacagtttggttcagtgagagtttattagagagctgatggtaggtcagtgttagtagtatctttcaaagacttcatctcacagattctgtcactggccctgggagtctaatgcatcctttagctcccttccaagtctagtttttaaactctgaaagcattctctgaccagggttttaatttccctatcgagttccttctgggggctgggttctgtgagattgttgttcctctggtttccctggcaaaggcagaggttttgggtttttttgtttttttttttcattttttccctggttttcagcataaacagtttattattcccaagtatcaagtgttgtccagatactccgaggggtccccaggtatcattcctggcatctctttcctgttctttccatgttctcgtgtaggatgttacttaagccctatataaatgacatcaagatgggctatgtctgtttctacagaccattttacagtcctcataatgttggttgcctgactgtgattttactacattaatttgtatgatgatttcttaaagtgaaagctgatgagtgaagtggttgacttgacccctcccaggacctctctttatctccgtggaggatcactgtgtattccctgatcccatggagctcagcctggagcctgagctggcctccagatgggctctcggcaataggcaccccctcatcctctgtccactggcccaagctgggccatggaggcctgatggccaagacctcacatcacaaagcctggtgaactggatttcttcagcttgcttattttgtcttttgcctgtggaactttctctttcaccaattcatctttccatcactacttggtttaaataaaatccaaaggctgccttgttcagttatacctttttatactctgtttttatttagacagactttggtaggaaaccttccaagcaaagccccgggggaaaagtgaccattggcacagatttcagcctgtgcttttggcccaatattgtttctatttttattttgtttcatgtttttgttaacatccagggcaaagattaagtacttacacttatctggtaatggtgagaggcctttggattgcttgcctgtggcctggagaatgcatgcttaaaactattaacccccagctacctcctgggagataagatctagctgttaaatttggctttccctaaaggaggttctgagctcctacttgatctgagagagggaaagaagaaggataaatcccaacctttgctgaattttgaaaaaaggatagtagcttaatttatgaaggttgtttttttgaaaaaactaactttatgtcataatttcttagctgccaaaagacgtaattctacctcagctttgccttggcaacccgcttttggcactctgtgcaagcctgtcgttgctctgcattatttaagcagtaatctttaagaaggtgagaaactattattgctttttaacacagttgacatgatattggcgcagactagtacctagagcttcaaacatttctggtggccgtaaaccaacttaaacacctccatgtagaggtctcactgccatgaggtcatagattgctacaaggagggagaaagaagaagatcaaatgttgtttaaaagtctttttttttctttttaaatattcttattccactgagttgtagctgtagattttggccgggagccagacaatcaagatttagtattttgaccagctgtgatctagtaatgtccctcagaggaaacattttgtagggagggaaagacacatatttgagactgtgaattgtactctgtcctcatactttacagtgtgggacctggttgtagacagataaaacaagtacaagtgaatctgaaagagaattaggaaaaaaaaaagtgtttcaaattgttaaagcctcaccccagcttcaagaactctcttgatgtggtaaatctttacatgctttctttatttcatttttcctgtaagtttccacatttacatcagttcgtggcagaatttatttctgctcatagctgatgcttagaatgcctaacagtataagtcttagaaagtcaaaagagcaacacaaacttaatgtaggcaggaagagaagagaaggaaaatataccaatccacttaacctaaaaatttttctcattctcaccccatcctcaagtagaagtagagatcaaatgtagatgttttggtgacaacaaaaaacttaagatcctagggactgggagagagaaggaaattaacaattaggtagaccggcttggttaaatcacatctttctacctagtggcttcatgacctttggtcaagttacctaacctctgtgcttcagtttcttcatctgtaaaatgaggatgatgtttgtaatacttcacagagatgtcataaggattaaatgagaccatgtataaagctgttaacagagtgcttaatccatagcgctttataaattttagttgccgttttattattattaataatttattgggtacttattcattgtactaggaattttacttgtatatctcatttaatccttactgcagtaactattggtagctataaccatttcacagaagaggacacctaggttgggagcagtgaggtgcatcatcagtgtctcgtgtttcctaacgatggagctacatgtggagctctggaatattacctatgggagatgtggaaatgggaatcacattttggactggtgctttcttaacttgttttctctttcccaatctcttttctgtaaaaggaggctacagcttcaggcagtaaaaccaagaggaagaggagggaaatgatgggggcaaggatggtggagtagaggaaactgggctctaccagttcctgggttggcttcatggcaaggtatttgcatggcaaggtatttatataatggttataaaagtgctgaatatggtcttcttcattttagtcagagaaatagagaatttctccctcttaaaaaattctctcttcctgaagctaaattcatgcagaacaaggatgcatcaggggtttggggacaattggaatgtacctcaaaggattctgggaagttcttctagtccctaagcagtaggtagatcatgaaaacagaggaattttgagcattttgactttattcaaagctttccccacctcatgtccccaagaaaaaaagaaaaaaacctaagattgtgtttcacattgaacagattaaatctgttgattgatttgggtctttttctccaaatctcttttatacttttttttttctttttttcttttctttttttttttttgagacggagtctcactctgttgcccaggctggagtgcagtactgcaatctcggttcacgcaacctccacctcctgggttcaagagattctcctgctctcctgcctcagcctcccgtgcagctgggattacaggtgcccaccactacaccgggctaatttttgtatttttagtagagatggggttttgccatgttggccaggctgatctcgaactcctgacctcaggtgatccacccaccttggcctcccaaagtgctgggattacaggcatgagccaccacacctggccttttttttttttttttttggtgggcgggggagtcttactttcatccaagctggaatgcagtagcatgatcatagctcactgcaagctcaacctcctgggctccagtgatcctcccacctcagcctccctaagtgctgggactacagacataagccaccacgcctggcactgtacttctttatttccttcttgcagctagctccctgatgtacagaagtggaggtgtgggaaggtaggtggtaggagtttcgtttgttcctgcttgaaacagtatgctgtataagagaaacagtaaagggaaggagatttagattccagtccttcttctacctattaccctgtgttcctgtgcaagacatgaatatgtctgagtctcagttgcgccttctgtaaaatgagaataatacttggaatttgaagcctactgaaacgaatcataatgacaaccaccacaattacaactactactgacgctagtgtctatgccaggcatcctgccaacgattttaagcacattattttatttattacttactgtagtcgatctattttataaatagtcattaaatatgcccacagtcatataactcaggggtgcccaacccccgggccacagacttttacccgtctgtggcctgttaagaaccgggccgcacagcaggaggcgatggagggtgagcgagcattaccccctgagctccgcctcccatcagatcagccatggtattagactctcataggagcacgaatcctgttgtgaattgtacatttgagggatctaggttgtgtgctccttatgagaatctaactaacgcctgatgatctgaggtggaggtttcatatccccacccccaaatccataggaaaattgtcttccacaaaacgggtacctggtgccaaaaagattgaggagcactgatataactaataaacgaatgtaaccttaagttgtaactccatataggtgggatcatagtggcagagctaagagtagaatccaggtctttgaacagtccttcttgtcgccactgtctctagagctgaagagataagaaaagatagttgattgcaataaataaggactcacagaatgagaaacaaattaatcatcttaatttagagagctcagagaaaacttgatccaaggaagccaaactgacttcctccttgacatctaaactccaggccagttggcttctccctcatcgtgccattgtttgtgaccccaggaaatacttttttacttatggcaaaaggttaacagtccctggtgtggttcagttattcaacaagctacactgtgtttcactaaaccatagcctagtaaatttgcaattatgatatctttgggttgttgttttttaataaattccttttaattgcagcattaaaccacagatgtcatgtttccagtttggagctaagcccagctggaagagacagccacttacgggaaatggctggtgaggagaatgtgtgcagtgaactggtagactcggtccagttgcttgaacctcaggctctgcacccgcaattctagtgcctccgaacacacggggccccttggtgggagcagagaataaagaaaagctactgtgtttcctaatatgtccactcctcccaaaacacacacatttttgcttttggttgtctaagggttgaggctccctgtaagtttttcatcacaatataaataatgtactaattgcatatgatgagtaaattgtcaacagcctttaaaaattggtcatataattagtaaatctatgagtttcaacctcttcatctagatgaaatagtcatgaagccagactgtaatcaaagaatcttgaaacctcctgaatattctgttttgaactattatttgccttttcaattcctccctttctctctttaggcaagagtagagataaaaatactcttttatttctttaccttatactaaaatatgaatgaagggtctttctgaaaaccttccattaaatataaaatcaaaattattttattaaaaatctatgcattatgtttttatacgagatgctcacagcagtttgttttttaatagcaaaggttcagaaacatcctaaatctacaaaagtaagggaataattaagtaaattatgatagtccattcagtgaagcaaccatttagaattctgcttaccaggaggttttaatagcatccaacagcaggatgtagcattctgtatataccagaaacacagctttagtgtttctttcttgtttcctttttttttttttttttgagacagggtcttgctctgtcgtccaggctaaagtgcagtggtatgatcacagctcactgcaacccaggctcacgcaatcctcccacctcagcccacagttgctgggactacaagcgctcaccaccatacccagctaattttttaattttttatagagacagggtctccctatgtggcccaggctggtcccaaactcctgggttcaagcagtcctcccaccttggcctcccaaagtgctgggatcacaggtgttagccgccacacctggcccatagggtttctttaaaaattaaacacatatatttaaaatcaaagtctgaaaggaaaatacccaaaattaatagcagttatttgatgggtaatagacttgtgagtttttatttttttatatagttaacatagttttagttttcctgtaaaactattgtaataattaaaaatacatgtgtgtttaatgttatcatttgatacttcaactgtttggagcttggctatcttaaaaatctggaatgtagctgggatcctggaagtaataaaaaaatcaattctgaacagctaaaactaatgttaccaaactcatataataaatacagcatattgtgcccaggacagctcctggcccgccacgcaaatcctgtttactcatactttgcacacaattttcaggacatctgctttacaagaacacagcaaactaagaaagggtatagtggccactgcgggcaggggcactgattcaaccacccacagcgccagaggggactcgaagaacccacgccaggcttacctccagacctgcgtcctacagaacagacaccactgaacatcctgtagtccccttattgtgtcatcgctcagtaatgttcatatcagtggcccagaggcaacgagaaaatgccttttcttgttcaacttttttaagatggtaagaaaagctgtaataaaaatttttgaaaggttaaatctcatagaactaaaaatggagggaaaaaatgtggtgataaaaaggtaaaccttagatatgtagacttctttattatctctccaaaaataactaatttccttaccattcttaagagagaccattttggctgggacctgtggctcacacctgtaatcccaatattttgggaggccaaggcaagaggatcacttgagcccaggagtttgagaccagtgtgtgcaagatgatgagatcctgtctctaaaaaaaaattaaaaataaaaaacattagccgggcatcgtggcacacacctgtagtcccagctacttgggagactgaggtgggaggatcccttaaggccaggagttgaggctgcagtgagctgtgatcacaccagtgtactctagcctgagcaacagagtgagactttgtctctaaaaaaatttttttttaaattaaaaaataaaaagagagagaaccttttactggtacttggattttccagtttgaatctgatactaccattacttgagttttcatacaaatccaagggaactggagaagaatgtcacaaaatcaggatgtcagaaaataccaaagttcccacctctcaaagccttggagtccatccatgaaaagaggaataacattaccatcttagagtttgtgggcaaatgagaaggcatttagcttgatgtgtactatgtctttggcacttagcaaatgttacttgaatttgaatgtcgtgttcccttgtgggacacaatagataggatgggctctggagtcagacagaatctagttcagatgtggttcttcagccttgaacaaaccacatgacccaccacctgcctatcttcctcacaggacactcgagggctctgtgtgggcagctcatcttccacggggctcagaacattattgacagtcgggaaaatggtcgttcccttcacattgtagttggcaaggtggggcagtgggggttgtcgcgcctcattagttttctgttgtacaaagttgagaacttttagagttctcaaactcaacgagggctacaaacaccctgttcctcttgtgcggcaagcactgctgggtgtgccccaggcctgtttctcatgccctgccttttatcagcccactgggagccccacaaaacagcagagcaggatttctggggtgggaggatggcagcgcagggtcacagcatgaggggttaagcacctggctctagccacacaccaacaagtcaccttcagtgttccgggctgtttcacctggtgcttccacccctcgtgggctgggctggcaaatgaaagcttggcttttctgcacagaatagactgtctgaggtggtgctgatgttctcttttggtttgagtacctagtcaacctgcaagatgatttagagagggacactgttagcaaatggtagagtaaaaacaaggcttgcaaaaatgtgtagcttacccaattattgtgaatttgggcaacatattaactataaacctagatcgaggccagcagattttgccctgttttgttttgtttttctggagaactaaacactgtaatttactagtctacttgcctagttctatatgtaccccagtgaccacgcctaattatgaaatctctcctggcaccagtactcacagccaggcagaggagtctgacagacccaaggattagaagccgtgtggttgccccttcccaagaataacccttgcttgggtgtctgagactgcaagtataatcctgcatcagaggagagagagcagggagctggggccagggcttgtggctgtagacacaagtggaagaaaccccagatctcttttcttttctagggcacttcttgctattgtaatttgaaaatgtattatttgaataatgagggatgtctttctcctgcaggactggtagctccttggaggaagggcctactggtcttgcatctgtctccctaccccaaggccaggcacatatgggaactatttgttgggtgtgtgtagtttcaagttctgcctctacccctgcctagtggttgcccttctgcaagccacttaaccctctatgcgtgtttcctcatctgaagcacgcaagtcaaatgatctgtgtgtgcctccctctgcctctggacccaatctgttcatatggttgtattgaagctaatttcatccacatacaagaatgtctagagctagcatagtgtataacatagccatcatttccaggatgtagatactctatttccattaactgattattatttattatttcagactttaccctgctttctctatagggtttttgtaaagactaagtgaaatgatgtataggaaattacttcagaaattataaagtttgtataactgaacaatgattgttattgctggcccaaagataccctcctgagaagaaactcagacccaaaagacagcattgcagaccaagtattgtaaaacatatgtgtggctagccccatcaaagaatgtatttcccaagttagtttttcattttaaaaaaaaaaaaggaacccctcaaaaattttttttaatttttaaaatataaccttgactctctctctctccctccctccctccctccctccccctctccccctccctccctccctccctccctctctctctctctctctctctctctctctctctctccctccctcctctgccagtcctctaatgcaaggtggttagcatttgggtgttggcaaggttgttggtcatgaaatccttctcactgcctcactgagcatgggcaagtcatgtaaattctctgccagatgaggatgcctgcttttcaaagctaaaataagaattgaattgaatactaaaacaagaatgagattatggatagcccttcagaaatatgaagttagttatatccttcacatgtttttcttgctagatccagcctgtccagttacttcacctcttccccataggacagggtttctgttccctgccctgccttgggccctcttctctaaatatattgcagtgtgtctgtatcctgctggaaggaagctcccaaagttggacccacatacctcatgttgttttttgcattgagacactgcaataactattgtctaagattgattcttatctatttttattagctcagacctaagtatgctgttccctgtctctggatccagaaggcttacactgagttctgaagtccaaagtaacttcttgtttttgtttctcttctagtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttc

SEQ ID NO: 36372 - DNA, 213564 bp, Homo sapiens
gggacggcgccctcaccgcgagtcacttgtcagcccttgtctgaggcggaggcagccccgcgccgcgccggacccgaggtgagtggcggccggccggcgatgcgcctctcggatctccggtgggagaagggaaagaaccggccgctgtgcgccgaacgcgagaagggaagcccggttggggacgaggagggggcgctcctcgggcagggatggctcctcaggtgctttctgggcgcggagcggcggaggtgggagagcagcttgggaaaaggagcgcccggaaaagggcagcgctggagtccgcatgaggccagagggcgagccctggggtccccgcagcccgggccgaccgggaccagcgtagcggagacggggacgcgggagggcgcccggaggtggcgagggccggcagggacgggcactgccgctcccacccacccggctgccggcgtcgcccggcaccaccgtggtgtggtgtctgagtgcccagtcctgcgccagtctcttggagggtaggaagcgggactcaaaggaaaaggcgcgttagtttttctttgctcccaggctactgagaagcatttatttctcccccagatatttacagttttgtgtaacctgtttggggaaaacttctgcgcgtccagaaataaagctcgtttaagaaacacatttgtcatgaacacgagatttgttaacacttgagtacttgttggggcttttgtaagactgtgccttcggtgcgttttacaataagtggaaaaaggaagggcgtgtggacagggcagagcttggaaggaaaattcgtggcggcgctgggcagggcagatttagggtgtgatcgccagatcctatcccaagtccgccttcctgacggggaggacgtctgaacccgcctgccacggaaacggcccgttcggtagccttatttggccaacaaggctaggcgcgaatccctcctggaaaactgtcctgtcggctgctttcatcctgtgcctgtggctttagttcttcagctctacctacattctctctccattgcggggaaagagaatctcaagatatttctctttaatttcaggcctttttttttgtcactctgtgtagttcatcttgagttctcctttctcccctctcacccactaatgaagctgagatacaagtgtgggaaataccaagcttccttccctagtactagagcaaagacattgtttagactttccctaaaagaaaatccataactctacagaaattccaaccttttcgacgtgtttgaaagagtatgctgctatttcctgcctgcttggtatttgaggaagggcttgggcactaataaccagatggaggagtcttggaaaggccaataaaaatattgccattgcttggggcagagactgttttaaggcagatgaattccaaatgaagctagcagaagaagcatctagaaatgaacggacagtgactagaaatgaaatgacactggttttgtagtgtggctgtgaccttgccagtgctaggaattttaataacaaatgagagaagttaggaagggaatccccaagtaaagggaagttgcaagtacatgggttgataatctaaatgaaatacattttcttgtagggaagaatggggccagaggaagttgagcccaactttcatattattccccagacacaagttaaagattaataaaggagggcaggctgcctgtgaaatatcagttggctttacacgattctgatttgtatcgtgtcaatatcaggacagtccttctattagttttctgaaaatctcctccttttatagcgggaaagcaattgaattatgtgtggctcgttattagcttcccactagtagtttttcacctatatatacagtttgacttccggcttggcctttggatcttttttagtgctctgtgcctattacttcattactgaagtaatgtgttattgccttgtagttcagtatactaccacgccagtagaaaagctgtttcggtttctgatacaattttctgtaatttttattttccctgatataatttttctttaaaaaccaggcttatttgaatgttttgccccattttccctttatgagaagaaggaatgtttgctttaaatatacctatggctcaaatatctatatctgcaactatgaatttggggtgatgggctagaaattttgaatgggttaaaacatattttaagacaggtaatattaggtggtgatttggttgaatagcttacattttccaaggaagtatgtttttaatataaaattacatatctgttatgtttttaatattttttaaagagagagaattattgtttcttagtattccattaaaacaaaagaaaacttcattcctctgtctcctgccgttataacaaccaataggaaactcgaagtttttttttttttttttgctttttaaaaattatatgaaagtactactaggagagtcatcacacgcacacttaacagcagaacagacaaaagaaagcaccgaagcactggttcttttctaaactgccaattccatttgaatgcattaacccagcacttttgctgtatttagtcataatcttattcactgagtggcaaatgcttactctctgcctggtgaggtgtgtgtataaaacaaaaagcaggttgtgactaacatcactgtactagagtattgcctatcgttgactatctgaaggaaaagtagatatcactttaagtgtggaaaataccatgtccccataggaggaaatacaagttgtagttcatgattggagagaatagttttgtgcattgaaaaacagcttctcattgtaaagaatttagtatttggaaagcatgaatgggagcctactgatttgcagtctctttcacatgttagagtaacttagaatttaagtaagtgcagttgaaagactcttgtcaattgcagacaaaagaatacatgaagtggagggaaggagaaaattattctgaattcaacctgaaataaaatcttgctacattagtgaagtattgtaaagtactttgagttaaactttgcatgcaagaagccacaaaattggattgaagcaagttgtgaaacatactaagtgtctagaaatgtattctgatatggaatttttagaccatggaaattgccatgagtgtagaaaatttatattagctcacagattgcttttcttaaactgaaattaatgaagaacttaattaagacttatcttctatatcctctcacccccctcaaacaaaatactaaacataatttatgttctagggtttcaagtaaacatttttgctaatcatctgattttctttcacagcatatttcattttctgtcattggactttgagccattagaaccatgagcaactacagtgtgtcactggttggcccagctccttggggtttccggctgcagggcggtaaggatttcaacatgcctctgacaatctctagtgtaagtaaactttacaaattttattatagatgttcattcagtgcttagtcctcgggctgagttgtttaattctctgttgacctgtactctacttattatcattgctcctgggatttgatcttggcaaatttgattatctataataaaggatgaggggagtagatttagcaaggataactgacttcaatttaacttcttttcgttttcccccatgttatcaataataaaatggaaaaagcatttaactaggaacagactgtacatttttgaactgtccctaatttggggaattctctgaatcttcgttctttcatatataattttcaaaggttgtgctatgggattttaataatctctttcagttccaaaagctgtttgttaaaaactgttgatcaaaattgaataaaatgattgtttcggaattatttcctcagctcactttctggtggaggtgatagccaacagtaagatggccaaaagctacttacccttgaagaggaaatgaagggcttggagctccaactagatagcctatgaataattgagatttggctttttacctcattatggatttagtttgaatgtattctgtgtatatattttaaggatatgttttcatgatgatgatgatagcactgatgagaggagtaattaaagcttctatttattgagacttgactatatgtcaggtactgtttcactttcatcaccagtaggtaattattactattatataagtttctaaaaggtttgtttttgcatattcaaataaatatgaatttccatcttcttttactcaaatggtggcatattatacacacagttttttttgagacagagttttgttcttgttgcccaggctggagtgcagtggcgcaatctcggctcaccacaacctccatctcccgagttcaagcgattctcctgcctcagcctcccgagtagctgggattacaggcatgtgccaccacgcctggctaattttgtatttttagtagagaccaagtttccctatgttggtcaggctggtcttgaactcccgacctcaggtgatctgcccacctcggcctcccaaagtgctaagattacaggcgtgagccaccgtgcctggcccacactgttttatactttgcttttttttgcaacaatttaccctgagatcattctctattaatatataaggaggtatgtgtgtttttttaaaacaattgtataattttattttataaggaaagtgacatttaaccaatcccctactgaagagtatttgtggcatttccatattactgttacagtggtacagtgaataccaaatataagtacatacatatatatgtgaatatatgtatctacgtcattttgaaaggttgtgccaatttacacttttgtgcaacgcatgaaaatactatttttgtgccagtcttaccaacaaacttggatatttatcaagtgctgtgaatgcatcatctcatttaattatcataccaacatgcaaaatagtgatattattcccattgtatataactgtgctgtgcgctcacatgactgtatggaagagctggctttccaacagttatgctgtgctgcctctttaataattcactttaccttaaatttagttagttgtttctttaatcagatatttagaagattgtcattttggttaataatatatgtgtatgtataaatatatatacacacacatactctgcatcttgtatgtgtatccaacttcattttgaaagattaaaaataagtttgtaacgcctaaatatccttattaaaatactgcaaatcccattttactaacggagtctcctttgtttcttggctgtggatttttttaaagttatctttaatttatcatcaatttctgccttgatttcagttaattagattttataaggaagtatatatatgtaatccagcctgcaagttttaacacctttcatggttagatgaaattttaaatgtaaagcatccatgtgaaaatgtgtcatgtgatttattcctgtttgagtgagttggtattttatttcttctactgatgatctattatgggaacaggagcaatctttgagtattattggtttttacgttttgttagcattttatattttaaatattctactttaattatctaaagaaagttattagtttaaatgcttacttttttgctgaaaaaaagttcagaaacaaattgacacctaaatgagccaaacttaattatcactttgttgtgtggtaatagaaatgcaaatagagtatgtttgcgaattttgtggtaccgtgtctttaaaaaagtttcatgtgcttcagtttcctggcagacagtttgaggtactagctccatgttgtgatgctgatacaacagaacactgtgtacatacatatgtgccctcccctggcacagaagaaatgctttccttgtgtagacagagtgctaattaaaggattttgaacatactgattaaaagagactatggtaacaaagctgctgagttatttctgttctcttacaaaagtctctgccatctactgtgacctttttgggccttgtgcagtggggcatgcaattcattctggactggagaggattggaaggggaggggaaggagagaagggaatgttggctcaatcgggctgctaggctcttggcctttcattgtagttatttttaaccccttgtgtggtttaaatatgcctagtaacattgcctaataaaggtttgcgtttaataactaatttatattgtggtaagattgttaatgttataaatttttaacttactctcatcttaattagttctttggttatactttttctgccttaattatgtaaaattactgggatattactggtcatcaggttctttaattaatagtatcaagaaacaattaaaacctgaaagcatgcttaaaacatgtaatttaatgattcacttactttaataatgcacatgaaattcttagcaaggtctggcagtctctcaattatcttttataataatattataaactttaaaaagaaaactatttagagacttgaaacattaaatatttaacccccgtagttgtagggaacatacagttatggttttgttttgtttttttaaacttattgtccactgaaattaagaaaggaaaaaaaatcagaagtttgtacttagctgggaatctgcatctttagagttcaaaactgtgcaatttttcctctgattaggtattattatgttgaactccaaagggtcatttacattcctttataacactggagctctggtgtatcgaattgtgttatgagataagccactagcagggacttgaacattccattttctttagattttgttgtatcagcatgtgaatatgctgaatacaacttgtatcctaaagcatacaagctataacattttcacgttggactcaaatttcttcatcatctgtattgtatgaattttgtatactgttttgttggtggatttctaacataagattgccagttcctgctagctttttaaaaagatcctcaggttgctgtagctggatgatcacatgtcatttaatttccgatccttaaaatggagtgcgggctacctaagtttgcaggctgtctttttatgatcctgtgtttatggaattgccctgaagccatggaatgtgaggatgggtttcattgtagcagtgtgggtttgttggtttttgccagtatattttataacaagaaataggagacttgttggataattcaaggctatattttggccagttgataaagattatatatttgtgagtaacatcttttaagttgttatatcctaaagttgaaatactctgctgtgtgttactttctcattatgtttgggctcttttcttcactgtcaatatttggattacctgaagatgatatcccaattctctgtaaacacattttagatgtttctttaagagataagaattaggtcaaactttttaacatctaaataacaatgactttgattctcaagagttaggggaggataaattgttataagcttggacaaaattctaattggatttgaaaagcagaagaaacttactattgcttggattatggagccctgtttgggagtctaacacagaacagagaaggacagaattgtgaaacactttgctatgaattcattgattcagtagttatagtaatacttcctagaagccactgaagaagatacaaagtggggagtacaaaggttggatggaaaagaaataagcacagtgctatagaactagacagtgtcgtaagacctgtcacaagtcaatattctatgaaatgacagattctgataagtgtttctcagtttcagtgggtgtaaatcttttgtttgtgggggttggtttcctttaggagaagttaattgaactgatcctcaaaggatgaaatttaaacacctcaaagtcagcatttctccgtgttgtccagtgcctagtgaagatgaagacttttcttgccattgcttgactccaagtaaagctgtgaatgtagttgagcgattctccagacctgccagctgcagtttccctcctaccggaagacagaaagactttcagtcctcaagctgaaatgagagagccatcctaccttgaataaatgggcccattgttaattttaagctcttgagtattttcttttatattccctccaagctaccctgtcattatgccaagttagaaaattaatttagtttgtataactatatgatgtatatttcacatgtgtgttcactctgctttaaaaatattaattaccttttgtgtgaagttcagagacctgtcttttcccatgtggcagttttatatgttttgtggtcacaaatgtcaggaatctcaatgtaattctggataaatttttctgctctatgatttgtaaagaaatgaaaatcttatattttttaattgaaaattagtagttttagaaaaaaacgcacttatttgattttagtaaacgttgggcattttgaaaagttattcagagaaatgttactggtaggcaggacttttgtatctgatggaggaaaccgatgtagggtttggataaaataagactagcaggctgggcacagtggctcactcctgtagtctcagcattttgggaggacaaggtgggaggatcacttgataccaagagttcaaggttacagtgggctgtagtcatgccactgtactccagtctgtgccacagaaccagaccctgtctcaaaaaaaaaaaagaaaaaaaaaaaggtaagaatagcactttagaccttgggaaagaacgttttcatgtaactattcatctactcgtgagttaggtatatctacctacttaaactaagaatagatagataatagataatgtacagctgtatattggaatgacttggatttaaatcttagctggaaaatcagttcattaatttgagcttctgattttctttgatgtatgggaaatgctttataaattaaaaagtatacaggtagatttgattattattaataatttggagcctgtgagctttcaattttttttagaacttctgaggcaaagagcttttctttatgatagttgctagtcacactacatgtgaatacacagttgaacagtggtctttgtctatgacatcctgttagcagtagttcttacccagattcccatataccacaggaccagttatatctttttcccccagttacaactgtattgaggacaaatcagttatgatttagttatttctagaagcaaacgttgctttagacaaaaaaggagttatttagcatcgtatgagagagaattatgtttcaactttggcagatgagactctaggcctttatttcagtatctgagatgcaaaaaatattgagtacgtgacataaaatttgacaaaactagatattagcatgtgaaataacaatatgtggatctgtttgcaaataaatgacctaatggaaatgaaaagagaaaacattaagtaactaaagagcagtgaccatggtgtctactgattctttaggtattctatgtgttgggccactatatagtcttgttgagaaggcaggtttggttccttaattaacagagagggaaaaatcacttttctagcgtactttgtttttattaagaggttttttttttaaaggtaataaactaagaatggacaaagcagagaatattgaatgagtatccccttattccttcacctttcttatttttttgtttcctgtttaagtatagttatctacccttctgtaaatactcagatttcttttatagctgatgttgtcacccattttttatgacaattactagaacagagttcaccaaccttgttggcatttagtaactggactcccaactgggctaagcagttgtagtaaatgtccctaataggcgtaaatagaggagagtaaaatgaactggaaatgttaataggagggaatgagaaagaaaaagttagatgagagaaaaaaataaagaggactttttaaaaggctgcagcgtgtcacccaggcgggagtgcagtggcgcgatctcggctcactgcaacctccacctcctgggttcaagcagttctctgcctcagcctcttgagtagctgggattacaagcattcgccaccatgcccagctaatttttttgtatttgtggtagagacagagtttcaccatgttggccagtctggtctcgaactcctgacctttgatccagccacctcagcctcccaaagtgctgggattacaggcgtgagccactgcacccagcttaattttctttaggtaagacattcatatggttcaaaattcaaaagatacacgagcgtatagggggaaatgtctcctggtgccctgctgttcatttcctcctcctggaagccacctgtgttagtagtatacttccagagataatctataggtatatctcctccccaccctccttttaacacaaatagtatgcttaatagaaatacttttttttttggcattttgttcacttaacccaacatcagtaaatatatcttcattcttcattccttttttaccactacactgtgtttggatttgtcataattttttaaatcagttcctattgatagacaattagatttttttctagtcttatgcttttactgacactgcagtgtaagttttgcccatatatgtatatatatatgtgtagacatttaaattttttctagtcttttgcttttactgacattgaatttaagttttgcctatatatgtgtatatgtttgtatatttgtatatttgtcacataaattcctagaaatggaattgatgagtcagagggtgtatgcatttgtaattttgactgatattgccgtctttatagagacactcctgctcataatatgaggatgcctatttccccatacctatgctagcctaagtttcaacagaccttgatcatttccaatcagatgggccagtttccacctgtcttctttttacagggctcagtcacaagtattttacaaaggattttctgtgttttcaagtggtttgttttccattttgcaagataatctaggaaataaaaacatgctgctcttctttaaatgataccattaatttcttaaagatgccattttctgaattctttcgtccagagcttttgttagtaattatctccatcatttgtttcccatttctaaactaacttcctctctatcttaacctattactcccagttacatggcaaaagattttgtgtttttggcatagtgccctgtcatagactttttggaaaattaagcaaatcacatttaatagattcaaagttgttaactttggaatctgttcagtaggctgatatacaatcaacccttgaacaaaacagggtttaggggcaccaaccccctgtgcagtcaaaaatccatgtgtaacttttgactcccccaaaacttagctactgatagcctactgttgatcagaagccttacccataatataaacaattgattaatgcatattttgtatgttataatattaaatactgtattcttagaataaaataagctagagaaaacatttaaaaataaggaagagaaaatatatttactgttcattaagtggaagggagtcatcataaaggacttcattcttgtcatcttcactttgagtaggctgagaaagaggaggaagaggaagggttggtcttgctgtctcagggtgtgccaggtaggttaggtggaggtggaagggaagcaggagaaagcaggagagttgggcacacttggtgtaacttttattgaaaaaaatctgtctgtaagtagacccgtgcagttcaaacctgtgttgttcaagggtcaactgtatgtgtggttttgaattctagtctttagctccttttaaatgatgtgacaaggagactgaccattatgaggtgttcactatggtccgaggaatggcaaatttcacccttatgagactcagtgtgtttttattatcaacctttattagctaatggaagttaactgaaatcaggtaggtttatagagtgttctgtagcatagtgagtcaggcattgtgaaggtatactaatgtgtggcacaaggtagttactcattttagcctagtgtgagcagcagagtgtatgtgttggtaactatagtaacaaaaagagtaaggatgccagggatatttatatttttttgtagtaaagatgaggaaaggaggaatttctctttagtgtgttgctgtaaatgttaaatatgatgagaagagttttgaattagagaagaatttgcaacacttgttatttggattctgtgaattgttaaacatttttttccccaaggtccagagattgatttaacaatggccactgtacttcatgataattgtcctggctaaattttaattgaagaaaagagaaagtagttacggtaatgacattaacaatttaatgctgtttaccattgattggatcagggatttaagtgttgtgattcagttccattgagatctaattaacagcccagtatttttcaaatgatttctgggatattaacttttggaagtggtagaattaagagatttagtaaggctgtataacactagccagagcagactatgttctgaaagtatgtttgttctgaaagtatttttcttctgagaaaacgttaccggaggacagatgtcctttagaaaacaaatgttttgtcccttaactaggaccccttagaaatgttctggagaaagaaattatatctagctagctagctatcgtgttacacatataatttccatgattttggtcattcctttgaagtatctttatgctactcacttgcaaatatcctacaaatggttgttttgatctttttagggtagacgtttctgttttgtttaaatgtacctctgtctattctggaagattctggttatttggtgtccagttctctgagtgattctttgctattttagcagacaaaagtatttccaaaattcatcaatggcttattctccttcaggctggttccttatcctcaggctagcatcttgactaggcaataattttagaaacttatatttaatatattactgccttatttaagaactgtatgagcttcccattatcttttgaattattacttaatttctctggttggttttcaagttgcatataaatgggcccgtttaatataacttgagtttatagtccaaaatgccaattttgaaccctgaagttcttagtctttttattctttttgcatactacttttgtttattcttatcatccctaaagccctatctcttcctctaggaacattcatgtatcctttgctctctgaaatgtttgactattccagttcaattcggtctcctttctttcctgtattaaataataatgataataatgaaaatatgctaacgtttattgatcccttgttactgtttgggtcctgttctagatgttttgtacatgttcgattatttaattctcataacagccccatggggaagtgtgattttattttattttagttttatttttttgagatggagtctcgctctgtcacccaggctgtagtgcagtggcatgatctcggctcactataacctccacgtcctgggttcaagcggttctcctgcctcagcttcctgagtagctgggactacaggcctgtgccaccacacctggctaatttttgtatttttcttttttttcagtagagacggggtttcaccatgttggctaggctggtctcaaacccctgactcccgcctcagcttatcaaagtgctgggattacaggcatgagccaccttgcccagccaggaagtacaattttaaatctctgatttagagatgaagaaactgaggggcagagaggttaagtaacatgcccaaagttacacagctgataattggttaggctcaggatttgaaaccagccaaactgagtagtaataatgtgtttacctgttatgctcttatttccgaggaatagatgacagttctcactagagatagccaaatttgtgtgtttgtgtatgtgtgtgtatgtgtgtgtatgtgtgtgtgtgtctgtttcttttttttttcccctttgtttttgagacagggtcttgctctgtggcatgggctggagtgcagtggcactgtcacagctcactacatccttgaccttctgggttcaagtgatcctcctacctctacctcagcctcccaagcagctgggactgcaggtgcatgccaccatgcctggctaattctttaattttctgtagaaacagggtctcattatgttgcccaggctgatctgtaactcctgacctcatgtgatcctcccatctcagcctcccaaactgttggtattataggcctgagccactgggccaggtctgtgtgtttcttaaccagagaatagatcctagagaatcaaaaacttgtatgtatgggagtaactgagattattaacaaaaaaatatataactggtttccagactgactagtagtcagaatcatcagtgagactttgaaagtgtggatccaaggactttgacacagactttgaatttaggatatttagggattcattagattccacatttttaacatgctttctagatgtttcacctgcaccagttgggttccattttgtatacttatgtttgggaaccatatgtagctttgcttttgtaaaaacaaaaaaaaaattttattatagagcttttgttacttagatcatttcagcaaaaatgttaagggtaagttacttggaatttgaactggagttgactaaataatgtgacagatctgcttttctctaactgccagcctcttcctgatttttcagagttcagtcaccataggtcaagtcttttatagaagtaaatggcagttttaataatatatgatgtcaggtattagttacgtttatgatgctgtaaacacctttatgacaaatgaaagatttggaggactttgaaattggcatgctatttataatattttaatgctttaacagttaatacggaatgttagatttaccagagacttacagagaaatccttggctatactaggttttgttttacacctcatgataaagtggtttcattaaagttaaaacaaacaagttacagtcttttaaggccatggccagagagatcaattcaaatatttggactccatgttagatttcacagcagtacagtttaagtataatgaatagttcatgtattttgttagatcatgagcctctcttatcactcaagaaaacccccgagtcttatttattcaagattactttagaattcccagtacatgttcagtaactattaatgatcacagtggtaatagagaacgaatgggaagctgggttgccattgcaatcaagtttcttctagatttgttaatgtacctgattgatagaattaactgaggaaagttttttttttttttttttgagacggagtctcgctctgttgcccaggctggagtgtggcggcataatctcagctcactgcaacctccgcctcccggcttcaagcaattctgtgcctcagcctcctgagtagctgggattacaggcacccaccaccatgcctggctaatttttgtattcttagtagagacagggtttcatcattttggccaggctggtcttgaactcctgacctcgtgatccacccgcctcagcctcccaaagtgctgggattacagacatgagccaccgtgcctggcctaatgagacattttaatgaaacattttggttttccttgttttcaatcctaatcaggatttaagtttctaggaagtatcctagaggttacattatatgatagacccttacttcccaaggtggtcttcccatgtgtcagccaggatttgttttttgtctttccgacccaacagttctacttcttttctttagtgccctgcacaacaaacatgcatgtttgcacattacagcctttcaaacaggggaatgagttatatttccctttgagtcttgtggatattctgtaagaagccatttcttcaaatgtttctctcatgacagcttccctatcttcacatcccttagcatttacctttaaaagtagtttaggttttaattgtctctttaagtcaactcctagaactgaacctaatacctcagatatgttaagaccaatgcaaagttttaattatgaagtaaggaaactgatttttgtatgacttgatggtgggatttagaagctgttctgagcaatgagcttgatggaactttcacttttttccctctatgcacttttttttttgggatggggtcttgctctgtcactcaggtggagtgcagtggcacaatcagagctccatgcagccttgaactcctggtctcaagcgatcctcctgccttagcctcccaagtagctggaactgcaggtgtgcgccactgtgcccagctaatgttttacattttttgtagagatgagctcttgctttgttgcccaggcaggtctcaaacatgtgggctcaagtgatcctctgggattacaagaatgagccacggtgcctggcatctgtgcacttttgtactgcttgaaatttttacaatttctatgtcttctgtttaagagaagacataaaaaggaaagaaaactaaacctagtctgtgctctgtccatgtgcatatttaggcttgtctggacataatatggagattaggagagcctaagagaagcagatgtttttgtttgttttgtttttaggtgcatatgtctgtggtgtgtgtttggatgagaaatcaaagactcatgagaataaatttaggaaaaacataattgaggtgtagtcaaacttagtccttgtcgattttattgttactacttactatcttttaggagaagtgggtaaattctcagtatggcaggttatgtcctgttggtatggttttctgaatgacacatgtcagagccataagaagaggtgttagtcaacacatatttattgatctcttaccatgttctgggccttggatatagagtgtgcttttccattttctgacaaaggccacatggcacatgatatgaaatgtaggaaggagattggacataggagaggacataaatgtcatcagatctaggaaaggaaaagatgagcgttgatcacatagcctgtgtcagggttgcagggaacttctagactaggatttatagaacccatggggcagacacaaaagtagtagtggcagacagaatcatttattctgtatctttattgagtgccagctatgtgctctgtactgttgtatgcactgaaaatacagtgataaacaaaacaaagttatgtaccttatagtctagtaagggggaatggtaactcacacacaaaaaaaacaaaaaacataagcaatgtaatttaataaggtgatgtgccagagagtaactggaggaaagggatgggtgtttaggggtaagagtttcatttttagattggacagtcaatacaggccctctgaggaggcagcattgacctaagaatgagaactaatcacgtgaagagctgggaaaacacattgcaggcacagagattagcaagtgcaggggccttgagacaggaaagagctgaatgtgtttaagaaatagaaagaaggctagtgtggcaggaatgctgtgagcaaggaggaaagtggagtgagaatagggagtatgtccagtgccagggtgagagataaagaggttcctggtaatgaggaggataacattggaggccatggtaggacaactcctggggattttagatggattttgattcctctggattagagctgagctagagagagtgggttactattatggtgatctgaccatatctccaggctggtatgtttcataaattgcttttgatagaaattccagggcaagaatttaaaattttttttgagcaaaggaataactgtatagccttctgaggtgactatttggaagtgaaacactcatttaaatatatgtttgtcttgaaaatttttagttatagttctaacacatacatgattttttttcattatttgcacactgattatatttttcctattttgcattcttttaattttttttttttttttttttttttgagacagagtctcactctgtcgcccaggctggagtgcagtggcgtgatctcgactcactgcaacctccgcctctcgggtttaagtaattgtcctgcctaagcctccccagtagccgggagtacaggcacatgccaccacacccggctaattttttgtatttttagtagagaggttttcaccatgttagccagtatggtcttgatctcctgacctcgtgatccgcctagctcggcctcccaaagtgctgggattacatgcatgagccactgtgcctggcctaaattttgttattttttattgttagatgtagcttgtctcccagatggcttctgttttcctttccttgtgatgttacgaccttttctactttaataaagaaatgttgcatacacattcaggagttgtttacaaattatgctggtaacacatttattagaatttgcctcaaagacaaagtgagtgttaggatgtttattctaggtcagatctgttgagctgaaaaaatttttacagtatatctatttttaaaaagaatattttagccaattggttggctaatatacccaatgccaagagttacattttatgacccttttattatttctagtggagggtgtgtataagttttaatatgtttttcatttctgaactttcagagagatcacttgattagagttaatgtctagtttcagtaaattcagattttcagccttcaacattgtaattgacaaaaatgtcatcagtatcatatagctctaggtcctcagtagtagataataatgtctacattatgaagtagtaaattatgtaacttcatacttcatatttgtattggtctgttctcacactgctaataacatatccaagagtgggtaatttataaaggaaagaggttttttaattgactcacagttccacatggctggggaggcctcataatcatggtggaagcgaaggaggagcaaagtcacatcttacatggcgacagtcaagagaagagatcatgtgcaggggaactcccctttataaacccatcaggtttcgtgagactttttcactatcatgagagcagcatggcaaagacccgcccccatcattcagttacctcccaccaggtccctcccatgacatgtgggaattatgggagctacaatttgagatttgggtgggaacacagccaaaccatatcaatattcaagatcagctttttataaattcagggtagcaagtttttctgtgagttttggggtatagttgcaaaatactactttaaaaccaacttataaattacctgttatattaaatatgataacacaatacaccataaagtctacttgagagatagtttcgtaaaagattttatcttagatttaaagtaatctaatagtacttaaatttctaggcttaaaaaaaaaaacttcagttaaccatgattatatagtgatgaatagtcaaatatctgtaaacattatattatcaaaactaatatattagtactgtatttttcttgcttttttcatagcagtcttttaggatttatattttctcccaacataatactttagaattacatttttagtgaactgtattctacatgctgttgattgtagttattacaagtgccagccctggaacagaatgcctgtgtgtggatcatggctgtgtaatttaccagctgtaatttaccactggtcaaattactgaacagtgccccaagttctttacctgtcaaataagggtaaaaatatttgcatcataggattgttgagaaaattaaataaattaacacttgtaaggtttttagaagtgcctggtacacagtaagtattcagttaaggttacctaataacattgtaagttaccttataagtatttgtacttacaaagatcttataagtatttatacttacaaagatcttataagtatttatacttacaaagaccttataagtatttgtacttacaaagaccttataagtatttgtacttataaagaccttataagtatttactagtaatagggagttgaaacagttttgaaactattattgaaataatatttctagatgcctcacttcttagataatatcatcttcaaaattcaattctgcttttcttttttgaaggtttttatgtaggattttctagaagcaatttttttaatacacacacacacgcgcacacacacacacgcacacgcaccctgtaggtttggattgaattacttatgaagtctcttctttatagtcagtacatagtaaatatttgttgaatgagtggtccatttccttcttccatctgtcatggtctggcataaactctccaagagatttgaagggagagttggcaccagtagtacctccaattagacattctttccacagtgattgccattcagtgtagttttgttttgttttgttttgttttagattcttttaaagtagcatgaaacacagtattgctggtgataggcagttgctctagggaatagttttctgcagtgaaggatgaattcacaagacagaataggtaagtggaatgaatgtagactagatgaactaagcaatgtacctgccttttgtactattgctttctaggtgtttttccagcatcagctgcctgtgggtagaggtcaccatgctctttatcttgccatcctgcatccctggtggtggccagctagactaggatgagtgcctccctaaatgcggcatttatagataaagttgggagatttgtatgttgtcacactggttacaacctctgtgaattttatgaaataaattataaaatttagcaaatctgaacttcagtcatataaatgtaaattattattgctcactccattgatttatttactcattccacaaatatttattgaacatttattatatgcaggacattgtcctaggaactaaagatacagcagtgaataaaacaaagtctgtgccctctcaaatctatgttttagggaggtgaagaagagacagtaaacaaaaataaatggtgataaaatggtatggagcaaaacaaagaggtatagggaaagagtggcagttgcatggggcttacataatttgtagaaggtgagcaaataagacctcacagataaggtgacatttgagcagagatctggataaagtccaggaatagtattcagggcaaagggtaaagaccttgaggtgagcatttgcttggcatgttcaaggaacagcaaggctccgatggctggagtaggcagaatgagagggagaatagtaagaggtgattttattttttttatttttattttttgagacggagtttcactctgttgccgaggctggagtacagtggcacaatcttggctcactgcaacctccacctcccgggttcaagcagttctcctgcctcagcctcccaagtagctgggattaaaggtttgtgccaccatgccaggctaacttttgtatttttagtagagacagggtttcaccatgttggtcaggctggtctcgaactcctgacctcgtgatccacccgccttggcctcccacagtgctgggattacaggcatgagccaccgcgcctggcccagatgattttagagagctgaaggtagatacttctcaaaattaaatcctgtgctatggtttgttgatgggacagaagctctttttccttggattaaaataaggtcttgtcaacatagtgggtgttttgtttgtttttggtaagcagtaaatattttctctcaagtttgaagtctctgctgattgcaatgttgttttattaaggactgatgttaattattaatagtatttgaagttttaaaaggttgtcagtggtgatatttgcattcttggtactgttgtttgatatgtaggaagagtaactgattatgaatgagaagtggagtcagattaaatacatagttcagtgataatttttatggagtggtgactaatttattttcattgtcatcatcctaacaataatactcactttaaaaatcaaggtgaaataaaattatttttgtctttacaccaagatttcagcttgaaaatggaggctgagaaattttagtatcttttgggtaatcaccaaagtaacatgcagattattctaggcatattagcatgttgaatgttttagtttatttagggatttgtgaaataacatttgaaattgctttttaaatttttctttcagaaggctttcttgggaaactttggtgtcattcagtggatgatcattaaaacatttcatttacatcttttttattgttgtttttgtttttgtttgagacagagtcttgctctgtcgcccagggtggagtgcagtggtgcgatcatggctccgtgctacctccgcctcctgggttcaagtgattcttctgcctcagcctcccgagcggctgggattacaggcatgcgccaccacgcctgactaatttttgtatttttagtagagacggggtttcaccatattggccaggctggtatgaaactcctgacctcaggtgatctgcccaccttggcttcccaaagtgctgtgattacaggtgtgagccaccatgcctggcccatttacaccttttgaagacagctaattttatctggtgaagtggtagccacagaccaattgtcttggcttccgtggtagtcattagactatttttattaaaattttatttcttatttgtatattttagagacagggtcttgctctggcaccaaggcagtcaagatcacagctcactgtaatctccatctcttggactcaagggattctcccacctcagcctcccaggtggctgggattacaggcacatgccaccatgcacagctaattttttgaaattttttgtagaggtggggtcttgccattttgaccaggctggtattgaactgttgcactcaggctgttctcctgccttggcctagcaaagcgctgggattacagaaatgagccactgaagccagctgacattttcagtaataatagctaagtattttcttgggaaggggcagtttttccaaattatttttcatatcaactttgattccttttaagacaagttttatcatcgttagacaattatctaagttatcccactgaaaagttttataatcaactttattaccctttgggtcaatgaaacttctgccctcccccgcctttttttttttacctaaaggaggggcaagaaatgcaagaaattttctcctcaaaggaggttgttgtataaaggagggacttattctaatggagaactactttctaaattcagtttaatggtaatgctctgaatgccatgcagatgatatgcctctctagagttggtagcagttttaaaacttaattttcagtaattctgttaaggaagtactttcttcaacaaaaattggcagttgatttagcaggctctttaaggtcttacatttggtttttagataattcagattttttgcaaataaacaatggactcttgagtttcatggtcaatgtgcccttccctagaaatgatgatgagtatttgcattagggttaattcttttcaacttaaaagttgtagtctttctttaaatgaaaataaaaataaaaactagtaggaaaaatgtagaatggtgattaccagggttaaggggcaggtggacacagggagttgtttaatgagtatagtttcagttttgcaagatgaaaagttctgaagttcttttgcacaacaatatgaatatacttaacattactaactacacattttaaaatggcatacatttaaaaatggttaagatggttaaaaaataggagaaaaaatagtatcatatttacctggagttttacaaattacctcggggttgtttaattatggtaatatgattttttaactaaattgaacagatttaccaggacatagcctctatatttcaagacagtgtaaagtttgtcagaattggcaaatcacctcccagttcaataaccccaaggcagttttgttatgccttctcttaaaacacacacaatcactgtaaatatttgctatatattgctcttaggtcatttcaactgttaggtaactcttgaagttgtatcgtttctaagctaaaaacaaatatgtcataaatataattcatgcctacatgtctcatgagaataaagtatggatgcacttgataatttagtattaactgttgaacactgaaacctgattctgcccacacattatttgcgattgtgtattattcataattacatattatgaatattttatcttgggtggataagaatgtgactttgtttttagttaacccaaacctttctggacacgtaaaagtaaagcctaaagaattgttatattttaattaagagttagtccttttctctcgctgtctttttttataaatagtaatttataactagaggaagaaaatataaatttacattttgattataaaaattatacatatatatattccagttgaaactgcataggaaacaatgacaacaaaaatgctaaaagcaaaacaataaaaccccctgccaaacctgaaatgtggacatttttatgaatatttgtgaaaacagacacgtttctgacattctttatgtaacagtacaccttggatcttcctccatcatgagtatagaaagccctttatcatcccttttttggttggttgttgttctgcagtattggtttcatacttaaatttttcatgcttataatagtttagaggagatgtaacaaatacagggatacaaaggcaggatatcccaactcttgagagtttggactctggagccagccatcgtgggttcaaatcgcagtagggacactttcttgctgtgtaacctagaataagttataaaactcaaggtctcagttttcttatttgtaaaatagttattaacagtatgcctgtattatagagttcctgtgaatattgagttcctatttttgaagcacttggaacattatctggcagactgtgcaattataaatataaactgtttttaatgttagtatggattctatgatcgttaatattttaagatagagatttagtgtttacttcaagcatcaacacatgccccttcccagcttctatgtcttcaaaagtttgtgcatggtattgttttgtgtctgttggaaggagatgaggtgagggaagagtggtagaaaggaagtattggttttagagatctgggtggagttactattggcagttatccattcttttctggccatattgcctttggggtatcttgggtggcctttgacaatagctgctcttcgtagagccagccctgctatatcctggtatttaggaaatagttttaaaggttttcaagccagaggcagtaaaaggacaatttaagttaatatgagttagtaaattttggcatgcagtccagcttggagatacacttctgtaaccttacagaacattttcttgatttgtgtgtttaaatgttcttaaagtattgaaagtgacctgtgttatctgagagatacttccttttttggaattggcctttttgacttctcttcatggttttctttaaacgttgaaacttggaggaaaagagtaagactggcttttattttaaagtagtttttaaaatggtcagtaatagaagaaatgtaatgaaacaaaaaagttaatacattttggcttatggttttatgtatacagctgactcctgaaccacatgagtttgaactgcatgggtccatttatatggtgattttttacaataaaagttacaccaactgtgcttgcctgtcctgcctccccttccacctcctccacctcttttgcctctgctacccctgagacagtgagaccaatccctcctctcctcctcagactactccacatgaagaaagatgacaaggatgaagacctttttgatgatccagttccacttagtgaatagtgaatattttttctcatgcttttttaaaaggaatgatttctttagcttactttaagaatatagtatcagccgggcacagtggctcacgcctgtaatcccagcactttgggaggccgaggcgagcggatcatgaggtcaggagttcgagaccagcctgaccaacatggtgaaaccccgtctctactaaaaatacaaaaattacccgggcatggtggctggcacctgtaattctagctacttaggaagccgaggcaggagaattgcttgaacccgggaggcggaggttgcagtgagccaagatcacggtattgcactccagcctgggcaacagagccagactccgtctcaaaaaaaaaaaaaaaaaagaatatagtattaatatatatataatgcaaaatacatgttaattgactgtttatgttaccagtaaggcttctggtcaactgtaggccattagtggttaagtttttagggagtcaaaagttatacatgaatcttcaactgcatggggatgggggttggcacatccaatccccgcgttgttcaagagtcaactgtatttataaaattttattttagtatagtctttcatgaacctccttaaaagtcaatgtaaagttattaatcaaggaaatctatattctacttatggcatcaattcctttgtagtataatttaaaatatttgattttgtgactgctaatttttatgtctatttattttacttttgataccaagttaggcacgtaagttaaaggaagttattattgtgacaagtagaaaatggtttaaactactattacaaatgtacaggtcatggctcagttaggcttgaattaggctattaagcagaaatggtaggccgcttgctgaaatatatagaatcagtgattttttaagacagtgctgtttttcattaaaattatttttttggtttaaatgaatttgggttctatccaaaagaaggtaggtgtgcttggtgtttttttttttttttttttttttttttaagacagggtcttgctgtgtcacacaggctggagtgcagtggcgctatcacagctcattgcagccttaacctgctgagctcaaatgaccctcctgcctcagccttatgagtagctgggaccacaggcatgtgccaccggggctggataattttttttttttggtaaagacaggattctcaccatgttgcccaggctggcctcaaactcctgggctcaagcaatcctcccacctcggccttccaaagtgctgggattacaggcatgagccactgtgcccagcctgtttttcattttgtaaaacacaccaaaaccaccatttcagtactttttttttttcttgctctatttatttcctattattggttagacaaaatggcgcttttaggaatttttataaggagagctttgagacttttttttttttttttgagacagggtctcactcttgcccaggctggagtgcagtggcacaatcgtggctcactgcagccttgaccttccagggctcaagtaatcttcccacttcagcctctcaagtagttgggactacaggcaagtgccaccatgcccggctgatttttatttttttttttgtagagatggcattttcccatgttgcccagtctggtctcaaactgctgagctccagcaatctgcctgtcttggcctcccaaagtgctgagattacaggcatgagccactgcgcctggccagagatctttgtatattggattgttttaaggcaaaccatgatgagaaactaaaccattcttagattattccattttaagatatacgtgaaatatggacataggtaaaatattctatcatatcttgtgttttttttacatgctgcttatttatctcttctcacccatattgtcatcattttatggtgtttgtctttgcttcgatcctgattttttaatcttggcagaagtatactggcaaaagttgatgtaagtctaattttcaaggttctgtgtaacattttccactgcctttcaccagctttcaattatttttgctcctggagaaaatatcactaggggaaggagagagaaggaaaaagttaagggtttgggaggagcctagagctaaagctcatttagtagaagatcactaaatcagcagctgtctttttttattcaattctttgaaaaaatgttttaaatatgacttctcttactcaccatgattactttttagataaatgtggaccatagagaatatacataagatggttagtgttaagtaattctagatcatgagtaatttatacatctcaattttcttaattttttctaaaaagtaagatatggtaaacatttacttgagttacctgtgtcttctattgaaacttaccattaaggtcttgatttgggaattaaatgaatcagagtccagttaggaaaacaaaaacactctagatgttttcaacaggaaattttattacaaggcattggtaaaatcggttttggtagagcagagaaatcaaacaggatctatgggtatatggtggggcaatctagagatgagcagcagcaggtaatcactgccacccttagggacccagagagatgatgggaagaagtggtgttcccagagcccaactgtgggtctgtctggcaggagtgaaaactgcagagaaggcatgggtctggagctgggactgtagagccaggggctgattgaccaggggtgaaaccttagggaagatacagaaagggagagaaataccaaggctttccccctccttctacccttcagacctctgccattgccttttattggtgggacctatccacaaagcagagagaggaagggagcctggggaatatagttctctgtcatacagagagggcagagaaaagcagggaaaagatatgagtgaggagacagctgccagcacagacaatacaaaaaaggtttacatcccccagccccaaaactgatcgtattagtccttttatattttaaacactcctcttccctcatggctcaagatcccttgtgtaagaaggaaataattatactgtatgtggttttggtttttatgaaccttgatattaaatgatgttaagctgttattatatagtatttgctgtgcatatttctgccggtctctgcatttttattgtttatgtatttttagatatacaaaaatttattttcatttgttcaaatcttttcctttacatttttaaatatcttaaaagattaggtagtcatttccattgaaatatttaataaataccctgtcatttgctttttctaagttttcaatattttcaaactctggaattcatctggaattaatttttgtgtggggttgctgcattatcttgatgctgataaagacagcttattccttttttttttttttttttgagacagagtcttgctctgtcgctaggctggagtgcagtggtgcgatctcagctcactgcaacctccgcctccctggttcaagcgatgcctcagcctcctgagtagctgggattacaggcatgtgccaccatgcccagctaatttttgtatttttagtagagatggggtttcaccgtgttggccaggctgatctcgatctcctgacctcgtgatctgcctgcctcgcctccgaaagtgctgggattataggcatgagccaccgctgccagccattattccagttgttgttttgttttattttatttcattttttttttgagacggagtctcgttctgtcacccaggctggagtgcagtggcgcgatctccgctcactttaagctctgcctcctgggttcacgccattcttctgcctcagtctcccgagtagctgggtctacaggcgcccgccaccacacctggctaatttttttgtatttttagtagagatggggtttcaccgtgttagccaggatggtcttgatctcctgacctcgttatccacccaccttggcctccgaaagtgcttggattacaggtgtgagccaccgtggcccattattccagtttttaaagcttacttatgctttgagaaatcttggtcttttctccgtaatgccttgtctgtgctggatttctttaaatttggtaccaatttacagtaatattctaaattttatttaaagtgttatattttctacttccttaatagggtacttctatttttaatcatctgtgaagtagccacttcacagatattttacctccctttttttttttaaattacagagtctagcatatcatgttgtgatttgggttatttatttattttttttaaagagacaaggtcttgttctgtcacccaggctagagtgcagtggtgcaattatagctcactgtggccttgaactcctggggctcaagtgatccttctgcctcagtgcccaaaatgttgggattacaggtgtgagccactgcacccagcccaattttggttaagtttaagaccttttgagattaactaataaatatctctgagttcaatattggtttgtgcatctctgttatttgctttttatgtgcaagtgtgcaaagagctgtcatcattttcgcttttttatttactttagttttgggagaatgaaatgactgttgagtaatgaatgtctaataatgagttttggactttgccttttaaaattagttactgtaattatattaacctggtaattgtggtatggatcattgtctaaatttagtagatgggctgggcatagtggctcattcctctaattccttgcactttaggaggccgaggcaggagggttgcttgagtttgagaccagcctgagcaacatagtgagaccctgcttctacaaaaaattaaaaaatttgctgagcatggtagtgtgcacctatagtcccagctactcaggaggctgaggcaggagaatcacttgggcccagggggtcaaggctgccctgagccatgatcgtgccactgcactcgagcctgggtgacagaccaagaccctgtcactaaaataaaataaaataaatacagaaaaaaatgtactagacagggaaatgaacaccaaaatgttaagattaaaaattattaactcttttttattccttggtgaatttattgacttgtgttgaggatgttggaactctgaaagtatctaaattagagaggaaatcacttttatttgcttctaaagcatatattattatgacagaatggttaacttagcccttttaaaaagttgagttgtgtgggagggtgagtgaggagagaggatgtgtttaaaaatggcttgtttatcagaaaaagtagcccctcaaaattagtttcaaaataagagacttgtttttaatttccttctgatcataattttaaattttggtaaaattagtgttaattaaaaacatactaaaacaaacttaaaaattttaatgtggaaattttcagcattatataaataatataataaacccaatgtacccatcactgaggttcaaaagtacatggccagttttactttccaacataagatactcagtgttctcatttccctgattgtcattcataagtatatacatgtgtatgtttataattatttttaaaagtttgtttgaatcaggaccccaataaggtccatacttttggatggtttgtaaatttcttaaatccattttaatctataaatttctcttctgtagtactttatttcttgcagttttatgttaaagaaacttggtcatttgaattagataaaataattttctgagggataattttaatatggaaaaatagagatggttcaacatcgtgttttacagatttgtcatttgtttattccgttcgtgattatttccatatcccagatatgtcatttgcttactactttcatgattattaccctgcttttaaagttaaaattcatacttgattatcattctaatcttcacatttatggaatcatggatttgatgtctttgttatatttatcttagtacaattcttcattcatgtaccatctaaaataatcctgaccacatattaggatacactgatttaatattaatgtctcctcttctttttattccctccacttacctctcgtgttgaaattcaatcagttactccaagagagacacttgagaccttagatacgtttcctgcatgtctccagaaacaaggtacattctgtgcaaagtatggttttactagcacgctgttagtgaagtgtgttaccaatctgagatcatggttcagccaactcagcatttttatctttcaggttcagattccattacatgtgacatataattttacaggggaacaaataaaaacaggacccggcttctggattcccattgaaataatattttttgttgataaatggaattaagtaatagctgaaaacatttttctttcttttttagggaaagttaaatttgaagatgttaaaattaagaagaaagtgaatttctaagaagttttaaaaaatttgtgaggaaggcattaaattaaataatttgaaaatacgaactttggaggcaaatagaattattaatttactttgcgtggatcactatatataactatgtaacatatggattatctttgtttatatgtcagaataagtatactgaaaataacttaagaaaactcttttacatgcattcttatttgtatctcatgtcactctgcaaggaattatcattctcattttacaaactaggagactgagggaagcccagagaaatcatgtagtttgtccataggtacacagccagtcagaggagatattaagaaccatgtaggggtttgtgttatactgtactaaaaggacactgggtttgaagtcggatgttctggacctagtgctatttactgccttagctatataagcttggatagtttatttcagatcactaggcttctgttatagaaatgctatcatagagaataatagagtaccatgggagttttgaggagagtagttacaattgtttgatattatatacagaacaagaccatattcctaatatttatcttgacatggggagcgtctatgttggagtaattggacaataagttgtcatgggtagctttattgaaacctcatgtgactagtcacatgactacataaaagagagtgtaggtgggtatgaggggactttcctccatcacgtgtgtttctggtattaagaggagaggtgttgggaaggaaaggaggggaagggggaaagagaaactaatgtcttgagaacagagtcacaagtcaaatacatgtgtaatggatatctgttacttcttgatagacactaatggcaatcatctgtataagaacagaagaaagtacagatctctacttttgtctgtttggctcttgccaaattcttctatcctgttcaccaatcccttctagtttccaagttcatttctcttaacactttcaccatttactcgtgttagcaccgtaggattctgactacagtatgtctccctttgattacatattattattgtgctacagctatgtcatcaagcaatatgattagtctataaatgaaagtatttcacacactgcatggccaatgtaatatatatgtagttaagaaattatgtgaagtgagtgaaccgcatggagttctgtttagttcataaaccttatccataagaaatattattggctgggtgcggtggcttatgcctgtaatgccagcatttgggaggccaaggcaggcggatcacaaggtcaggagttcaagaccagcctggccaatatggtgaaaccctgtctctactaaaaatacaaaaaaaaaaaccccaaaaaccactagccgggcgtggtggcatgtgcctgtaatcccagctactcaggaggctgagtcagaagaatcgcttgaacctggaaggcggaagttgcagcgagccaatattgcgccactgcactccagcctaggtgacagagtgagactccgtctcaaaaaaaaaaaaaaaaagaaaaagaaatattatctctgatggctcttttaccttttaaaaaacatgaaatcatgtgacatcggtgtggtgaaaggtcagtcaattacgaattgggactcaggatgaagaggaggtctcaaaggcccccctcacgatcaggaaggcggaactggggactcagtgcatttctttgagattccttagatgaatcctatacatctaagttctgccaccaggatattagttaaaattcttatgttccaaccactcagtacagacctgtagcttatcgtctgtgaacatctaacttagtattagcatttctttcctcaaaatagtgtacacatttttttttgttgttatttggagatataaccaaataataaaggatactattaaaaatcctttagcttttggtaagttaggcaaggttttatatgtagcctctacataaacattctcttatttatagggttaagtttcaggagataagagaaagatcttttgtgagtaggatacattgaaatattagactgtaagtgagctctgtagaccaaaatgctgaaatagcttttctcataagaaagttttgtgtgacaaacactgcaatttgcctatcagatacttttcatccccttttttcttactagaagtactgtacttttttgagggtggcagtgtgccagcctaggagatttgcctttgtagactccttgcagtgcggtctaagtggtatttactaaggagtatttctatttccctgagtcaagtgttcttccattcccttttgatttccttcttcctttctgggaagtgaacacgatgcttggaatttcttgctaccatatgtgaaaataaaaaaacagattaggccaggtgcaatggctcatgcctgcaatcccagcactttgggaggccagttcaggagagttgcttggggccaggaatttgagaccagcctggtcaacagagcaagaccctgtctctacaaaaaagttaaaaaattagccaggtgtggtgacttatgcctgtagttccagctgcttttgaggctgaggcaggaggatcacttgagcccaggagttcaaggctgcagtgagctataatcatgccactgcactccagcctgggcaacagagtaagaccctgtctcttaaaaaattaaaataaaataaaaagtagataaaatctatgtacatgggtggctgaatagaaggaagggagtctgtgacaatgatgtcattggggagatgccctgggctggtttcttttatttatacttctcttaacttgaagaaaataacaactattcttttttgggttttttgctatgggcagctgaatgtaaccctaattttgctgcctaaaaatattttgttacattatctcatatcacaaccttgttattaaaaggtatcagtgctgcccctctgctgcctatatagattttgtcagtagacttgaccagtgaagaacttgaccagctggaataaagaagttatgagaaaaaagcataatttcaatgtaatttgagtgtaagatatcatcaagaatcaaatgattcaagacctctgtcctcctgagcagtaagttgaagaaaacctggcatccagatatgttcttcaatttacaattaggtttctgtgtatagttagcagctttcacacctcttgcagcctggccattccttaagaggtgaaaggcattgagaaaaatggcatattatatacatccgaaaagtcgctgtgtttctccttgacagtgtcagcctgcctgtactccctgtaaaatattcattaggaatggagacttcatggtgcttactggtgacatgttacaagtgttcaggaattgctttcttgactttgtgtagcacagaatcattcctacggtggtggtgagagtattcaggcatttgtgtgcttgtggataggccatttgtgtttcttaagaaacttgaaagggtgtataggagtctctggaacagcgttgcttggtttacctgtatcggagttacctgcatatcttagtaaaaacacagattcttgtgccttattcaagatttacctaattagtatattaggactagggagtgggtcttaagaagcagtactcgtgatttaaggacacaaatgtttgagaaatactgtttttgagccttcctagattcccccaccttcccacacaagttctttaagttgtgtgtttgtgttaatattatggtgctgaattaacccattccttttggtgaatgcatctttcactacaggcatttgttgttgacactgatgcagtccagcttgctgaatggcggttctgcatgtgaaatcaacatttagattgattttacacgagtgtttaatgtttgtggaaagtacttttcttggattagttaatattcttgaattgaaatgatctgttttttaatgaatagccaaagagctgctgttcctttaatggtgcttatatgacttacaaaattcattttcaagtttcctagcaatttttattacttccattttattgggaaaatctttttttctcctttcataggtgttaactttttagtcacactttcctaaagctctttataaatggaaaaataatttttttaaagtaaaccatgatattcttaaaataacttgcttctactttgaatagattaaaaacaatgagtgtcacttctaaaccatacctttgtgtttaaatgcataccgtaagtagccatggaacaaacatcttttgttatttttgatacaaaaatttcacttctaagtaaaagacataagaaaacacatatccataaaaacctgattctgtacctatttaaaatagaacacttacacattttaaagtgtttctacttttcgagtcagatcttcagcaatgccagttgcagtttagcctgaaggtgtttttgagggttcctggttgagcatgtgttttacattccccctctccaccctctttgtttattggactgttttagtcatcataaagtgcttcaatctttactaaagcaaatgccgtaaaggatctgccttacaggcaattatttctccatgagtaaggtgaggtagcagtactacggaagtgaagtcagctgggagtacagctcatctccttgtatggaaagtaattttgcaggaagaattactttgtacgccacccattaacagttaggcattccagaagatgctccttttggaatggtcataaaggtgtgttttcttcttttgatgaactataagtagccctggaagatttggcactccttcattcttgcgtagtatatgggccgtctttaatagtatattgtctatttttaatcatggaggaatagaatggctaattgagacaagtagctgtgttagcagctgtgaaccgggcctatctatgtcagtctggaatactttgtccctggttctggaactttacagggtgtgggaatgcttgatgaattatcttaggttacacaacatgcagttctttggaatgcatatacatgtatattatacatactttggatagacacttgtatttgaatactgagtagtatataaatgatgaagtcattttagagtttgactgtcaggcagttaacatttgttgctttgtggttttgtcataatatgatccttactaattaggtgcagaatattcagaatattgagtagtatctggttacatctcttttatgacatatatataaatataaaaatatttatctaaaacttaaggtttaatgatatttatacaatattaaaacagtataggaatatacaaaaatacaaggcctggcacagtggctcacacctataatcccagcattttggaaggccaaagtggaagaattgcttgagcccaggagttcaagaccagcctgggcaacatagggaaggccccatctctacaaaatttaaaaaataaaataaaataaaatttcctcagcctcttccagccttcctgcttcccatatgtaatctttccagcacttttgtcttcatttggttgctctaatatgctccaacttcccccacaaatacatgttgttctgcagctttcttttttttctttaatatatatcatgggtatgtgtccaggtcagtacgtatagacatttatcatattgatgtaacatatttatgcatcagaatttctactgatattgtaattattttttatatccagaaatttttaaatgaatgtttttgtgggtttttttttgcctaatatatatttttatgtggctataaataaaaaatcaaatatgaactgtggggggtataatcttattgagtgtaataatttgtatgcaaattttagttaaaattaataaacaatttcaaaataatgtaaacatttttgtcaacaatgactaaaatattataaactctttatgaatgttttctatatacttgtttctgtataaaataatatctaatgattttagattgcattataaatattttaacccttgatatctgctgcaaatgtgctttctattcagttcttctcaaaattaaaataaaaataagcttattaaagacttataagtaaaataactagaattatattccatacactatgtattatttattcatattactgaaaattactgattatatccttccatataacagtggaaaaagaattggtttggtgactcgaaggacttgatggtcaaattaattgattttggatatttcatgtattctcattttaaaacttttctttagtttcttatttattatcctgtttaatgtaggctggtattaaaatgagtcagcatttctgataattgtgtaaatgttaaatgatagcagaagccaatttaggattaaacaaaaattgttgtggctcctctgctaatcacataatccaaatgtgaattgagagattattcaagaagtgatgattcaagaagttaaataatacttttaaatgacaatttttataaattgcaatgataagtaattcaataaattaatttgggtttacccagaagagcataggagtgctttcttaatatacttttcagttccatgactagttatttttatactgctatgtgaatgtgaattttgtactataatataaaatgactgtataccattgtttcttatacaactttatttgtcaaaaaactcattataccctacctctatcataaagcaacatatctattcccactgggaattttcatatgctagtgtggaccttgtttgtgtttactaacagaaatctttgatatattaattgagagatacagtcactgtttcattgtgggaaaactgatgatcatcaccttattcagagcaaagccaaatgctgattccgactgctaaggggattgatttaactggcacctagcatttgtactttagagaagaaacttaaccttcttctaagcttttgaggtattcaggtgtttgattaaatcatttctttccagagatttttaactctgacattgattatccttatctaatattttagagttaacattatcatattatagaaccttttactatttccagttctatttaaatcctgggacagtttcctttcctttttggactgagaacaaattgaatattgaataatctctttggaatgtatcttttagggccttgttaactggatgaattcatcactttcatattatgctgctattctttcatgcctttcgagattttcaatgaaaagtaagtttcacagcctttacaactgagaagcatcagctgtgttgatttttttttacagcattggtaaggtgaatgtgcattttatcacctctgactcatggaagttaggggtttcttgtgccggaatcagataaaggaaggaatatcatttttataatatgatagaaatctttaacctactttaaaatattctcccttcatttttaaataatattttaattgacatatcttaattctatacttatggagtacaatgtgatgttttgatatatgtaaacaatgtggaatgattaatgcaatctaatgcatatccctctacctcaattacttatcttttttttgtggtgaaacatttgaagtttattctcctagttttttcaaatatacgttattattgactgtagtcatcctgctgtgctataggtctcaaaacttatttctcctgtctgtctgaaactttgtatcttttgaccagtaactccctattccctcccctcaatgtcctcctttaaaagtaatttgtataatagtcaatgctgatacacttttttcagctttaagaattgtttttcttttcccatttcccatgagttaatggataagagagaggaccaatttaaatttatgaagcaggatcttcaatgtgtttgctagcttgaaaggtactccacatttttattataagagaatgtgttggaattaactgagtttgtgttgaattatacttcctctcttttttttttctctccccatcctgttttctctctttctgattggaatgaatttattaggatcttccacatgcagtgtgcatgcactgtggtagtttttaaaatttaggtgaagtttacataacatgaaattaaccattttaatgtgtataattcggtggcattttggtattttcagtattgtgtgaccacctctatctaattacaaaacattttcattactccaagaggaaacttggtacccattgagtatttactccccatttctcctggcagccatcagtctgttttctgtctttacggatttacctattctgggtatttcatataaatggaatcatatgtgtccttttatgtctggcttttttcacttaccataatgtttttgtggttcatctttattacagcataataccggtttcttactcctttttattgcagaataatattccattgtgttatcatatgtttattcattcatcagttggtggtcatttaggtagtttccacttttttgctattgtgaatcctgctgctgtgaacatttgtgcacaaatttttgtgttgacagatatttttattgctcttaggtatagacctaggagaggaattagtgggtcatatggtaattctatgtttaactatttgaggaactatgagactattttccaaactgggtgcaccattttaacttcccaccagcagtgtatgagggctgcactttctccatataacatggcaacacttgttattgtctgtagtcatcttggtgagcatgaagtggtatcattgtgcttttatttgcattttcctgatagctaatgatattgagcatctttttatgtgcttattggacatttgtatatcttgtttggagaaattgctattcggatcttttgcctatttaaaaattatgatttttctattatagagtagtaagttttttaaaactatattctagatacaagtcccttttcatgtacatgattttctttcattctgtggattatcttttcattttcttgatggatttttttttttgaggcagagtctcactctgtcacctaggctagagtacagtggcgagatctcagctcactgcaacctctgtctctgggcttacatgatcctgccacctcagcctgccgagtagctgggactacaggtttgggccaccatgcttggataaatttttaaaaatttttttggtagtgacggagtttcatcatattgcccaggttagtctcaatgacccttttaattgctgaataataatttcttgaatgtatgataatttttaaaactctataccataaagatgataatttagtattataaaagctgctgctttaaatattctgcagtcttatttgttaatttccttagggtaaaccaagaggtataattattggggccaaaagtttatgtatttttatattttttgataattattgctaaaatgccctcaagaaagattatactccaacagtgggagcatttaagagtcagaaaaatgtttagaagtgtacatttttcatagactattgtaatctgccttctcactgtatacattagattttgactacgtacttgactccagactactttcatatcttgcaggttggtgtaatttttctctccctctaatacatgttcctcctgtattgctaagccttttttatttttctccagacaggatatcactgtgtcacccaggctggagtgcagtggtgtaattgtagctcactgtagcctctacttgctgggttcaagtgatcctcccacttcagcctcccgagtagtagggactatcagcatgcaccaccatgcatggtgaattattgtttttgttatttttttgtggagatggggtcttgctctgttacccaggctggtctccaactcccggcctcaagcagtcctcccatttcagcctcccaaagtgttgggatcatgggcttgaggtgctgtgcccagccaagacttatagctgcatttcttcatgcgcttctgcatgtataccttgaaatttctgtatattttttaaggcttcaatcaatatggcccttcttaatgaaatctttctcagtttcaacacctaaatacaagtttatcctgagcattcactaattttttttttcttgttttttttttttttttttttttttgagacggaatttcactctggtcgcccatgctggagtgcaatggtgtgatctctgctcactgcaacccctgccttctgagttcaagcgattctcctgcctcagcctcctgagtagctgtgattactggctcctgccaccatgcccggctaatttttgtatttttaatggagacagggttttaccatgttggctaggctggtctcaaactcctgacctcaagtgatccacctgcttcggcctcccaaagtgctgggattacagatgtgagccaccgtgcctgaccacagtttttttgctatcgttgttttttgtgacagagtcttgccctgtcacccaggctggagtgcaatggtgcaatctcggctcactgcaatctccgcttccctggttcaagcgattctcctgccttagcctcccgagtagctgggattacaggtgcacgtcgccacgcccggataatttttttgtattttagtacagacggggtttcactttgttgcccaggctggtcttgaactcctgagcaatccacccaccttggcctccgaaaaatgttaggattacaggcgtgagccaccatgcccggcccgaccatgttttatatattcgtcactgaattctagaactgaccactgtttctgacatataatagtggttctccttaacactaactttatgcttggaccaaatcaggtttcccgtcagtattatattctacagtatatctttcatagtaatactgtgttcaactttaaaagcttgttaattgtgatcatactcttactaggattatactaaaggttctacttgtgtttgtgaacatacatgacaaaaacacacatattaaaattatttgtttccgagttttatactatctaatgacacaactgtgtaagcatggtattttactgtttaaaattgtaaagtatcctgttaaactttacttttaaatttttcttaagacttcttaagttgcagtaactgtctatcagatgttgaccttaacaacatctcctgttaggtagaatgacaaaattaaaatggagcttagttgaaaaaaaaaaaggtttggccgctttgaagataaagatgcatatgctaggaacaggcatggtatgctctgtggtcagggaaggcctccctgcagaagtgacttctgagctgtaactggaatggtaagaagatcatgatgcatattactaaggacagagccccactcccttaaaccattccagggagggaggaggcccccagtgaggaatggctcatgctttccaggggggtacacaccagaagcaaggcttgcaggtgcagaagttcctgaactcacgtatgatgtagttgcagagagttttcaattttcatggagctgtgtgagcttgaaagatgacagtcagtttgaaagatgaccatggaccagttgccagaggggtcttcctgaatagcctgctatgcagaggaacttaaggatttttatatgtccttgggagagggaagagaggagagaaaactctaacaatggctaaaattgaatttccctcaattcagaggaatggggacttcacagtcagcttcattaaagaatatgtgacatttctagcaaaaaaaaaaaccaaaaaacaaggtttggcattgtagttatttgtccatctaccctaggcttacagatttgttcatcaagtagcaaaaacagatgatttacatataaccaattgtctaggaaatttttaaaaatttgagtcatttgactgttaagtagaaatgaatgtattacttattttgtaggtaaaaaaataattttagaattcttctggaagtcttattaaattgataaatatattagaggtcattttaatgatgatcagtacaagattttttccaagtgaaatctggggattgctttattcctcttataccttgaatatcactaatgcattaggttgaatcatttgggggctgctttcgccaacagactaatgcccaggaaatatctgggtgaacagtttgccagatgcacactttatttatttatttgtttatttattaattaagagacacagtctcagtctgttgcccaggctagggtgcagtggtacaatctctgttcactgcagcctctgcctcctgggctcaagcagtcctcccacctccacctcccaagtagctgggacaacaggtgtgcactaccatgcctggctaatttttatattttttgtagagacagggttttaccatgtttcccaggctggcctagaactcctgggcttgcgttccagtctgctggccttggccttccaaagtgttgggattacaggtgtgagccaccccgcccagcccagatgcacatttgacctaatgaactgacaattcactgctaattttaggttccatttgacttaatcctaaaaatgagagcataagtagataacagcctgtacattgaagtagttccagaaatattggatttatctaaaattatgtttttcattatagtgtagttgccctgtaaatttttattgatggtagtgcataaaaaggcattaaaatttgagacttcctgattttagaaggtttatgccaagcaagtttgacacttttaagcttacaccaaatgggtgaattgtgatctaagaattgcttaagactatacttgggtgcagttttcattttttgaaggctgctttacatgtgattctttgtcctatgtattatctatctcaaaagaaggcattgtaaatggattgaattgaattagcacttttccttgatggcttttgtatccctaatgatgttgctcagcattatgagggcatgtcttaacagtaatatacttatgatcagtaaaatctttctgcttagtattttaaagttgagaagataattaattgatttttcatcctaatagtaatgactactttttatttaaagaggtgaaaataataattcagacacctaatataagtatcctaatagaagtaaaaagtagaggaaggacttacactcactgaactatataaaacatgatatgattattgattttataatacaaaattcattttggaaaaataaattgattatgctcatcttttaagatatctttctgaggctaccttgacattgctattggagagataaagggaaaaaacatctacttgaactattctgtcttaaagcctgtttgtagtttggtttgtcttcagtgcatgtcatcaaaaagattatgtagacagaatgaaacagcttcatttaaaaaactgaaatgttttgtgttaactgtgtgtgaacgatatattgcccattagaatgtatatctaatgggccatcctgtagttcaaatcttaggagattttgggccactgtgagctaccaacatttgtctctttaaaactgcaagattgaatgggtagctacgtgctggacagcatgtagctgttgagaaggctttggatgctgagagaaggaactcaggatacctgtttgtaagggaagttttaacttgttctgtgtcctgagaggaaaaactacactgttacagttgttgttggaaaatcctttctgaagaaccaaaagagttattttctcactgcttagctaaacctagatattcagccagtaatccacatgaggattgacctgggctttcggatcagggctcagcattgagaaaccaagtatttgtgctttaagaagcgggctcatttgtattgtacttgctgagggacactactgtaacatttattcctcatttaaattcagtggctaaatttaaaatcacttccccaggagtaattgcagaagtctttcacccatggctgaaaatgaaaaataaatttatttaatagagatgcttttgtgttttcatatttcatttaaaaaacttttgctatcataatgacatattcacagttcacgactttcacacatatgggtcttctttttgaaattctttctgcctagctaacacttggactttctgaggaactaacctggttgactcctagactagttgagacatgcatgtcacttctcaaaataccttgcattaaagaagtagcacatttatgagaattgtatttaaatactgaaattttactaattatttaattactttctatactaacttcacaaggcaacacttgcattttcgttgttgttgttcactgctgtattgccatttcccattgcctctttgatgcttaatggatgtgtacagaatgaatgaatgcatgtgtgcatccactgtaagatgaggaggggaaactgatgtgggtgggaagacctctgaatcataagtaaagttttgagggtttttctcctcctctcacatttgtgttttggaaaagtaggttctttaatccttcatgtgtgacctttcacaaggcaattaaatttttttataaagcctgttttactttattatgtgacttcataattataactatctgatattttattctcatttagcagattgctcaaacaataggtataaaagctgttaacggtaaaaatgtagctgttaatggtaaaaatgtgaatcacaaattattttatggaagtatttagggttgggtattgtggtctactttagtagaccatatgaatgagaacttgaacactttcaaaataatttgagataagattggttagaccaaatggtcaccaaaatataatttatgttaatagatatttctggaaaaagcgaagccttctctgaaaaataaagtctttcttataattaagagacatgcatattatattttactgttacaataaccacaggtctttatttaattacaagagagaaaaaatataaaatggaggaaaaaagtaattatctgtattttttcacccctttcttggaaataaatggaaactttcatttatttatttattgaataagtcatatattcataaggttctaacaaaagctacaacaaacacataggtgaaaaatatatattatattagtcttctatatttgcaggttctgcatctgtggattgaaaatgtttggaagaaaaacaatgtaacaataaaaaatacaaagaaaagaacctaatactgtataacaacagtttacatagcatttacattgtgttaagcatgacaagtaatccagagatgatttaaagtatataggcagatgcgtgtaggttatatacaaatactatgccattttatataaggcactagtccccagtccccgggttatggatgggtacagatccatggcctgttaggaaccaggctgcacagcaggaggtgagtggcaggtgagtgagcattaccacctgagctccgcctcctgtcagaccagcagtggcattagattctcagaccagcagtggcattagattctcagaggagcacgaaccctattgtgaactgcacgtgcaagggatctgggttgcaggctcgttatgagaatctaatgcctgatgatctgaggtagaacagtttcatcctgaaactgtaacccatcctcccctccccctgacccacctgtggaaaaattgtcttccatgaaaccagtccctggtgtcaaaaaggttcggactgctgattaagggacttgagcacctgtagaattttgtatctgcagggggtcttggaaccaatcccctgaggatacccagcatgaccatacttttcatatattttaagaactgtatgtatttcctttcattagacagacgcttttaatgtaaaaaccttgtacatagtagagaatctagaagtggtatcactttgacagtggtgactctctgtactttgataactcaaagtataattttttctgattaagtttctgcacctgttagcaaaagcaacccctttcagagcatctgaaaccttgtaagaatttttgaaaagctgtgaactttattaatatttgtgaattccttcattttcagccaaagggatattcatataacagttaacattttaccaagtcttaaactagaggattgatattcacaatatttggcctcaggaaagttttatgtaagttatacaggcatttttcattttttcactggggaattgatggcagactagagaggggaagaagaacaaagaaagcatgaaaaggggcagaaaaggtgttttgagaattccggtctttattttccataaaagaagtgatagcaactaaaatagtattttttagttcttttatttacttctaatttttaaaatacaaagtataaagaagactttttaaaaagttgctgataatcgtgtctgctccttcctggtaatattcctaggaagaatatttttctaaatttatttctttcaaagtttatggattttatttatttatttatttatttatttatttttagacagaatctggctgtctcccaagctggagtgcagtgacgtgatcttggctcactgcaccctccacctcccaggctcaaatggtcctcctatctcaagtttcccagtactgagactacaggcatgtgtcaccatgctcagttaattttgtattttttgtagagacagggtttcgccatgttggccaggctggtctccaaatcctgggctcaagtgatccacccaccttggcctcccaaggtgctggagttacaggtgtgagccactatacctggcctttttttttttttttctcagacaaggtcttgcccaggctggagtacagtggcaggaacacacctcactgcagcctcgacctcccaggctcaagcgatcctcccacctcagcctcctgagtagctgagactacaggtgtgtgccactatgcctggctaatctttttaatattattttattttttgtagagatggggttttgccatgttgcccaggctgggctcaaactcctgagctcaaaaagtctatccacttgggtcccccaaagtgctggtatcacaggcgtgagctactgtaccctgcctaattttatggcattgagggcataaaaaatggtctttgctgttccagtgtagtgctaatcaaagtgctgcctgtggatttgtcagtttatgacaacataagttcagaaattgagagtaagaatttagaaatttttatagcaatttgacagtaattttatgtctgttgaatctaataataagaatttggggcctgtattttatagttttttagagttcatttttctgataacttggtttttgttgtattttactaaagtattagcctgaaacagattggagactttaaaagactgacaatcctcacagtttgagaagctgtgctctatattatttcatttttcaatcatatttgagatcttcttattcctccctcactcaaccaacctccctcttctcagagatagacttccatcatcattcatcaagggcataccaaggaagatcttcccaccaaaataaaaatattgggaagaaatagtgatacccatcagggatgggagaaaaactcagaaggctgacttctttcctctctggatgagcctactaatggggttatggagtaaggttcagtaggagaactgcagagatttatagaatgaagaaaggggactttgggggctctgccttttctgctacttttctctcttcgtttccttctttttcttcatttctctccccttttcccttattcctactcttcttctgcttccttttctctcttcctttttggtctaggtggttagaatttgtgactgaggaaatttgttttgaagcttgtgtgatgtttggaaatagctgtgtttctcctggaagctagaagagacataccgagagttaatcagggcagccatctagagttaggctttaagagagtgaaaactcctgacttatccagcctactatatttaagtaggaagaacagatagtgagattgagggattcaactgttaaagaatcaaatgtgcaatgtgtcaaatgtgttatctcaggagggaggatggcaatgatgtgtagggtaagcggcagcccacatggtggtcatgagatgggctttggagtcacactgcctgggttccagccccagccctgtgatctttagctctgtgaccttagactagcaacttaagttctttccatcttgttttctcagttacaaattgaggataaaagtatctactccataggatttttatgagattaagtaagttaaggccgggcgcagtggctcacacctgtaatcccagcactttgggaagccgaggtgggtggatcttttgaggtcaggagtgctagaccagcctgaccagcatggtgaaaccccatctctactaaaaatacaaaaattagccgggcggggtggtatgcacctgtaatcccagctactcgggaggctgaggcaggagaattgcttgaacccaggaggcagaggttgcagtgagtcaagatcatgccactgcacttcatcctggacaatggagtgagactccacctcattaaaagaaaaaaaaaagttaatacatgtaaaacatctaactatccaggaagcatattgaaatagatatctttgtgattgttgccactgctgtaggtactagccatatattttgcagggcgagctttggtaaggttttttcctttctagtttgttattttgaaaatgttggttttaattcgtagacagacatttttggtaatgattgtctttctgttttcaagtttagagatataggatatgttgggtattacttaaattatttcccatgtccccctgtaactgatagtcacaaaacagaggcatagaaaggtaaattattagggtggcaagcaaattactttatatagtctacacttcctcatctccctcaccacctaaactgcttaaactgctgagcaaactcaggacgataattcagtgactggtgtactccgatttgaaataactttttggatactgaatattaattcagtgtttaaattattactgcaagaggatttcttaatctgtctttagccagtagaatttttgaataacttgggtatttttcactgacttttcctaaataatactgttttagaatagcctctcatcgtgtagtaggaagatggttttgatagtagagcttcacattgggacaagaagagcagtaatattgtccagttcatgtgtgaatttattttagagaactgccaagtttctcctccgatgtgcctgtcacttggccaccagaaggatttctttcattgccaatcaaaccatttagtttctgatgattgtcctattttaaaaaacccaaacatctgatttattttccaacgttgatacctcagacttttttctccatcaaacaagcaagaaaggtcatttgaacatctaactgttgaccactcagagttctaccccttttatattctcactgtgttctgcttgtttctgttagctcataaatagcaggttgtgattttggctagcatcaagttacttaacgtgagcttacatttattatatgcagaatgatagggaaattgactgtgtttagctatcacatctttttattcccatttggagtcattactattacatctttatgggacaatttaaatatcctgtttagaaataatacaataccctggataatcagaattctgtttggctaggagacctcctactcccttgtttcaatcatttactagtgttatcacagtctaatagaaaggtattttagtattttcttttgaaattaagtttattattcattttagtaatataaatccaggttcctattaactagattgaagctcacatttcattttatagcattttctacaaaaaagcaaaaaaaagtttgtgatctgattgaaatcactatgatgtgtaatgagaatcagaacttcatggttgtgcgactttctttttttttttttgagacagagtgtcactctgtcaccaggttggagtgcggtggcactatctcggctcattgcaacctccgctcccgggttcaagcaattctcctgcctcagcctcccgagtagctgggattacaggtgtgcgccaccacgcctggctaatttttgtatttttagtagagatggggtttcgccatgttggccaggatggtctccgtctcgtgacctcgtgatctgcccgtcttggcctcccaaagtgctgggattacaggtgtgagccgccgtgcctggcccgttacgctattttcatggagaaagactaccatatgtaactgaaattgtgtaatggtgctcttgtgtctggtcatttatgcaccagtaacttgttaaatacataatctgtttctcattttcagattcatgtcttctgttcagtactcagggcttgtggttgtctgccttgtgtttagacatacccaggaatctcattactttgcattgaagactgtttttatttttggaatgttctgaatgtttccaaactctgaactgtgctgagtattgaaatctttctttctggaacttgcactcataaccactgttcttacttagaggattattagattcctgggtcctcactgagactttctaaaccaagtttcttgtaatgagtttgcatagtctgaattttataacagtgccctgagagattttaaagagatgggcagtggggtggtggggataaaaccaaagtgtttttcctattttcacaccattcagcacaacacttctgacaatagacatgtggggatatttccccatacaccaaccagtcatttctccagtggacaccagccgggtgtactgcaattcaattctgacactacctacctggagatagccttagatcttacagattgagggttcagtcctacaagactgctccacatttcagatgccagtcttaagtcactttttttttttttggaaacagccttgctccatcacccaggctggagtgcagtggcgtgatctcagctcactgcaacccccacctcctgggttcaagcgattcttgtgcctcaactacccgagtagctgggattacagttgtgcgccaccatgatgcccagctaatttttgaatttttagtagagatagggttttgtcatattggccaggctgatgttgaacttctagcctcaagtgatctgcccacctcagcctcccaaagtgctgggattacaggcatgagccaccacgcatggctggaagtcacctatatttctgatcaactggctataaattgctgggtcccatgactccttccttgggttcaattaattttctagagatgctcacaaaactcagggaaacactttacttacatttacccatttattataaaggatgttacaaaacagtacagacgaacagccagatgggagagatgcacagggcagggcgtatgaaaaggggaacagcgcttctatgccctttctgggagccaccctccaggtgcctccaggtgttcagctgtccaaaagatctctgaatctagtccttgtgggtttttaaggaggcttcattatgtagttatgattgcttacgtcattggccattggtgatcaactcaaacttcagcccccttcccttcctagaggttggaggtggggctgaaagtcccaaacttatcatgccttggtctttctggtgaccagcctccatcctgaagctacctggggcccccagccactatcatctcattagcatacaaaagacacttctatcattagatttcaaggattttaggagctgtaagctaggaaagtggaccaaatatgtatttcatagtatcacagattttgatcagccaagtgtgggaagtactgctctgtaaaacacagtaattcagtcttttcaacgccatcatatttaaagtaattcctagtatgatataatttatggatctttctgtgttctgatggtgattgtttctctgatactgaattgcacgtaatgttcttgatgtctcagctaaatgattgacaaaataccttagactgggtaatttataaacgacattattttatggctcacagttctggagactgggaactctgagatcaagttgccagcagattcagtgtctcatgaaggctcactttgcttcaggatggtacctgatagctgtgcctcacatggaggaagggcaaagaggctaacaagcttcctcaggcctcttttataaatattactaattttattcatggagatggagtcctcatgacctgatcacctcctaaaggtcccacatctaaatactgaatttgagattaagtttgaatatatgaattttggagggaataaacattcagaacatagcattctgtccctgtgtgatggttaatattaggtgtcaacttggttggattgaaggatgcttagatagcaggtaaagcattgtttctgcatatgtttgtgagggtgttgccagaggagactgacatttgagtcagtggacttggaagaggaagacccaccctcaatgtaggtgggcaccatccagtcggctgccagcaccgctagaacaaagcaggcagaagaagatgggattatctgtcttgctgaggcttctggctttcatctttctcccacgctggatgcttccttctgttcctcctgcctttggacctcagacttcaggttcttcggcctttggactcttggaattaacaccagtggtttgctggggctcttgggcttttggccacaggctgaaggctgcactgtaggcgtctctgcttttgaggcttttgaactccgactgagccactactggcttctttcttccccagcttgcagatggcctatcgtgggacttcatcttgtgatcatgtgagccaattctccccaataaattcccatatatatatatgggatatatatatatatctcctgttggttctgtccctctgaagaaccctgactaatacaccctggtgtcccaaaattcatgtccttctcacatgcaaaatacattcatttcatcttggtagccccaaaagtcttaacttgttccagcatcaacttgaaaatctgaagtgcagagtctcgtttaaatatctaaatcgggtatgggtgagactcaagttatgattcaccttgaggcaaattgctctccagctgtgaacctgtgagatcaaacaggttatgtgctcatatatataaggcactcattaaccatttgctgaaagaatggaacctcatggcaaactaatctaactctgacttttaagattacagtaaaatattggtctcagcattcaataattatcaacagttggtagtactgataatttttggtgtacacaaggaaagccctaaatggattctagatttacctgcaacttctggtagtgaattcttgttctctctaacagaaatggctttagccttatccttatatttgagtgcttctgggctgttactttgaagggcagaggtgatttgattcatcaaagcactaacgtaatgagtgggagaggatgaatcagcagacagtgtgctggagaaatactctgccaggcaaaccaaaatcttgcttctctgctccttcactccctccttggtatggactttgctcaactgggaacagtgacattgcttaatagatttttccctaactgctgtcagcaccctgccctctgccaatctcagcattacccagagcacaggaacacatggtccaccactgcagtagaacaagaatcttcagtgttgcttcagtttattttactcttagttttaaaaaagaaaaagaaaaaaagaggcactgacataagaacatttcctttccatttctagctgttttttgtgattgtgcatttgatttctgtaggggaagtaaaacagctagagttaaatcaatgctgtgtgacgagagaccagagagctagaagtgatctactaacatttggtgctgtcttgataaaagccaactgtgtaggctggcttattgggcaaaaaataaataaataaacttaggattgtgaaaaaaggtacaggaaacttattaagtggtattggtggaagttctaacctaaacaaagagctggaaggaaaaggctcccttggaggtcagaaacttggctccttgggtcaagtgttgatgggccttggttttgaaaggctacagctgtataaaggagtctgttgccatacgtcctggggctggaatgggctgaagactttctcatcttctctaagggataggagaacatacttagtagaaaatgcactgataggaggaaccaggagttggcaagcatggatttcttggaaacaatctggcatccaggagtaatagcacataatatatacaatctgttataaagaataaaatcacactagttgatatggaagcagactgtaaacttagattgttcagaagttatttatcatcctatactgtgctctttatcattactttcaatggcaaaaactgtgattacttttgcaccaacctaatatgacttttggcagccttgctatccttgactctcagttttcttgttactttctccctatgctgtagacacctttaattgcctgccattccttggaaatggtagtgttttcatatcatcgtgtctttcacatgttttttgtttttgcttgcagtacatacttctttcctttttttgtttctgcaaattccaaaccatgttttattactcaaagcagttgtcatcatctcttgagaaactgtcttcatgcctccaaagtgtattagttgttccagtctttgtgttattgatagcttgtatacatttcatcattatatcataatggcccagattatcttttctctttgcttgtccctctgcctggaatgccttgtctctggatatctgcttgctctctcctttactttgttttggtctctggtctctgttcaaatgtcacccctgccagaagtcttccctgactacccaaacttaaaatagcatttcttggcattttcagtaccctttctctgctctatttttcttttgtagtacatcttttacttccagacattttattacatatttatgtttatttgttgattttctctttccccctactgaatttaagttgcatgaatgcaaggacctcattttgttcattgccatatgatgccatgcctacaacagcctagcacttagtagatacttagcaagtatttgttgaatgatagaatgaatgaatattttatttctccatgtattagggttctctagagggacagaactaatggaatatatatgtaaaggtgagtttattaagtattaactcacgtgatcacaaggtcccacaataggctgtctgcaagctgaggagcaaggagagccactctgagtcccaaaactgaagaacttggagtccgatgtttgagggcaagaagaatgcagcacgggagaaagatgtaggctgggaggctaggccagtctctcttttcacatttttctgtctgctttatattctagccatgttggcagctgattagatggtgcccacctagattaaggctgggtctgcctttcccagcccactgactcaaatgttaatctcctttgtcaacaccctcacagacacacccgggatcaatactttgtatccttcaatccaatcaagttgccacgcagtatcaaccatcacaccccactagtttaatagttcattcttacagtcatcagcatctggcacttatgtaatcactcagtaaacgtatagtaaatgaataaatgcatagttcagtattaaatgtcagggggctcaactgttaccagtggaaagaagattcttgttctttagatgaattctttctaaagaaacaacaatttaaggtctgaaaaagtagaaaaggtagattattcccactcctagttttctctggagttttccactccagtttttgggtttctattggtgatgtggttttaggtttttgagaaatacccatgtttgctggataagacaagaggaaattatttggaagatctgtgtaaatatttgcacaccatgtttttttccaaataaattctttgatgacatcctagattttttttgtctgtcttcatgtgtttggaatggttccccaatctgcattcttagtgatgtctgcttgaaacagtttaccatgcccctttttcctgttgctgtgtattagattattatacgaaaacgcagaccttttagtaattttcagttttacttctgtatgtttaactttgattattgttcatctgatagtcctaattttgttgctgttttaatcagttttgcaatgatctcgtctttttcatcttagacccagagctgattttaaccacttaatgctaatctcaagaattctctcagttattttaatattttaaaacaggaaaataggctggccacagtggctcacacctgtaatcctagcactttgggagactgaggcaggcggatcacttgaggtcaggaattcgagaccagcctggccaacatggtgaaaccccatctctactaaaaaaatacaaaaattaactgggcatgatagtacaaataaaataaaataaggaaataaaaataatacgtatgtagcaactggagaagaatacaaatttgttgcccacatgaaaaatgagtattagtgttaataactgtttagactaatgaaaaattgtaaagtctatgtaaatatttatcacctcttagaattgaaaagaaccctagaaacatttgatctaaccatcttgtacagctaagcggaatgaggccagagatataattggcttgcccaaagtcacaacatttgttagtggtaatagtgctagaattggcctcaggtttcctttatactactaagggttgcaagggcatgggctgtcaggcactttcatacatagtttgtggaattataaatggccacaaatattctggctagcaacctagtatcatagaacagaaattttagtgtgcatacctttttattatttttttttatttttaatttttgtgggtacatggtaggtgtatatatttatcgggtacctgagatgttttcgtacaggcatgcaatgcataataatcacatcgtggagaatcgggtctccatcccctgaagcatttatcctttgtgttacaaacaatccaataacactcttattttaaaatgtacaattaagttattattgactatagtcaccctgttgtactatcaagtagtaagtctcatacattccttttaaatattttttactcatcagacatcccccccaacacacacacacacacacacacacccctccactacatttcccagcctctggtaaccatccttctactctctgtgtcaatgaattcaattattttggcttttttggtcccgcagataagtgaaaatatgcttatctttctgtgcctggctttttatacttaacataatgatctccacttccattcatgtggttgcaaatgacaggatctcattcctttttatggctgaatagtactccagtgtgtatatgtatcacattttctttgtccattcatctgttgatggacacttaggttgcctccaaatcttggctgttgtgaacactgctgcaacaaacatgaaagtgtagatatctcttcaatatactgacttcctgtcttttgagtatatacccagcagtgggattgctggatcatacagtggctctatttttttttttttaagatgtagtcttgttgtgtcacctaggctggagtgcagtggtgcgatctcggctcactgcaacgtccacctcccaggttcaagcgattctcctgcctcagcctcctgagtagctgggactactggcatgccccaccacacccggctaatttttgtaattttagtagagacggggtttcaccatgttggcccggatggtctcaatctcctgacctcatgatccgcccgcctcagcctcccaaagttctgggattacaggcatgagccactgtgcctggccagtagctgtatttttaatgttgaggagccttcaaactgttctccatagtgttgtactaatttacgttcccaccaacagtgtacaagggttcccttttctccaaatccttgccagcatttgttattgcctgtattttggaagaaagcaatcttaattgggatgagatgatatctcatagttttgatttgcatttctctgatgatcagtgttgagcaccttttcatatgcctgcttgccatttgtacgtcttttgagaaatgtctattcaaatcttttgccaatttttttattggattattagattttttttttcatagcgttgtttgtcagatgggtagtttgcaatttttttctcctattctgtgttttgtctctttgttgatggttttctttgttgtgtagaagcttttaaagttgatgtgtcccatttgtccatttttttgctttggatgcctatgctagtagggtattgccgaagaaatttttgcccagaccaatgtcctggagagtttctccagtgttttcttgtaatagtttcatagtttgaggtgtttgagttaagtctttaatccattttagtttgatttttgtatatgatgagagatagacgtctaatttcattcttctgcatatggatgttcagttttcccagcaccatttattaaagagactgtctttttcccagtgtatggtcttggcacttctgttgaaaatgagtttcttgcaggtatgtggatttgtttccggattctctattctgttcattggtttatatttctgtttttatcagtaccatgctgttttggttaatataaccctgtagtgtaatttgaaataaggtaatgtgattcctccagttttgttctttgtgctaaggatagctttggctattctgggtcttttatgtttccacgtaaattttaggattgctttttctgtttctgtgaagaatgtcattggtattttgatagagattccattgaatttatagattgctttgggcagtatggacattttaacaatattgattctttcaatccatgaacatggaatatctttccatttgttcctgtcctcttccatttctttcatcagcattttatagttttcattgtagagatcttctttggataagttaattctgaggtacttaatttaatttgtggctgttgtaaatgggattacttttttgaattgttcatttttggcatatagaaatgctactgatttttgtgtgttgactttgtatcctgcaactttactgaatttgtttattagttctaaatggtttgtgtgcgtgtgtgtattcttcaggtttttccaaatataagatcatatcatctgcaaataaggataatttgacttcttcctctccagtttggaacgttgtatcttttttgtttgtttgtttgattgttctagctaggacttccagtactgtgttgagtaagagtgatgaaaatggccattcttgtcatgttgcagattttagaggaaaggttttcagtttttccccattcagtatgatactagctgtgggtctgtcatatatggcttttattatgttgtggtatgttcctctattcccagttttttgagggtttatatcatgtagggatgttgattttatcaaatgctttttcagcatcaattgaaatgatcatatggtttttgtccttcatcttgttgatatgatgtatcacactgattaatttacatttgtttaaccatccttgcatcccagggataaatcccacttggtcatggtgaatgatctttctaatgtattgttgaattcggtttgctagtattttctttttttttttttttttttgagacggagtcttacgtggtcgccaaggctggagtgcagtggcgcaatctgggctcactgcaagctctgcctcctgggttcatgccattctcctctctcagcctcccaagtagctgggactacaggtgcccaccatcacgcccagctaattttttgtatttttagtagaggcggggtttcaccatgttagccaggatggtctcaatctcctgaccttgtgatctgcccaccttggcctcccaaagtgctgggattacaggcgtgagccacttcgcctggcctcggtttgcagtattttctggaggatttttgcatcaatgttcattagagatattggcctgcagttttctttttctgatgtgtctttgtctggttttggaatcagggtaatactggcctcatataatgaatttgaaaatattcccttcttttttacttttcagaacagtttaagtaggattgtattagttcttcagatgtttggtagacttcagcaatgaagccattgggtccaaggcttttctttactgggagactttctgttacggctttggtctcattacttactattggtctgttcaggttttggatttcttcctggttcagtcttggtaagttatatgtgtctaggaatttgtcccttcttctagattttccaatttattggcatacagttgctcatagtagccactaatgatcctttggatttctgcagtatcagtagtaatttagtctcctttttaatttctgattttatttttaaatgtgcatactttttaagaaagaatttctaaagaaaagatacatatgccaaaatagaagtataatattattcatcactttatgtataacaacaaaaaaattaggaagtaacttaaaagactaaatagtagcctgttgactaaatacctttgatttgcagtgtggcagttcatcagatgtttattgtgttttgtgtttacgtctgtgtatgatagccctaaatagaaatataagatacagttagtttgaggagcattgtattatggagagttgggtacacatgtgaaaagtggaatagtataaaacagtagatgagagaaagagccttgcctcttctttaatatcttttcttagaattgaaggtaatgccttatgggaatagggccttattaaatgttaatgattaacattttgaagattattaaggtttttaaaaagcgaatccctgtttttataagctatacttaccttagcatgtgaaatcatgattttgcactatttggaataagcattctgttttaaaagttcttaaattttcttgagctttttgttttgaaatatctttagcttgtgggttttgaaaggcctgtgatttttcctcctgtcgtagaagtatgctggcctggtgtttaccaaccacacttagagaaactctgttctcacatttcattaaatcgtaagttcctataatttttttggttatagacgcctttgaggatttgtgaaaagtcgtggtcccactcaatggaatatacatgcatgcttgcacagaatttgcatacaatttcagaagatttgtctcatcattgagggagggttgaaatgtatgattatcattgttaatccattcccaggtatgctagatttgactaatttgcttttagtctttataattatttgtgacatttcctatcatttctctcactattccagagtaggctatatagaaacactgatttctctgtaattaacaaatttgtttgattttcagatgtttgtggatgtgttctttttacagactatcatactttcacatttctagtaggatattcacacattaacactttggatttagacatatgtagattagctataagtcagaagtgttaatgaggcatctcaatagtaaatcacagttgatgaagacatgtttctatttattaggactttggtagagtagagtaagatgctgttttactaaataagggctcatcataggaaataaacttagactactagaacagaccgtgctgtatcagcaaaagccctgtgtttgaactagatagctccatggctacataaggaaaagagacataattgtcctcttctgtttgcttttataagggaggatgacacgtactttgaggtattctcctcattgctaccatataaggtgtattctctaacttttgagtaaaattggcataaccaaaataaggcccactgttaaagtaagtactgctcatatgagtcaggattacacatttgctcacagagagacatcggtgattgcttgttttatttccctaccattctaacctacaaaaagccttatcattttatttcacagaaaaaggtaataaatccaaagcagtctctctctctctctctctctctcttttttagttggtatgaggtctcacttgttacccaggctggagtatggtagtgcaatcatggctcactgcagcctcgatctcctgggctcaggtcgtcctcctgcctcagcctcctgagtagctgggaccacaggtcccagatggcacacaccatgcccatccaaattttttaattttttgtagagatagggtctcactatgctgcccaggctggtctcaaactcctgggctcaagcgatcctcccacctcagtctcccaaagtgctagtattacaggcatgaaccactgtgcccaccccagccttagattttaagagggatgtttacattagacacataaaccagagattgacattttaaatgtagttgaatagcatttgtagactgctcaaagtgccaacattatataacaacaagtagtgcaggacagaacaatgttaaatgctgaagtgtgatattataaggtagattaataagcactaggatgataataaaccaattaggatttgaaaaaagctttaatgcatatatgcgggggggacatcacatcacacattttctttacttctgctcactttactagtccctcagttgctcgtaaaaacttcaccgggattttatttatttgtgttgttgagtgggttgagtagtacctattgttggcaggaaagcaagttctgtgaaagttctctgtcataggtgtaatgctcacacattcttatgtaggtgttttgcaagggggtggtgacgcaaaaagtcacatagtcacgtttatggtatcctgggaaatatgtgggagagagataactagaaactgtcaaccatagtcttatatgtccagattcaaattttttatttgacagcaggtactggaaaatatattttaaaacaaaattcaagattgctcattaattagattttaagaaaaataacactttctcagtgctttttctgcctcaagaaagtcttgtttgtcagactgatataattttattagcataattcttcaaattttggtaacagcactgtcagaaaaacaacagcttccattttcccatggtttggttcccagggtttttggacatgggaaatttctgttagtgtttctttctgtagccctcatgtttatatgttccttttttacatttactatatctgatggcattcctgccatacccatagtgttagggtcatgtgtttccaagcattccatatttgttgaaaatatgcagaagattgaaacttgccctttggtagtggctctttatataggtacacgtctcctacttgttgcctgtagtacattataggataatcaccaaagtaaatttcttttgaatcagcataaattgttctatttagtaaacatctgactattaaaatggtgttacctgtccatattataaatcatttctattgctgatgcctattttcttagtttggcaactgctggcttatttccaaggaaacgcaaatagaggttattgtgtacattttgagtatttcctgcaatttagaaggataaatttcatatatagacaattctaagacattggagtcactgttgcgattaaacatcgtgcctttttatggaaaagcttagggcatgtaggagctatattgaatgatcatattcaagagaaatcttagatggttagacttatttaaaatgatatctgccataatgggttataatttttaaaaatgaaagctctattggtttgtttgtgatagaagtgctctcaagaggtaatagctaaggggaaggcttagtgtagcaggtatatccaactccttataaatcctaaataacatacttgtttgtggataagttttccatttagtgcacatttgagttccttgtctaagtgttctgctgtcttgagatattaatattttattttcagtgtaattttataaagacacagtactactttttctcttattgttaaaatgattaggaacaaatgctggaacattgtatgtggaggctaagcattttgggtaattttagttataaattttatttgagaacaataaattaatgacatgtttaaaggcacgcaagtattactgtgagaaaatttactcgaaattatagttactaattatgttcatgtatattattttaaatgcaaatcaaaacatagaatcttctcttttctataattaatcattattttgatgttctgttctgtttagatattattttgtgcatatgtacttggatgtatatcacacctagagataaagcctggatctcactttccaacaccggggacatctttgtttcctcatggtcttggttccctcctctgccttctataccggtactcttctttgtttccctgttctctttttttcttttattcctgtccttctctggcctccagctcaaggcttcttcaccaacatcgctttattgcttcttatcctttggccttttggtacagtggcaacacctaactgtcctgagaagtgacaagaggccaccattctttaggaatcgattttgggaaactcataattggatagtagtaagcagggaaggaggatgcagtgaattacgttctgaatgtgtggcatattcatctctgttgctgagtgaggggaaagttaggcttagagaagcagaaggaagtttaaggaaggaagtgaaaagccagaaggaggtctgaccggtcagtttgaaacgctgtcttctctgccctgtatgaccttgaagtaggcttcctgcctatgtgaatttgtgacattgtgtaagaataaacaataatattgagcatttccggtgcattttgtggtatgtgctgtcctggtgttttatttaacctgcccagcagctctgtgaggcaggtggaattatagtcctcattttcaaagagtggaagctgggacttagagaggtcaagtaaattcgggtcacacaaccagcaaatggcagaacatgaatataaactcatatttgcctgacttcaaagcctgtgctcagtattgtagtcttattgttgtatggacatagacaagttatttaatcacgttgaagctctgttttcccatctgtaaaacagacaactaccttacaaaacagaggaatgatgaagcatcctccaaagtccccgatttactgttcatgcttggtagattatagtactaattactttttctgggttgtttctttcttaggacagtaaaacactatatgagaggagctaccttcctaaaatgactgaaaaaaaatttatctttgggtctttcctagtaaagtaagatgggcaagctcaaggatctgattccattttcttttacattctctcccaaattcccacagtctttcctatctgcttgctgaagactggacttccttttcaagagaagacttcttgtcatccatgattacagataaaagggttaaaatgcagctgttcctagggatgagttttaatctaagtacagataactgatattagatcctttcgtactgaagttaatggggaggcttggtaaagataacactctcttcaggagcatacagttttctggttttccttcatttcagcatcagtgaacagacctgaactcagaggcagttccaacatgtacagccatgtgtgcttgcaactgaggtgagaccacaaagtaatgtttttgaagaagcactcagctacaattaaagtctgtggaaaattggatagcagtactgaaaaatgcatttaaagatcaaaaaggaagcatttgcttgtgattagtttgatttatgctgagctcgacccaggagcctcccacaactgcttccttcctacactgtgcttttatgaaatacatacacacttatggctgccgtgtacaagatatactgatgacagatagtaaactactgctttaaacaaatgcaagctattcagacctgaaaaacagtgaaacaaacaaatcaaaaaaagagctatgcaaatgatgaatgactttgtagtctttccttggctgcttagattcataatgctacatcctacccaattaagagaaaagtaacgtttatctttctaatgagtgaacagattgaggaagtggttctggagataaatgaagctcataggagtatttagttaagtgctcctttttacaagtcctaaatttgtttttctgtgtattgggcatttcccactatgtatagcattggttcaagctgatcatgcccttaagtttacatcttatgagtaggaagcctgggtagagaataatgaaaatggttagagattccaaaaagacatcagtgtggaaaactcaagatgattaatattaccaggctgaaaaactgtaaacaaaaaggagtttgtatggcattttaaatatatgaaagattgttcagatgttgatgggcatttgtttccatttgtgctaattgattgagaaagaattaagattcagtacagttaagttcttcctaataattgttatacaaagttgccaagggaagttgtgaaagttttagaaaacctacaatattcaaggctcttggagaagagcaaattataaaacatgatccctgaccttatggagcttgttttgaagctggaaacagattggtgacaaattatagatggcttgtattttctctacattgtaggaagcagaagacatttgcaatttttctactctcattttataaatagggagttgatatgattagaactttccagtgcgagaggtaatggggccaccattcgggaatgttaagatggaagaaaaggagacaaatatggagaatgtgaaggtaggaaaggtctgtagaaaactctagtggaaggcaagtaggctataggcaagagcaatgtgaaagatgatcaagacttggactgtcataggagaggaatggaaggatggacagatcacatttacattgttacatttagtaattttcctagatgtggtacttaaggaagaggcagaatccatgtggctataggattcctgtgctccatgatctgaaaataagggtgacagaataaacgtggtcctagaaagaaaggtaattctaagaaattgattttgaacgtcttgagatgatagcctctcaagagatctagtatgtaaagggagcagaataagaaaagttatctggttatgacattgtctttgattccattattttctttctacgatgttcattacctttatattactactgaactaggagtatttaagttgcttctgttgggtacacttagaacaaatgcccatagatttcagtgtttctgttttcagactactttatgtgaggatggtgaggtaatttaactgcattctatttctagttaattttttgtttaatgcctgcccttctttgctaaaataaaatctaggatgacttatgtttactttctctcattacaaagatgtcaaattttatttcatttgctgattttagtagggaatagatgtccctttgtctcacagaagtcttccagatttgacttttattttaggattaaacatgtaactttgtataggtggcagttcacagataaacttttaaaactggcagggaccttagaaggcctctgagatcgtctagtgcaggccctgcatttctcagatcagtaatctgaggtcaagggaataataatacagtaatagctaacatttattcaactatattatctatgtgtaatcgtgataacctgatagcataagtggaacgaccttcccgaagtcccagagaaagtggcgtatagctcactcgctttcagaactgttttctttaaatgttttctaaaatcattaggtttttttttaaactgtgataaaataaacataacataaaagttaaccatgtttatcattttattttttattttttgaggggatggagtcttgctctgttgcccaagctggagtgcagttgcacgatctcagctcactgcaacctctgcctcccgggttcaagcaattctcctgtctcagcctcccgagtagctgggattacaggcatgcaccaccacgcccggctgatttttgtatttttggtagagatggggtttcaccatgttggccaggctggtctcaaacttctcacctcaagtgatctgcctgtctcggcctcccaaagtagtttatcattttaaaatgtataattcagttgcattcactgaatatagtcacggtgttgtgcgaccttctgacttacctagttctagaactttttcatcatcacaaacagaaactctgtataagattttagtttcaagtactagagaaatactggttatttacttgctttttcgggcctagtctctcccatcttccagcaactcagtattcagtgtgatctacttatacttactgaatgctgagctgtcatatgaatttgaatggtttctttaatttgtacttgtttcatatttctagatatctatgaaaagttcactgtcacttagtataatatatctgcttcttttggggcaatgaaatatatacacacgaaatttgaaggagatcagactaaataatgtaaacacatagaagattttattgagcaggggaagaaagactaaggattaaggactgtgacatgcacaaaaaagttgggttgtctcagatataaagagtttcccttctgcaaatgcctagagcaggaagcacacccagtataaaagatatttgggcttggaatctgaaagaattcaatccccaaaccctggatatgaactggactcaacaggaaggattgtttagcagatcttccctctctgttcctctttgtgctcaaacaaaaatacagctgttaaaagagttttaaaaaattatttctaaaagagtataaaaaccccattcagattgcattctttttattctgctaaaatgtgaagtttccttggctgcttctcttcctgattcataaaaatcacacaactactgttgcacaataaagaaatggagaaatgatcagggaatctttctcagaaaattcagtttttttttatagagcaaataagaatttaagaaaataaacatttaaatcatttgaattttatctttacatgctaaaattctgtacatgttaaacaagacagttttatgttacttcaatagtatattaatatacttttggtataagcaaaagtataatttttatcagcatttattattctttttcaaagagtgacactcctaatgaaatatatttattacagctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaaggtaagttgctttttgtttgtccctgaaagagaaaacaacattgaggaatgtgtttttgtgtgtctgactcacggtgttaactaagactcagtttctgctaccatcatttcaggtaaataaaaaatataatggctcttaaattggataattaagcagcaagagaattgctgaaagctatgagttatttccccatcaaaaggcatgtattcccatactaataaaaattgtgtgggcctgtaatcccagcactttgggaggccaaggcgggaggattggttgagctaaggagtttgagaccagctggccaatataatgagtcctcgtctctacaaaacataaaaaaattagccaggcgtggtggcgtgtgcctgtagtcccagctatccaggaggctgaggcaggaggattgcttgagcccaggaggtcgaggttgcattaagctctgatcgtgccaccacactccagtctgggtgacagaacgagaccctgtctcaaaaaaaaaaaaaaaaaaaaaaaaaattgtgtatacagcttcagagaattcaggaattcttgaaatttctcaatggagtgcaggctaagaattctttctgttaggtaaaattctgagcattatattaaagggtattcttttaggatatgatttggctttcattagtttgtccttttctctttttttttttctgagtagaaaatttttaatagagtcatttgaaggctggactttttgaacttattgctttctaaagtcactctggcctcaagttataaaataattaatcatcacattgtttataatatatcaggtattttgagcatcccatcatttgaaacctgcaccaaaatcatctggagtgcttgttaaaaatactgatgtctatactgaatccgaatttctggaaggaaagaccaggagttatatttattgaagttctctgtggttattatgacttacaaagtttgatcactgtagtatcctgggctgaaggcaagggaggagaaagagggaatgcagagtgatggaagggtagctgtgaaccttcagctttataatgaaggtagcttgatcatatacgaggtagttatggagattttaagcaaatcttgtttttgatggttacaaaaagtgttctgaattctatcaaatttggaaaacaccactttttctccctccccaatctcttccataattatattgcatataattatcttagtcttccataaattatcatgcatattatgaatctttaagagggaaataggctgggcgctgtggctcacgcctgtaatcccagtactttgggaggctgaggtgggtggatcacctgaggtcagaagtttgagaccagcctggccaacatggtgaaacccagtctctactataaatacaaaaattagatgggtgtggtggtgcatgcctgtaatcctagctacttgggggctgaggcaggagaatcacttgaactctagaggtggaggttgcagtgagccaagatcttgccactgcactccagcctgggcaacggagcgacactctgtcgccccaccccccaaaaaaatattaaaaaaaaagagggaaataaaacctggtaccttcccaacatatttggctatggaacctttttcttggagcctctcctaggagtcgtgttttgtgaaaaacacttaggcagtgcttctctgctttttgctactgctgtcctaggtgattgctagtgaaaggatttctataggataaattatatttacctgagtatcaatttggtattaaaactgaataggaaattgtttttgcaaactttgacttagacatacagatctattttgaggtattgtgactttctaagcagtttcctctttagggtctttttaaaaaacttagagaaattcttttcagtgggactgctgaatcaatgtttatatgtattttgaattttgataggctattagctatacattttaatgcgtaggaaagtagtcaataagaaaagtaattggttataaaaaaatttgtttcattagtattcttctgttctctatattgagacatgtaacatgaaagttgttactaatcacatgaaagtaaagtcatttttaatttaccaagtatgaattttgaagggaaatcaagaggtcaagaagcttaacttgtttgagatatcaagaaagcaaaacaaatagagatgatgacaggctgttttacacattctaaaactgaaagtttatttaagggtatgagctctttcatgggttgcgtacaatttctttcataccagcctgcttgttttcacattgtgctgcttattttatgacccaggaaccagaatcttattttctattgaaaacacttctgagccccataagagtagataaaaaccagatgttgccctgtttggatgcctttccaatttatgtaatctgctactgattctaataaagattctttaaggctgcttaaatacagaatctgacaaaccaacttacaaaattgacttgttataaacatttgagtatactacttaatcatatcttcatatttctaaataatagacattcaaggacccaaactattagggagtattttagagtcccattattattcattggcgttctcttcaagtttttgagcagttcttgtgttaggtaatgtcagcctgttttgatagagtgtgtggttaacaaaattcgtagtataacattgacagtgctactgaagaaatacttttgccttttaaggaaaaaaatacaactttgaagagttatctttgattcttttctataccaggaccattctctccttaagttttctctcttatatcaaagtaagtatgttttccaagtttgaacagcatttctttctttctttttttttttgagactgaatctcgctctgtcgcccaggctggagtgcagttggcaccatctcagctcactgcaacctccacctcccaggttcaagggattcccctacctcagcctcccgagttgctgggattacaggcgcatgtcaccattcctggctgatttttttgtattttcagtagagatggagtttcgtcatgttgtccaggctggtctcgagctcctgacctcaagtgatccacctgcctcggcctcccaaagtgctggaattacaggcatgagccattgcgcccggcctgaacagcattcttttttttttttttttttttttttttttgagacagagtctcacactgtcacccgggctgaagtgcaatggcacaatctcagctcactgcaccctccacgtcccaggttcaagcaattctcctgcctcagcctcccaagtagctgagactaaaggcacgcatcaccacgcccagctaatttttgtatttttagtagagacagggtttcaccatgttggccaggatggtcttgatctcttgaccccgtgatctgcccgccttgtcctcccaaagtgctggtattacaggcatgagtcaccacgcgtggccctgaacagcattcttaattgtcctctggtcagttcttcattccacttctcaccaaccagattactctgaattcttccaaactaagttacctacaagagtactttttcagtgaactcttcccttcataaacttgaagttttctgcatgaatatatactactatcatttacagacttgtcttagtccaatttcctagagcagagtctgagatggggattcttgtgcaagtgatacagtaagggattcctttaaggaaagcagtgagtgaaacaggattgggaagcagaagaaactgagatgagcaaaggtgtgatttcaggggatatccagcttcacttgatccagcaggaaacttgggaacaaaattgcactacagagtgagtctgtcttgccttgaggcaatgaaactgggcttttgtacccccttccttgtatttgttagttattagctgtcagctgccctggaagtatgttgtgtgagtaaacagagaagagggctaggaggtagcttatattgcttccaaagaaagttactggtgtgaaccattagaagcaatggaagaaacacctggggaattggtgtaccaaaccattagaagggttccaggagatctaagctgggcacagacaacagcacgtgctatgggattctatccagactaatccctctgctcagaaggtcgtgttctttgtaatcgagtcctcctcacattgtcctctccagatcaccaccactcatcactgaatgccctttcttccatttaggataggtttctcaccatccttctcttgcctttatgccctctcatgaaattcatttcatctgaaatgcccaccacctgttcactgccagtgcatgccttcacatccactaaacccaaatcgagtgtctcctgcccacagtctgttcctactatcgcacctcactcctttttccccttctgaacttgtatgaaatagtttatgccattcagttcagcgtttaattatacactaggtataatcaggaataacaagggcaattccacgagtcttatacaaataaacctaattagctaatagtcatacctagcactgcctatgttatttactaattattccgtgtatattagtcgtggttctccaagaagactctttaagagcaaaaaccatgtttttttttactctatttgtatttgatagcatcttgtatagtagtctgtttttgataggcaccagtattatttcccaaagtaggaatcatttatctatttcactaatattttctgaactcttactatgtgccgggcactgttatagattttggggacatagcagtgaacaaaccaaacaaaaatctctgctttcatagtactgacattttagaggactgagacagataataaacaagtaagcagaatatgtaatatatctcgtgtggatatattacacggaatattatagggaaaaataaagcatgtgagggagcaccttctcacttggggtactcatgcccagatatccaataaccttctcactgtggctttccttaccaccctattttaaactgcagtttcccagggaattgcatgagtatccaaagcagagcgaagagccagtgtggtggccctctgtcagggaggctggtatagccaaacagagtgagtgaaggcagactggttagaagtaaggtcagagaggtagcaggaagggagtagaagtggcgagaacttgtagggccttgtgggtcattgccttgtttgcaatcaaatttaagttttccagggcctatgaaaacattgcgagaaagctccggaaagttatagctggttggccagggatctagagcagcgttttggagagaaataacttacagtcacggaaaggaaggccagaggaaggagcagaccaggtctcccccaactcaatagtggtggcgctgccttttcctgctagcactgtagaaacactggatgaggaccactgctgcccaaattctgctctcctccacctaagaattcccaaggagagaacgaaacccagtttttgtttttgaaaagaaaattaccagtaattttgttttgttaatttttttgcattgaatattattcttatatatccactaatttttaagaaaatatacgtgtatattcaaaatttggtttcatttttaggcccaacctcaatatcttaaaataggatttagataagaaaaagtaagataaagatacttgcttgagtctggtggttttgtaactgttatttatgtctactttaatttgggggcatataataaagcaaacacattttctttctatgacatcctaaaaaataagacttgactcagtatactctgtgtttctaatgaacataaaagtgtgaatggttttattttgatttgtcttttatcgttgaaaaaattggaaaaaacatatttttttcctggccgtgaaactaattctaggagtactgcaactgaactataaaaaattctatttaaaattatttttactcttggggaagtcaggcaaataacagtgcttatttttaaatgtcaaatgtgtttgcctatgattttgatccaaatcaaagtggatcattttttaaaattacattatttcagttgatacaagaagaaaattactttcaaaagcttcgatgtctaattaaactattaactgtattagaactggtttctatgaaaaaggtgtttaactgttccatttatttcagtagttagctacatagtaggacatagataaacttgttacatgcttattgtatgatttagggctagtggctaaactactgggccttaattttcttgactataaaatgaggtcatgggtgatttctaaattccctttttgtaataaaaatagtggttcttgttctggtttttcaactgtaaatggataagttccctagagcttgctattagatcaaaccaacttaagtttgcttattttggctgagagaatcaggaaattggactttcttcattggagttatcttaaactgtgccaggttaacaaagtgacttgtactgttctgctcactttaaggtgaaaggtaggtcagatgggtatgcaagcatcatttattcatcagaaaatacagtactatatatttttattcttattttatgttgttaaattaatcctcttggaatcacagaatatatatatatatatatatatatatatatatatatagtttttctactcttccttgtttttatattactagtagtggcatgtctgtggttttttaaaatttttgtttcttattcttcaaacttcatttactgtctaacttgttatgattagaagtgaaagacctagaagaattgagttttgaaaaatattgatgtactactctttctgccttccccttcttcttcatccttcaaacaacaaaaagattgccagaggtccaaatactgctgctaatgaatgacagattggagtaatttaataggtacattggattataagagaaaagaagaagtagctgttgtaccagactgaagctattagccatcttttgtctcattttaatgggttgtttaatatcccattactgttagctttatgggttcaactctgctgtttctttcaccaatagaatagaggcaggagtttagaaagtacttttttcaatcgaagttttcagttctctatctgggacatttcagttcatgtgaattaaaagatatttagttagattttttttcttttaataattggagtttcacatcatcccatttgaagttactttttttttcttctttggtatttcacgtacttttctagtgtttattcttcagtttagcttttactacttcttctttgcttatttgtttttaattcttaggttggaggatgacagtttttcagaaggactaagtctgattgattatgtcccccatccatcattaaaattagaaatgctgcttaggagtgggaaagaggacaaacatgtattgacatgctttgtgaattttttttttcttacatatatcattaaatccttatatcaatccattgaggaagaagttagcctatttcaggtgaatatataatgccttagaggtatccaatcttttggcttccttgggccacgttggaagaggagttgttttgggccacacatacaatatgctaatactagcgatagctgatgagcttaaagtagtcacaaaaaaacctcataatgttttaagaaagtttacaaatttgtgttgggctgcattcaaagccatcctgggccacatgcagcctgtgggccgtgggttggacaagcctggcctagagagtttgtgtgatttgcctaacaaactcagatcagttcatagcttatgccctccttactttctttgctgtggcaaaggacttaatgactagtctcctagtagatatttgataagatgggatagatgcataataggggtcactcttcctctacttatgagcaactgcatctctgttaaaaagtacttttcattttttactctcccctgtcagtattctgtaataaaaattatacctaaattattttctgtgtgctttaaaaagatcctatatgttagagtgaaaggaaaaagggggggaaagcttataggttaatgggccactagatagaaacattcgtttggatactgacttgtgtatatggtttcccatcctaagccagaaagtcatcttttatttttttcttccaaatttataaccctattgactatatttgctagttcattcctatgcttctatgtatgcattctgtgagtaactaaaaattctggaattttttaaaaaatatgttttatgtggctgactgccacaactactacttgagatcatcattacagcagttactactgttactacttgagccatcattccaacagttactactgttactcctttagaccatcattatgagactgaatgaagggacggacgaacgtagaaatgaaaactttagacaaaagtaactattttaaaggaaaggctagcatggggaagaagagagaagaagaaaagggctccctgcttctggtgagcaaaggcagccgcctaagcttctacagcccttggtatttattgggtaacaagggcagggaggaggaggtaacaattagtcagctgcttaatccatcacaggttcatattgttactaacaggcttcagttatgcctaatcataagaaacacttgcgcctgggtcgtgactgccctcagcaatccttccgggtggcagacgcagtttgtcagtttgccaatattctgcatttatgacagtttgctgcttactcatatagccttcagtggtatactgagttgatcacaaccctcactcttttggcctccaacagttttaggggccaggcactgtggctcaatgcctgtaattccagaactttgggaggccgtggtgggcagatcatttgaggtcaggagttcaagaccagcctgaccaacatggtgaaaccccgtctctactaaaaatacagaaaaatatttagtaggatgcggtggtacgcgtctgtattccagctattggggagggtgagacaggagaattacttgagcccgggaggcagaggttgcagtgagctgagatcgcaccactgcactccagactgggcgacagagtgagactctgtctcaaaaaaagaaaatatgttttagggactgtttcgtcaacatcacgcacactggaagagaccataattgtcaatcaacaaatcaatcagcagacatagaaaataagtatttatcttatatatctctttttcttcaattcagtaggccttaaagattgttggaaatggacttgaaggcacaatttaattctgaatagtctgtggcagtttgacaataaacagatctgataaatatgggttggttaggatgtattttgtattgtgaaattcttcactttgactttacatcttgaaagtttttttttaacatatgaaagtcttatttatttctctgaaggaaaacttacttcaatctatactcctttgggaaagcaatcccaggaataatatgtttaaagatctgtttagttttaaatctttaaaaatttttttggatcacacctaaaatagtctttgcaaaatgaaattttaatatgtagaatttttaaggtccatgaaatagagatgtaaagaaggtgaatggcaccagcattggctttgaaattaggcaaacttgatccaaatcctggtttcaccatttcctggctatgtgaccttaggcaggttatgtaactgagtttcagttaaccacttgtacctgccttctagggcttttacacaggttgaatgaaatagcctatgtaaagaacctaggacataataaagatgagttttctctcttcctatttctctcttcagttaataagtgagtattagtacggtatccattgtaaagtacttctagaggaccatatttgttttgtttcttggcaacaaaaatgggtgtggctgagggaaagagggagaaactgagagagggaaatcagtaggtcattacctgacaaagtcagaaagataatgatgcaagatttagaagagaggattgcttagtcaaatgagtgattttggatcatgtagatgtaattaaagctttttcgaagagtatagaggatgcaaacatgtttactgccagctaattactgctttggttcaaaattattgtctaaaccaataatttatggcccatctggcaggaaagatagtggcagcaaagagaaaccagtacacacctagtcttgtttattctgctaactcctcgtgttcatcttagaggaacgatgcaaatgtagttcttctttactgtgggttaagtcagaaagacaaacaaaaatgtgagttttttctctcattttatattcatgtatattccctttaaagtaattttctgagtaacatattaaaatcaagtaaaattactaacttttggaacatgtttttctgatacttttagaataaattttcttttaaaacccttcctcaggactaccatttattactgaggtttaaaatttcataatgttcattaaatttaaaaatttggacttttccttcagatttacattatgactagcagccataagaggtggacataaagagatttataatctttgcccttaaagaatttataatctctttattgagatcgggagagatagaatatgctacaggggttcaaaggagagttaaagatcccattctaatggaaagcctttgtggagatgcagaaacctgggctaggctttgaagaatgaggttaaatgaaatagcatatgtaaagagcctaggacataataaggataagttttctctcctttcttcctatttccctcctcagttgataagtattagtatggaatccattgtaaagtacttcaagaatatcatatttgttttgtttcttggcaacaaaatgggtgtgactgagggaaagagggagaaacagcgagggaagtcaggtaggtagtcgggtaactacttgacttccctgacttccctctctctgtttcatattcagatggaggaatatcctcttgaagtagtatggagatgacaaatccccaagcaaatgttgaccaactggaaatagagataagaatgaaagaaaagtgaagtcagaatactaagccttgcagggtcttagacactgaggtattattgaaagctttatcagaaaagtgacattttcaggaccatattttgtaagactgcttggaaagaggtggagagagaccagaggcagggagactagtcaggcaagtattgcagtaacctggcttagtgacggcttgaaatagaaagcaggagaaattagagaagtgagaactgagcagtacttctgtaagccacagtcgtgttctggatagatgtagaatgagggaagagtcagaagtatctcaggattttagcctgcttaggcccaggctcagtgttctgcccctttcaccttcctcttgctcttctgctcactgaagtctggctttgctcctgtcatgttactgaaactgtttctcactaagatgtattacagattctgcaagttcaatgtgggcaaaactaagttctatgccttgtctcacaaatttgtgtctcctgctgctgcacttggtgaacggccccaccattcaccccattatccagatcaaaaagacgccttccttgcctgaacctcccactttcacctgtagccacctgttcattagcctttgtatatatgtctcaaaacagactaggaatagagtagaggaaattagtatggcatcacagcatggtggtggagagagacccaggtcctagtcattatgcttatatcttgaacgaaaatgtttaagattcgtgtttcagcatatactaattaaacacttgctgtgtggatagctggggatagaaaggaagttctcatacctgctgtggagctcacagtgctgggcactggcttctaaccttacataaggtcctctttttttttttttttttttttaatgtcaagtgttttatggacaacccttcccccaccacattaagataataattgtatttttagtggctggagattttataagtattgtattgcagttttaaatgaagatgtagattttctactttgatatgcaataatctacatttatttaaaaatccaaatatattgaagatttatgcagacttcattcatggatcactggtaaaaacttaaaactgtgtgctagttacctccagctgcctcaggtatagctttatatgagttgggacgcacagaccaaaaatattttaagccatctggaggtagagacagggaagcagagacactcgcaggaagggagagactgaggagagacagcatgagggtgaggagtgtagcagagatagaaaatcccaggccggaagacagctgaaggagtaacatgagaagattctcctggccacatctgtgtattagcagattaaaaggagcctgattctatgacattggattccaccaagttaacttcacctttattgtcattttaaaaataaaaatagcttaatttcagttttaaaatgagaagtactcaatatttcctggatgaaaaggagtagctgaataaaatgtggcatgctcacaaattaagtggtaacagagtcatacccaacccttcaaaagcagaaacaatatgtatttatttattacctactccagtgcctaccaccatggcttagatgtagtcatagaagataccaaatatatatttattgctttgagttgtagagtatgccacttttataaatatggcaatttttgctactgttgcctgataaatttagaaatcatttacaagttattagtgaggtaaatagtgacaagctggtcattgtcctttagttaatggcagcagtctccttagagttccagataaacatttttgtccatagctcaaggaatttttgaaaggattgaaattcaagtcattcccaactgttttccagtggctgttgttgctattatagtctcaaagactgaaatagcttaggctttatgtgagttgaaaagtacatgggagtgattggccatgcaaaacacggcagagtatttacactgtcaaattcttttgtttaatgtattttaaagcctgcattttcattgtaagtcagctttaaaataggttttcaaatgttactagtcctacctaataacttctttttacctgccgtgatccctgttaatactctttctctgaaattgaaatgcggatgaaaaatggtctttcattcattttttttgtttgtttatgaacttttaatttcttgggtaatatagtaagggttcatttccacatcacagtaaaattcacagggaataatcctgcattcaaatacctctcttacagtcaagtctgcctttatcttggctgttctggctgaagtttatagcactttttcctgttacaatgaatgtgagggactttccagattcttttgttttactggaattaggctttgaaataataggttatttattagtccagaatgttttcttatcctgagaatttctggtacacaaattattcttaaaacagaaaagtatttttatgttttgaaagaaaaattttacatttgaagaggatttaaataaataaattataacaatattcttgattccaagaactttagataatagtatttcttctgagatatgagagaaaaagtgttcaagttgttagggaagcagcttgttttttagtgcatagtaggaatttagtaagtaaagcatattaaagaaaaaggaacttaaacactttaaattgttacctctaagaagttactgaggtaggaactttatgttcattagtcgtgtaatcttaatagcaacttattatggcagatattatcatcctactttacagagagttaagtaagtacttcagagtcacacaacttgtaagtaaataagccagagttcaatctcagatttctctcttaatgtaatgatttgtctgcacacatctttttaagtacagaaattttaaagtatttttattgctcagtaattataaatacttcttctctaaaagttgttttgcttttccaaatacaacacagtaagaattttcgccattaaatttatttcataggagacagagaaaggggcagttatgaagacatttgtttgatattccagtcatttcaaatgccgtggaaacttctagcaaggagtcaaccctgttaagagtattaacagggatcacatattttaaaattctttgaaaatttttgctttattagtaccttacaaaatattccagtatcagtattacctcattcgtttccttagcagctccagtgtgtgcattctctgaatactaattaaagtagctttaatatgatcttcatctgtgaaacagttttttagttgaattacaatgcatggttaagtttgagtattgagaacagacttcataaattcatagcattttagagtttgaagcaactccagctattaaccagcagagccctttatctttatttatgattcaaactttcattttgatttgtgtaaaagattgcctactgtgacagctctgtgacaactctgtcacagtagtgacacaggaattggagtagtgtggtggaggagggaaggaagaacagattggtattaaactgtggtcttaacctttccaccctgttgaccttgctctgctgctttctccatctattttgtggactaattacaatgttcttttaggtatctcatctgtcagtatcttatgctgagattgggaaattctggatttagtggtaaattggtttatagcaaataccataactattaaagaaaccagcatgttttccattttctgtaaccttttcttatactttctttaagttgtttattttcctgaatttctttctttctttagagcctcaaaatccctccacttgattctagggtgccaaaatgtcctctctcaactgtacatatgtagagcttgaataaaccttatgtaactgaattaaagaaattggaaaagtgttgatgtaatgacagattgggatgaatgatgatggtaggagagagcagagtagcattgtttagtcactggaagtttgagattatgaaaaggaagaatttttaaaactaaggacagtgataaagtttgctgggatcttcaagaagagagatcctagtttagagggattccatgattaaaagacagggcaagtaataagtcagtacaagtactcagttttcccaggaatcagatgagatgagctggactggaggttgggatcaagcatagattaggaaaagaagcttgaaacgattgtacaaaccttagtaatacgtgaataagtaacaagatgaacagagttccccaagagtacttatatgtgtctatgtataatatatatgtgtctatttataatatgtaattcataccccgaattcatttgcagtgtagaaaaactgttacatgtgctttaggctgaacttgtcggctaaagaggacttatatgggaaatggaagaatgcagaagaggattggggccacagaggccatgatatatgaaggaaaaaaaacactgtcttttcctcatttcttttcttcctctcttctgtaggcatttatttaactacagtggtatgccaggtctacggtaggattagggaataggtagataaaagaaatgcatctctcagttcaagaagctcttaatggaaagaaacagacatataaagtgacaatatttataatacaggtggacgattctcagaatgtaggtatgtacaagtagcaactggaacagagagaaaggagtgtagaggagtcaacatgttccaggagatattgcatgaattaaaacttaaatatagaatttgctaggtggttgatagtaggaggaaagaggccattctaggcagagagcacagcttaagcaaaggtgcactcagttctgagaacttgtcagtagttcagtggggcaaaaatacagattttttgaggggacaggaagagttgggagatggttagagggttgggagggttcagattataaaatgtcttggctgccgtgagtaaaattttgaatttcatttctaagttaatgggaaactgtggaagagttttttgtaaggcaataataaaatatataataatactactaataataatacttatagagcaggtaatgtgtgtcagacattcttttaaatgctttacatgtaactcacttaatcctttcaagaactctgtgaggcatagatgctactattcttcttttttttttttttttgagatggagtctcgctctgtcgcccaggctggagtgcagtggcgcgatctcggctcattgcaagctctgcctcccgggttcacacgccattctcctgcctcagcctcctgagtagtctgccaccatgcccggctaatttttttgaatttttagtagagatggggtttcactgtgttagccaggatggtctcgatctcctgacctcgtgatccgcccgcctcggcctcccgaagtgcttggattacaggagtgagccaccgcacccagcctattattcttttaataaagatgaggaagtagaggagcagtgcctaaataatttgtctaacgtcacacagccaggatgaaaaacacaggtattctggctgtgtaatatgtgtagggagagaaaaaagagaccagttagaggagactgtttcacaagtgtaggtgggaactaatgaaggcctgggcactaggagagaattggggtggaggaatgagagttccagtgatgagtgttgaaagtcctaaaactggttgagtgactttcttttgagcagctgtgctgatccatgtcttattgttattgtctcttttccattgcttaccttctatttaaaacctgttctgctccttttgtttagtatttcccttttcttgcctcccattagcaacacaaatatactcattcatttaaaacttatttgtcagcttttggttggtatgagtctgcattaattgttgtgcagttacaaaaagaaaaagatacagagtactcgcctttcaggagtgtttgctgtagtatgacagctaagtcaaaacctgtaacagaagtcagtatgagagaggtcatcagaacgatacaaacttctgggagaaccatgtaccatctgcgtgtatacttcatcttccttcgtatgtctaaaactgtttgaggcaaattcatgtgggctggtgagatccccagcttcctggtttctctaagaaggtcagagctggaacctcttatgccattacactttctctctttagggatgtaggatacttagtatctcctaacatacaccacttcccaattttccaatgtcttggccttaggaaaaaaaaatgtcgtccatgtaaaacctcattcacacctgccactggactgaaagttccctaaggccaaaggccattcctctttggctttcagtagtatgccctggcattttctgcaaacttaccacttgatgggtgctaaaatatgttttaaactgagtattgcacccaacggatgaaaattttctaaaagtgcttctatcaagaattaggaaaccaaagtatagaaataaatgaagctgataagcataagtttgtgatgctaaataaaattacactgaagtcctagccacagattggcaaggacagttttgtgggggcagccccacatgccatagccctctgcagggagccataacttaacatccccaggtttaaattttaaattatatacccagccccttgttttgtccattaccagttgagaagtgaggtaattcattctcctttctactgcttctgcccatggtgagaacagaacttccatatacatcttctctgcccagctggagggggctgatggaggacacagcttctgtcatccagcgcctcccctgggagtctctttactgattggtcttcatttgatctacattaggtcacatttactgatggatggaataaactgctttaacagaatcatggtctccaagtttcacttcaccttctgtcctcaggtgtggcaggtgccctggccagagcctgctattctctccggcttcctgtttctttgtgtcttttatctactgttctgaaaaagtgaatggagtcggggagatgggaatttaaagtaagaggcccggctgggcatggtggctcatgcgtgtaatcccagcactttggaaggctgaggtgggcagatcacctgaggtcaggagtttgagaccagcttggccaacatggtgaaactccgtctctactaaaaatacaaaaattagccaggtgtagtggcacacatctgtaatcccagctacttgggaggctgaggcatgagaattgcttgaacctgggaggcagaggttgcagtgagccgagatcatgccattgcactccagcctgggggatagagtgaaactgtcaaataaataaataaataaataaataaagtaagtaagtaagtaagtggtccctctttgctctccaacacaagatggaagtctgtatattgggccttaaagggagattacatttattatgtttattaaggggtacatttttttctcatttgcctgctagtttttggtaggccataaccctgcagagaaggtttcagtgatacatcttaccttctaggtaagaggaggtttggatctcttcctaatcagtagattctatggactgctcgagtggctaaagtgtctctttgggttagaagaagaaattgttgtgcttcaatagtgtatactgtcctacacaagcaatatttcacttgttggaaaatgaatcttttttctttattaaatgatccaccctatttttataatttcagctacttccagtaatctctaattcctgttatttcatctatttaataggagcgaatgctacttttccatggttcctggtaaatttagctgtagctaaattagtaaaataaatgagaaaaattattaaaacaaaattgtttcctaaaaacaaagtttaatggttataattactaatttaaaaaatatacttactggggcactaaatacatttttgtaattcatttcacaaggaggaaagacatatgtgatgtttaccaccctgggaaaatgcaaaagtggacagactggtcagcccctcatatattttcattcattagtagtcattactcggatgaaggtgctttgcatactacactgttttatcagatccttttaaaactctttttgggtacgatactagtttcctgtgactactgtataaattaccacaaactaggggatttaaaacaacagaaatttattctctcccagttctggaggcaagtcccaaatcaaggtgctggcaggatcacattccctctaggagaatccttctttgcttcctccatcttcaggtgactgttgtcagttttttttttaattatttctaattttttaaatttatgaataaaagttgtatatgtttatcatgtacaacataatgttttgaaatatgtatacactatgggatggcaaaatctagctaattaacatatgtattatcccacatttaccaattttttggggtgtgagcacttaatatctattctctcagcaattatcaagaatatactacattgttgttaagtataatcaccatcttttacaatgtcttctgaacttattcctcctacctaactgaaatttcatatcctttgaccaacatctccccagcccacctccatcagtgaccaccattctattctgtgcctctatgagttcaactttgttagattccacataggagatcatgcggtatttgtctgtgtgtggcttatttcacttaacataatgtcctccaggttcatacatgttttcacaaatgacaggatttcctcatttttaaggctgaatagtattccactgtgtgtgtgtgtgtgtgtgtgtgtgtgtgtgtgtgtgtgtgtgtgtgtgtgtgtgttttctttatccttgcatttattgatggacacttaggttgattccatattatgggaatacagatatctcttcagtatgctgacttcatttcctttggatatatacccaagagtgggattgtcggatcatatggtagttctatttctaattttttaaggaacctccacagttttccataatggttgtactagtttacattcccactagcagtacgctaagggtttccttttcctcacatcctcaccaacacttgtgatcattttggcattccttgcagttgcaccactccagtctctgcctccttggtcagcttgtctcttcctcttagtctgtctgtgtcctctcctcttttgtttcttataaggacattcgtcattggatttagggtctacctgagtataatctaggatgatcccatctcaagattttaaacttaattacatctgcaaagacccttttcccaaataggttacattcatatggtctgggtattgggatatggacacatctctttggggggccaccattccacccatataggtacatattcttttttgttgtgttttgaagacaaaagcatagatttattgaagcaaaaatacactccacagtgtgggagtgggctcaagcaagtggctcaagagcggtacatattcttattttcccaattttatagagatacattgagtaagcagtgaagctggcactggccaggcattatgactaggagctgcgcatctccaccaccacactgtgatggcatgctaatttattctgatttgtagagggtctgttttgaggcattctctgtatgaaatctagtcctttatttaattaaggatgaattcactcactctgctgcccaggctggagtgcagtggcataatctcagctcactacaacctccgcctctcaggctcaagtgattctcatgcctcagcctcccgagtagctggaattacaggcatgtaccaccatgcccggctaatatcttgtcagcttttgctactgcttaggtaacctctgttttgggaagtatgtgcatgagatttattgatgaatctcttgatgcaaagattagcaataccttgccatggttaaatccagcagaagaaaaggctactttggcaacagcataggcttgtttttctggttaatgagaccaatcagaaatatcagagttcaaacctgacttcatcacttactggctatgaggaagttacttcaactctataggtttatttactcataagttaggaattcctattttgtagttagtttactttaaaaagttaagcctcaatttgatagtttgcctaaattaagcatataaatatttttaaaaatatagttcgaatgtctgtgattttcttcaggcttatttataactctaatgtagcaataaaactcttgaaaccattttttacatcacaaatgatggagcctgctcctttaaatttttacaactctaatatgtcagcatcttttgttaaccatgtactcatataatatctttttagaagcccaaataatatttgctttgcctatttgtggtatctctctcaacacacagtggtttcattgtttgtgtatgtttttccgggggaaaaaaggatcatttctcttactcagtgcctgacacacataccaaaaatggaaaaattatgagaaagaatgttgctcagatcacaacatcagattattgtacttttggcattttgtggctgatagccccttcctaagaagatattcttaaggttggaggtcactgtttcttcttaagagcactgtattccaattttgaataatatttcctagacaggaagcacgatcatctttcatttttatagtcattttttagtagatgattgttgagatggctgggtgctgaataaaacaaactgccctagtctagttgttctcttattgttgtgtgcatttcacacttgtgtaagcctatttgttaaggtcatggtagttagatgtatttttcatctaatttcttatggcctgatattttttcccaatattgttttttcttgtcctgttaaatcattgacaactgagcagccttcaaaagtatatttttataaaagtgttttttgaaatatgtcttatttcatgacattttgtaacaactcctagactattgtctattctatttgtcttaagtggagctattgattatataatgcaaaaagctgtgaggttgtaactcagttcagtagtatttataaatatttgttttccacttttgtgcatattatacaaatgatggatataaaatttgttttgaccatttatgatgcttgctttgggaagaggatatcctcatagaactgaacgttatgatggatttttaaaatattctgacccaaatgatattgcattgtcagtactgtccctggttattaatttctcctggagtagaaaatgctttgttccttactatatcccatttaaaccttaccgcctaccttaccccacccggccccacacatctatatacacacaacctcacttctcttccaagcggaatagttgctcattggaagtaacagtataaaaaagaaggtaaacttatctagagaagcatattaagtagtttttttctcctcttcacattcacttcttaaattgttatcaaacaaaagctattaggaaatctttggaatttattattttcaagaagttccaaacagattctttttcctaatactctttagggaaatattttaatgtggcttaattatctatctaatattaaatacaaattaaatttgctatcatcaatagaagatatttttattcataggagttcttgattttcacaatacctcttctatagcttgaagtattttttaaaatataaagctaaatctacggtaagtggtgcaaaaacaccagggatattaaattttttaacgttagtgttatatatattacttaaaatttttacttaatatgttcaaccctagcactccttctgacattaggccccccccacctttttcaacctgaatattcaagggatttaaggtatttgaaattgcatgtgaattattttgtggttatattaattaacattgtaacatctaggttttacacttaactgttaatgatcttagggcttaaggaaaaaaaaatatatatctaaagttagtggtaaaacttcagttatcccagaaaccccagaacatggttaattctgaataactgaatttgctaggtaaattgacatcaaatacctcaatttaaaaaaatgcttactataacattttcataaaagttttccaaaaattatttacctgtgtattagtttcctattgctgctgtaacaaattaccaacttagtggccaaactgcacccccaaccccccaaatttattattttacagttttggaggttacaggtctgaaatgggcttcactaggctaaaattaacgggtcgaccttcctttctgaagattcttggggagaatcatttctcttgcgatttccagtttctggagactacctgcattccttgacttgcattgtttttgtcttcaaaggcaacagtgactaaggggtctgtctcacatcatatcatcctaacagtgactcttctttctccctcttccacatttgagggcccttgtgattacagtaggcccactggataatctaggataatcttcctattttaagatcatctaattagcagccttaattccatctggtaccctaaattcccttctgcatgttaatgtaacatattcataggttctggggattaggacagggacatctttgggaagccattattctgtctaacacattttgtcttctgaaagggtaaattatgtatactgaactgactgtaacaatgtagattatgtgagataggagatctgactgatgcattttattaccacctgtttgccagaattatattcagactcctttctagacttcttctcatgttggttggttggtcttgtagtttcctagtactttatgcaggtgactgcactcctacattgtggacattttctataccagagtcattcaggactactgttgagaaaatgtcagtgtttgccatctcttctcactcctggtaagtacagtcctattaagtaatcttttggttgtttactttttaccaaaaaaaggcctgttcccatccttatctatcatcaagtctctcaccattatcgtagttgatatgtcttaacatctagtcattgagggtgcttttatgacacttttaattttaccctgattttcttgatgccaactgtactctgttctttcacacttttttgtgtgtgctcgagcacttttgttttcttaataaagaaatggaagtttgagtaacttacacaaggttactcatcaataactgattcaggatttgaacccaggctacttaattcagaagagcccatacctaccactcaaatggattgccatccaacattcattccaaactctaagcctttacttttgaaatccatttgtcctgacatttttataaagaagtctttaagactagaaggaaaaaatactctgaacataaatttatttactagcaggaagataggaattagatgaaatactttcattttgcttcaccctcttagaggtctacaacaggaaattggagagatattgccgatgttttagtagattccatagaaagttcatatacatccaattttcaatttagaaagaggtaaggaattggattgttttcatgacatttttctaagggaagataagagaggaaataaaggggtgaaccaaaagacatcagatataaagtgcctgtttactccctctgagtgactcacattattctactttaaaaacatgttaggaattcatctaatcttctttagggcacacccacttccctctaagcttagtatagttcacagataaattggtctttctcagctcaccacttctgctatgtagttaccttgccagtggtgatttgatgtcccgtggctggccatgctcttcctcttctgtctcaatttcttccttatatgtataaataaatacctgactcacaagtgttttgcctaaccctgtgctttccattgccttggcaatatttcttgagttgaaaaagccatctaaggtgctaagttaaaagaaaaaaaaaaggccttataaggtactcaggatctacacgaggttgttaattcatgttttgctttaattggttactctgtttcctatttcctcggtttccaatacttgtttgtagaaaacatcagttttgtgtgtatttgctcttggtcctaaagttaaggacactatacgcagagttaattgaccttcatttgtgtgccagcattctggggtgacataatgcctgcaagtgtcatattcttaatatgtgagggggttctatatggagtacagggttagttgctaaataacctctgtacccctttttctctgtctcgatgtatgcattctcattctcctgtagattgcctatttgtatgtattcctagaaaaggccttcgataggacgtctgtagggttattcccttctaaagggaatggttataccctctgacctatcaattccatttctataaatttatcccatagatatactcacaaatgtgtaaaatgaagtatatttgaagtaaattattaaagcattaagagcaagctaaatgttcatcagcaggaaatggagtcaatatatcttcgtctgtctgtataatggaacaatatgtattattatgaacagtttttgagcaaataaaaataagctgaagtttaaaaagttgagttaaaaaagcaaggtgtaaaacagtgtgcgtagtatctgtgtacgtttgtagatactgtacacacatgttagagggcaatttggataaagtattctgtgctcaattaacatattttccctttgtcttcctggctctactggcttattaccagtagcagttactcgggagttacccagctactcaggaggctgaggcaggagaatcgcttgaacccaggaggtggaggttgcagtgagctgagatcgcgcctgggtgacagaacaagactccgtctcaagaaaaaaaaatgcttatgttctgtataaaatcttcaataaaatgacgataccagtacctcatatttgtataatgatttacagaatagaaagcttcattttatatagttccttacataagtcagtggtatagtatccagcatacacataaacacatatattaaatatatggaaattatatagtaatgtaataatatatagttatataatgattcagtagaattgtcatctgaatacatttttgttgtttgctcactttataaggtttgcttcaagacatctcccttgtcttaaatattcttctcttaagctatgattgcatatggattatttttctatataaaatacattttattctcactttttagattcaaagttaggacatttctgaaagatttatgtattatctatttaatagaaatctttcaattacttcccaatgtgtaaagagtaagtgaataacagaaaatgagaaatttcaaagacttggtagcaagcatttagcaaatgccattgtccttgtaaaattattttaagctctatctgttgtcacacactgaaagatgcaagcaaacagtgtggctttggctagagcttatcattacttctcagaataactttggtgtattatctctagtagcattttagcttagttgatacacttcaaagtacccgttagacacaccacagattgacttaagctttgatgacttgcaagtccataaatatctcattttggaactctaaaagtttggaattctaaaactccaattttggaattctgtggtggtcaactgtaattatccatacttgaggagcaaaagggaatagttctgatgtctgcaattaatgatggttttatttttcatattgaaaattacttatcatagaattttgtcatcttcttgtacaagcattactagaaagaaggtcatgaaaatagtatgtgacttttctttgaaatatactcacctaaactggggttgaggtctgtatggcaataaaattaaatagatacagaaagaagtaagagaataggaaaaatgctaagcaaaaagaataaaagcttgaacttaacataccaatttaaaattcaaaaggaaaggcaaaggcccaagaaaaggttagaaaattttgaagaacaagatgaaaggatacccaattatgtatcacagtataaagctaatgtgtaactggtgacatgaaactattatcattgtaatgcctctgctagaaaagatcatttctatctcagggttttatagctagtctggttctaactcagttaaatccacagttattttctgtgaagcgatattatttattaacattatttaacaaatttagcttattgtatacctgtttaatgccaatagtgctgccaaaggctaaggttagaaaaattagtagtctgaaactactagatttaactctgtttgcaaagagccccataaattacttgtgctaaagctggaccttaataaatttataagtttgcagtaaatgaaagggtatcccttgaattctcccaaatcaagaccctgtaactttattgagtttaaaacgcttgaagcagattactgggtttcatcgtcaaagatttttaattctagagacaagtttttttcacttcatagcccatatttttaaccgcaaccctgtattgcttattcatttcatctccccaaataaacgtgaagatctttggaagaaggagtcactttttattcagctaagtagtatttctttcaatacatgaaaaagtcttgacacacaggcaatgctaaaatatgcatacacatgagaaattaaattgaggcaaaataatgattacctaaccagctactgtgtctggtatatgacccataaaggaaaaaagtggtcacaactgaggtcatctcagaaagaatagttttcctgtgtagttgagcgtaaattgttctccaagatgatatggagaagtggaagaatgtcttttttttggctttaggaaatacattattcattctctacagaaggactgattgacttttttcctgtatatgaggaacggattattaggcaaagatattacgtagtaaagtttacttaaactaaggtaagattttggactgtgcctaatgatttggaagcttacttaatcactattctcaatagctacctaatgcccaagagtgtgactttgtagctaggatgagctgtggatatatatacaagtttttattactgcagttgtaaaacaaagactttgatggctattttttatgtatcatcacagttaactattttcagaatcttgagaggtttaatctcctttctaagtcttttattccatttagtgacaactgttttttgacaatgtaatatatactctagtataatttaaaaatatctacaagttgtcaagttgaatggctgagagatttgtttaaagaaatgtgggcaacattcttgtggttggaaaaagtaagggaaaaatgaaagtattgcttaaaagctgttttcaaagcttgcattatgaaagggattatatgtgagatttagagtctttttaaaataaaaaagaaatagattaaattccaactctataaatattgtctttatatttaaaagccccaaagaggctgcattaaaattaatttctgattacgcatatgatcccaatagagaattcattgaccaattgagtgcagataaatataaaaatctctctatagcaaagtctactctcggtaaaattatgtatactaatatataaatataaagcccaaatatgacatttttcataagaaaaaaatataagtagaatcatagagaaggataagatcttttccccttagattttgcttcataaaatagtagtagtagaaattgattaaaaaagagtgatctaattttatatggtggtagcagaaaaaaatgcacatcagggtaacatcaggcacatctatgacatggtcagaaactctagaaggggcagggcaagataaggtgactttggtagtctaggttgattagtgcatctgaagcaggagaagaatagctagaagtatagtgtcaactaatacaagaaaaaccccagtcgtttctttttttgcccctccccttacctggtctcttttagcagaggcaaccaatgacttctcctagtatttacctttatgtttctaaatactaaccatctgctaacttttaaattatcagttttattattattattattattttgagacggggtctcactctgatgcccaggctggagtgcagtggtaagatctccgcctcccagattcaagcaattctccagccacagcctcctgagtacctgggattacaggtgcatgccagaatgcccggctgatttttgcatttttaatagagacagggtttagccatcctggtcaggctggtctcgaactcctgacctcaagtgatctgcctgctttggtctcccaaagtgctgggattacaggcgtgagccaccgcacccagccaaatgatcggttttagttattagcgtctgacttccttttgcgatagtacttctcttgccatcttcttggtatcatcattatttaacaataaattttaaaaatccgtattcaactttttcattcttatggcaatgtaaatattcagtgctgagccaaattatgggagaatccagtgtatcagaattcaatagagaatccacagggtccataaagagcacttgtggttattgtgggccctaaagaagtgtgtgaaccactgccccactcactgtgtggattaccttagtgtgtcgtgtgaatgatcctgcagctcatccctccttgccagattacagagctctccatgtgttatgtttaccacctgcatgtttgaaatccatttcttaccaagaaattctgtatcaagaaattcagctttccacagagagtattatatggccatgtcattggaggatgaataaatttggtaagcttgtgggaaatgtgaaaatattttctgaaatacatttttaaaaaatctcttctttcacattgtcagtatatttatttacactgttccagtgttatcttcacagataatttgtctttgaaaaatgactatatcataaaagtctttgccaagaacgagctattcatcctgtcttttgttgttggactttataatcttttgttgtcttcatataattttaatcattttattatttaaaactagtaaattggttttctttgcattgtccttttcctgagtacatgcagtaatcccttttgaggccatcttccatccagagacaatgaaatcatttgagtttaagtagcttttcaagctaatgctgttgttttccttattgtctgttagcttttaaaaacatttatctttaagaaaatatttaatagctattttctgtttgtgaaacagttacacatatattgaaaaacatttggaagatacagaaaaaaagaaactcatctgccctttagagaaaacaagcatattttgatagatatccatctagtcgtttttctcttcatatgtactcatttatatatgtatatacattcgtacgtacatacgttcatacatatatataaagacacagattatacattctttcaaaacatacttcaggaagataggtgtgaacaagagagaaatggtacctgctgccatgcaactgccacactagctaataaaagagctattcagtatacaatcacgtaattataattttgacaaatgcatatgatataagagcatgaacagttttaaggaatgagtagcattatcaaatttgtgaagaggttttatcaattgtttttaaagtttgctgtcatagtatataacaaaatacctttggtatctgcaatgtgtgtacagatacattctatatctatatatatctgtatctgtgtataccgaatggtcctcaatttacaaaggttgacatgaatttttgactttacaatggtgtgataccattctgtttttcactttcagtacagtattcaataaataacatgagatattcaatacttttttataaaataggctttttgttagatgattttgcccaactctaggctaatgtgagcacatttcaggtaggctaagctaagctttgatgtttgttaagttaggtgtgttaaatgcatttttctttttttgagatggagtctcactctgttgccccagctggagtgcagtggtggtgatctctgctcactgcaacctccgcctcccgggttcaagtgattctcccgcctcaacctcttgagtagctgggattacaggcacgcaccactatgcctggctaatttttatatttttagtagagatggggtttccccgccatgttggccaggagtcttgaactcctgacctcaggtgatccgcctgctttggcttcccaaagtgctgggattacaggcatgagccacctcaccggcctaaatgcattttttacttatgatatttccaattgaatatgggtttactgggacataaccccatcattagtctaggagcatctgtatatacatggagaaaaacttattctgcaatgtatgtaaatttgtcaaatgttatttcattatagatttgtcatctagtagaattgagtattagtgtgaagaatccttgtgcttttaactttagtttataacctttttcatttaaatcttttatttcagccaccactgaagtgccagaatagtgagataaattgttaataatgaatttccccatgaaagtaccatataatgattgtaacattgaaaagattcatatggtaaatacatggatatcgtgtgccaattctatgttattttactaactacaaggtataggtatagggtaagataattttcatagatttcttcatttaatcttgggaataaccctgtgaggtaggtggtattaacctctttatagatgaggaaactaatttagggaagttaattaacttgggcaagtttatttatttatttttatttttatttatatatatatttttattatactttaagttctaaggtacatgtgcacaacattcaggtttgttacatatgtatacatgtgccatgttggtgtgctgcacccattaactcgtcatttacattaggtatatctcctaatgctatccctcccgcctccccccaccccacaacaggccccggtgtgtgatgttccccttcctgtgtccatgtgttctcatggttaaattcccacctatgagtgagaacatgcagtgtttggttttttgtccttgcgatagtttgctgagaatgatggtttccagcttcatcaatgtccctacaaaggacatgagctcatccttttttatgactgcatagtgttccatggtgtatatgtgccacattttcttaatctagcctatcattgatggacatttgggttggttccaagtctttgctattgtgaatagtgccgcaataaacataggtgtgcatgtgtctttatagcagcatgatttataatcctttggttatatacccagtaatgggatggctgggtcaaatggtatttttagttctagatccttgaggaattgccacactgtcttccacaatggttgaactagtttacagtcccaccaacagtgtaaaagtgttcctgtttctccccatcctctctagcacctgttgtttcctgactttttaatgatcaccattctaattggtgtgagatgatatctcattgtggttttgatttacatttctctgatggcagtgatgatgggcattttttcatgtgtctgttggctgcgtaaatgtcttattttggaacatgtctgctcatatccttcacccactttttgatggggttgtttgtttttttcttgtaaatttgtttgagttctttgtagattctggatattagccctttgtcagatgagtagattgcaaaaattttctcccattctgtaggttgcctgttcactctgatggtagtttcttttgctgtgcaggagctctttagtttaattagatcccatttgtcaattttggcttttgttgccattgcttttggtgttttcgtcaggaagtccttgcccatgcctgtgtcctgaatggtattgcctagggtttcttctagggtttttatggttgtaggtctaacatttaagtctttaatccatcttgaattaattttcgtataagatgtaaggaagggatccagtttcagctttctccatatggctagccagttttcccagcactgtttattaaatagagaatcctttccccatttcttgtttttgtcatgtttgtcaaagatcagatggttgtagatgtgtggtattatttctgagggctctgttctgttccattggtctatatctctgttttggtaccagtaccatgctgttttggttactatagccttgtagtatagtttgaagtcaggtagtgtgatgcctccagctttgttctttttgcttaggattgacttggcaatgtgggctgttttttggctccatatgaactttaaagtagttttttccaattctgtgaagaaagtcagtggtagttggatggggatggcattgaatctataaattaccttgggcagtatggccattttcacgatattgattcttcctatccatgagcatggaatgttcttccatttgtttgtgtcttcttttatttcattgagcagtggtttgtagttctgcttgaagaggtccttcacattccttgtaagttggattcctaggtattttattctctttggagcaattgtgaatgggagttcactcataatttggctctctgtttgtctgttattggtgtataagaatgcttgtggtttttgtacattggttttgtatcctgagactttgctgaagttgcttatcagcttaaggagattttgggctgagacgatggagttttctagatatgcaatcatgtcatctgcaaacagggacaatttgacttcctcttttcctaattgaataccctttatttctttctcctgcctgattgccctggccagaacttccaacactatgttgaataggagtggtgaaagggggcatccctgtcttgtgccagttttcaaagggaatgcttccagtttttgcccattcagtatgatattggctgtgagtttgtcataagtagctcttattattttgagatacgtcccatcagtgcctaatttattgagagtttttagcatcaagggctgttgaattttgtcaaaagccttttctgcatctgttgagataatcttgtggtttttgtctttggttctgtttatatgctggattacgtttattgatttgcgtatgttgaaccagccttgcatcaacttgggcaagtttattgttgttaagatggtattgagacctacgtcttgcttggctgtaagtaaaattcatgctgttctttattttcttgatattgtgctgtctctttgtaatggtgaagtggaaattattatagccatctctcaaatgagcagaccaaggcatagataaaaaaggctagcatttaattgtggtagaatgggcaataaaatagtagtcaacctattcttgctgaatttccattttcctgtctacatatgagtgttcaactatattaaagtctgtcttgaggtatcctaaggtggtgttacagcagcccagtagagtacattctgagttttctgcctatacttgtacttcaaccaaagaagctttgcttttatttgttttatatactgaaccttgaattatattcaagtatgactaaggattataatactaacattgttgggggataaaaatgtcggctttctggtttttcttgttgcttttttttttattctagctgaaataataaatcagttccctattccatttttctgtaaaatgaactgtcatgatctcttttgtgtgtgtgttgcagggaggggggttagtaaaaaatttaatcataactaagttatgtaagtagatgatcttaaatgtttttaataaaaccatgtgttgggttacctttaaaagtagttatgataatttttttttgtctaaagcatttcagttatagcagtcataaatttaagttgagtaggtttttatgctcattatttttggtaaactaaggaaaatataggataaggattttgattagcctagtaagaaattgtgattagtttcacatcgaccaacttactgttttctatcatgaaacctgaaaaaataaaaaagatattattatgattctttgatttctcaagcattttctgagaattttgtcaaatttcggaaactagtttcttagtatccaattttattgaacataggctacagcaagtatctaggttataacagatgtttttggtggctctgagatggaaagttgtaattatatgaaccagaccttctatctagtgctatttttacaaggctgctctgttgccaaacatttcttctatagctctgtcttcttctagccatactcatcaatattctagcacatttaactgctgatctctttagaactcacgtaaggcagagattcaacaagaagagcagtgaatcatgctacatcttgttttcattggaacactaaagcatcagcatatgccagtgtttgctttggggtaggtttccctagaaaacagaagatcagtaagatgctaaattgaaattttatgtgacagacggctgaaaacaaggccatggttgaaagccaaactcttagatgttgtgcatgtcgaaactggaacaaagattataatgcaagttcaattttcctcaaatatggatctcaacattaattgtggtatgcagctcacccacagccttgggtgtggtctatgaatgcagctgctactctgttctacaattattgtattttattgccattatgactgggcctttgggttataaccattgatgcaaatgaaaaaggaagaaacatgttggatacacagtaatatacatgtttttggcattggctatttgtgtcatcttaactgtttttattcatagaacttaatagttggaagcacttgtagagaaaattttaatatgttggatttctttgtggggattaggagcaaagcttcttctctggccagcccgtgactgtttcttatctatgtggactccattgccaatcattgtggtggtttagaagcatccaaggtccacactgtcccctaaacattgcctttggggacaaatgcatgtaattctaggtcatggtgagcctagttgttgtccttgtacctaggattcagtgaagggcctggggggaattcagaaaaggagtcattgagttcaccttggtgattgaacatgtaactgctttctctttgattgaactttacagaaactaatgtagctgccaccaagacctggattgttgctaattgagaagactgtttagaagacaggtggactttagtttcactctaggaacttagcggtgattttatatattatggataatttggacctgaattatttcatttctcattattcccatactctcccattattatggcagccaataactgacattttctggaataagtctggtgaggtagctttcacaaaacaatattaggtttagtgtcctgagtaccttattgttattaccttataaatcccttgttattactgttcccatcttacaggcaaggaaactgagaggttaagtaacttgtcccaggttgaacaactagtaaatggaggtgctagggttagaatctgggcagtctgcttttagctctggaatactggacatttttgaggctgtgttatacttatcaaattaaccaggctaagacttagatgtttgttttgttttgttttgttttgagacgaagtcttgctgttgcccaggctgggtgtggtggtacaatcttggcttactgcatgctccacctcccgggttcacgccattctcctgcctcagcctcctgagtagctgggactacagtcgcccgccaccacgcccagctaattttctgtgtttttagtagagacagggtttacatcgtgttagccaggatggtcttgatctcctgacctcatgatccgcccgcctcggcctcccaaagtgctgggattacaggcttgagccaccgcgcccagccaacttagatgatttttaaaaaatgtacctatgagttgcttgtctttgaagtcagtattagtgtcgggtttatttggcagtctgttctgagttccttccacctcgttacaaatagtatactcctgagaaaaataaaataattagctaatatagacagattttcggaatgaggaagaacactgcatgatacaggctgtgtgatagtggtattattcaagttcccttgagcttgaagagatcttgtgggccaattgatccttcccttcctcaagaatccctgatacagtgatacagcttattccagttagacaatgctaattaagggcaagttttttgaattaaaaactcaccatcagtattcagcaagaacattttagaaaagcagccaaaagagttacaaaatagttctgggagaaacggatcattatcttgagaggagtcagtaacttcgatgctagagttatatgcgtgctttttcgtttatcgtagttttttaaagatcacagcatggaacatgtgtttttttctatgcactggttgttatcctttgcaaggtctcagatctttctgtgactctaataaaagaggaaattaatatgacaggatctcctattctcattctctggcagtcttttaggggatccttggagccaaagtaaggaagactcagattagaggttatgtttttctcccaccaaggaatctaatacttttcagattatttatcttaagagataggcatcagtgtctggcttcttcacatttttagtcatcaccaaagaggggaaatctctcttgtctagttcagttttataagcacttgctacaggatgttattgttggaacaacacatatagtaatccatggtcagcataatcatggtcagcatttctgttcttcttagtaattttgattatgtcagaagcaaatttggtggcagtgagctttgcagacatgtactagccagagctctgtgttaattgtgttgttggtagatctgcttattttatgtctttgaggatatcattgcgtgcagaattttttaaaagttaaaatagtttaatagtattttatgaatgggctttttcactgcaattcagtggacatttgtttgtgacccctattaaccagtcatcttgtttattatgtggcctatcaggcctccagacctttctgagagctccacctttgagtcaaggttggtgtttatcaaactgaggcttatatattcagtttttttgggtcaagaccagcatcctttcccccaagctagtttgtttttgttttgcaaataaaaataatatattttaataggttccacaggaaaatatgtatgttattgcttcatacttgtattaggtagataatgatacaaaatgtatttctgatacccactgtgataaaagtgtgaaaacagttttccaggtcagtgctatttaatctgtgggtcctggactggtaccagtctaaactgtttgttcctggtctgtagggagataagcactgaaattgagaataagcatttaggaacttttgtagcaatttcacattgccacagttctcaaggtttttgtttagtggatttgtcccattgaacaagtatagtccagtttgggtgttgagattccatgatgtgagtaacatacgttgtgacttgtgtatgttcagcagcattttaggtcatttcttaatctattagattcaaagagtggtggagagagggtgcattaattctcttgggaatttaagaagcttaccttttggtaaattagacataatgtgttgctaattggctgtggtttcagttttttaaactgtaacatagaaaaggtatcagaagaagaagaatataatttatgttttctatggttcccttgttagaaaaaaagatactaatactttaatactgaagagctttgggattctaatttgcttaaattttcaacaaaatccattaaattatcaatcagtaatataaacaagtcttctattataagcaaaattcagttttctataaacaaaaataaagattattaataaacagttgaatgagtttcagttctgtgatggtataaatgtgagataaatcacaaataatataagaagttgtaaaaataaatatttgaaaatttagctggcttttaagttcctatttttagatgtagatattattatcactttgaatgccttgacttaatttaataatatgagatttagtgataaggatgttggacaagattctacttattaatgaatgtgaaattaaaggctcatcttgaagttattaaacaaggatagacttggcctatgtatggctaaagtagccacatttgatcactaatttttaaattccttgattcttatgaataactccagatttttaaaaatatctaaactcacccaaagttattttttaagtgttacgtaactggaaaaagctaagttgagattgtgaagaatcttcatttcatgtgttctacacagaagatagcagactgactttgttttcctaataaggctgtgttgaatgctggaatacttatccccttaaattttattgaaatactttaaaatactcactttacaaaaaaggtttgcaatttaacacgtttagcctggacaggaatagaaaaagagatgtgcctctggtattagcataggacagggtgcatataaaggtgaacctcaaatagcatgtctcatactttgaaaagatgaaagacaaattagatattttgttgttttctatttgtgttttgttcatcacaatatatttaagatttggggcagtttttattccttctctcttcctttcttttagtaagtaggcttgtacagatcatttattgcttaacactgagatttggatttaatcttcttccaaaatgaagtactgcatttagcaatttttcttttttttttttctttctttcttttttttttttttttctgttttgagacagagtcttactctgtctcccaggctgaaatgcagaggtgcagtctcggcttactacagcctccacctcccaggttcaagcgattctcctgcctcagcctcctgggtagctgggactacaggcgtgcgccaccacacctggctaatttttgtattcttaatagagacagggtttcaccatgttggccagggtggtctagatctcctgaccttgtgatccaccccccttggcctcccaaagtgctgggattacaagcatgagccatcgtgcccggccttagaaatacttttctatctcactcagaataaaagaccaattccttgtaatgggttcatgtactttatgtgttctgcccccagccatctctgcagctttatctctcactgctttccccagcttttcctggaacctttctagccccactggtacattcctgcctcaggactttgcacttgctatttggactgccaggaattccgtacttcaggtttctgttcagagttcacctcattagagaggccttctctgacccttttgtataaaatagtgtgtcctttcctgtgtcttgctttattatgctccatggcacttactaccatgtgaaatattttgcttgttagtctgcctctctcaaatggatgtaagcaccttcaaaggaggaattttgtctctttttttttttttttttttgacagagtcttgctttgtctcccaggctggagtgcagtagggccatctcagctcactgcaacctccacctcctgggttcaagcgattctcctgcctcagcctcccaggtagctaggactacaggtgagtgccaccacgcccagctaatttttttgtatttttagtagagacggggtttcaccgtgttagccaggatggtcttgatctcctgacctcgtgatccgcccgcctcggcctcccaaagtgctgggattacaggcatgagccgccacgcccagcccgtctgttttattcattaccattgccccacctcctacaacagagccttctgtatcatgggtttaataaatatttgtggaactaattaataaattaatgaaataaattgttttaaggaaaagacacagcatgagtgttgcccttgaacttgaagtgatgctgggtaaaataattaccagttgggaatgataagttgattggttaaataatttctggtaatgcagaaggccatattaatccttacaggataaacaggttgacaggagctagattttgactataatataagggtgtttgtttgtatgtttataaaaatacaggctgattcaaaaagagctgaacacgataaaaaatgtattattcagtgattaggtatatatgcagttatatgaatgtgtagtcaaaacaaaattagaaggaaccatcgtagttatttctgtcaatcttgcatgctcagtatgcagccccctgtatcatggggcacacatcagtcctgaaatctaattcattctgttattggtagcatgtcaccatcgatagttgtaatggggaccatgatgccacttcctttattttctcaagacccacaagaagattatgtgatgtggtatcttgggatctgcatgactactaatgtcagaagctggttactattttaaatagaacacccaatttagcaccagagaaggtattcactaaggaacctccaaccccatcctgctgaaaaatgaaattattagagatttcctgttagtatagggaaaaaatactcctcttttctggaaaagtaaagaacaatggactgaaacctgttctttgtttttgcatctacttactgaactttcactgggaattttgtgaagaacttaatctcttatttatgtgcatattgtacagtctgtaaagtgttcactctatagataggcagatatattatgtatctgtatatattgaatacacatagacatatatgtatatattatatacaatgagtaacttctgtgtttacttgaattaaaccaaaaatggcattctataaacatgtcattgaaaatgaatagctgtttgttaatagaaagtagttattcattgtttggagccattactctctgaaattctttaccaaagttattttataactttctctttgatgttattccagaaggcagccagaaggtagaatgttagggctgcatataggcttctggaccacttgggttctaatccggcttctgccactttcaaatttaagttttggtcaaattagcctatttgggcttctgtttcctatatttaaaatgagaacatactactttgtcaggaagaataaatgagataatttatatgatgggtcaagtgaaattattggcatttggtaggtactcattaagtgatattttcttgcttatctctaggtttttttgttgttactgttttccttgaaattgatcctgttagtaatttgattctaatagtatataatcagaaatagaataatttccagaactccagagtttaggtcatctgcttacggggaaggtgccttctatcactgcttactttgtgtcaagcactccaccagatatgttacatacattacctcattgcgtcctcaaaacagttctgcaagggaggtattatgaccctcatgtcaacaaagaaactatatgttgcctaatgcaacctttattcagctatttgttctattcctcaaagaattcctgtatcaacaaagagcttcgtaagagaaggcctgaatatgaaaggcgggaactctgtctctttagggctctaagcttttcttgaaaggaagaaaaaaataaatagtcaaacttcagattatgaattgtgcttgctgatactactattatcctgtatatgaccctcattcagcatctgacctttatgaaagttttccggaagcagttaattttatatacattgtttaaagcctgtgaaaaagaattttgaatatggttctgttattgatgcttattctcctaatatgaatcttaactatatttggtggtttttgtttgtttctttgtttgttttatgagacggagtctcgctctgtcgcccaggctggagtgcagtggcacaacctcggctcactgcaagctccgcctcccggttcacgctgttctcctgcttcagcctcccgagtagctgggactacaggcgcccgccaccacacctggctaatttttttgtatttttagtagagacggggtttcaccgtgttagccaggatgatctcgatctcctgacctcgtgatctgcccaccttggcctcccaactgtatttgttttaagggcattttagtagtgtcacaaaagagccaataaaatgtagactcttaatttttcacaggcagattatttgctttgcaagttttattacttttatattagtaatgaagtactgtgttgataaaaatatattttttatctacctgattgaagttggaagagaaaatctatcaagtagaagtaattacttaccattggaccttagtaagttttcagagaatgcaattctagtacagattgatttttttttttttcattcctaaagatagtatagttcatgactgttaaaaaatatagagttttggtagaaaataatgggaaagaagggaattatacttgtcagtctcttcccttgcataaaaatgcagggtgcatccttttcacttgttcttttaggattttttaaaaaaataattactagtagctccatttatagtatgtagaagcagggctgaaagaggtttttagcactctttatcatttattagcaaatgaactgaagtgctgactagcagagttacaaatagtgcttaaaatgttattctagtccaataatattaaatctgacccttcaccaaacttcagtatcagtgctgtgtggtatgaatttcatttgaatgggtggtatggaagttcagatggatcacctaaacagttgtaaacagtgtaaaagttttgggtagaggagataagaagaatttaaaggtagtgtcctgcaaccacagaaggaataatacgtttcactttcatttcttatatcagtatctgaacatattataattagggctttgcattgtgcagaatgattacgaggtttagagaccaaaagaggcatggtcatgtagaattacgtactagaacgtttggtataataaacaccttaacatgatctaaactagaggctgtcaaatgatggcttacaggccaagtcctgcccaccgcttgtttttactaaagttttgttggaacacaaccatggtcacttatttaggttttgtctgtgtctttctacagtgacagagctgaatagttgagatcatttgacacacaaagactaaaatatttactgtctggccctgtataataaaatttgccatttcttaacagtgggacatatagaatagattgtttatagaaaccctttattgaaatggtattttcactgtaatgaaattttttccatagtaataatgaattactcttaaatttgaaatttcttttattcttgaatacatctaaaattatgtaatctcttcattctttctgatataaaaattttataaatactatttagaaaaatggattttttttctttaaaagattctgaagttatttttgagtgtggacatgaggcacaatgggcaaataatttttttccctcataaaactgttactatggaaataaatgtagaattacagcaataagttttctccctctggaatcaaatagaatattgtgaaattttgcacataatttgaaaacagttttaagaaagatgtatgcaaataaattataggatatataaaacacttattcttaaaaatatgtcatatactaatattttaaaataaatgtacctaaggagataacaagttaagtgttatatctttgttggaatactttagaagattgaggctttgaccaaatgaatttacatggaatatcaccagatgatgaagtcaatttggggtgtgcccacagtaatttttgttttggacttcttttttttggcacgttgagtgaaatgacatctttgttgattcttattcttccatgacacgattctatataattttggattgtggttacctttagagatgacctgtacctatatggaataagtgcccttcccacaaaatggccccctccacagtgaggagttagaagagagggtgatactggaaagccattttgcttgggttgacactgattttagaaattcaaacaatttgtgctgaagagcaaggtctttggagaacatttgggatgataactagtctcccactccaaactggatgaatgacttgataaagtcattttaccccttcgtttgtttgtttgttcgtttgtttgtttgtttgtttagacagagtcttgctggagtgcagtggcacaatctcggctcactgcaacctctgcctcccaggttcaagcagttctcctgcctcagcctcctaagtagctgagactacaggcacatgctaccacgtccagctaatttttgtatgtttagtagagatggggtttcaccatgttggccaggctggtctcaaactcctgacctcaggtgatccacccacctcagcctcccaaagtgctggattgattacaggcacaagccagcgttcctgtccaattttacccctttgcatttgagtttctcatctgtaaaatgagagaatgacacctaaatcatgagattattataaatgaaaaatatagttatatggatatgcggttgagtgcctggcacatagaataaatttaaggtagctgttagtctttgtttccacttatgctacttaaatttaaatttgcttgaattgcttgctacttgacaaaatgctttctttcttagtgattttcaggtatttaagtattaatcatttgaactttaaaataacaaattggggtgatatcactcacgctctgccctaataccctcttattttcttcctttcttccatccattggttctctggcttgacttttatctggttgatgaaaatttcttctcaaaccctaataaaccttcatggccacctgaaaaggattattgcaacaaaagcactcaccctacttacagaattattataattataattcttaaagaagtattataattagatatattataattagatatgcttagagaagtattataattatcaaatggtaactgcctgttctggatatatatcagagccacactcaaatttaaaatcaagcacaggcacagagggccactggtactcacatgggctaaagcaattctgctgcttttgtcttttttccttctttctttgactcttcaaaaagcctgaccagctttgggttatttctttctctctgtaggaaaaaaagatgtacgtattagttcctatagtaagatagagaagatgcaaagagggagaaaaggagtgagtgtgtgagtgagtgcatgtgtatgtgaagagtacagtcttttataagccacaaactgttataatatgctgatatataactattttgtacttttgtttataggaaatagaatctttacataatctcaaaccatttagaaaaacctaatacattgccatagtgatttaaatgtttaaggtttgagtatttggaacagtagactagctgaatatgcaataaagtgtgaggaaactgtttagaaagacatccttctgcactcttgagtgctcacttttttccttctagagttgctttgttattacagattgacaactttgcaattaaagtgattaatgatgtaccctagtgtttatgggtcccaaggtcagtggatccaaagatggccatgctgtgggaaacttagacaagagctcatctcatagaagatgaggcaaacaccctcctttttttctgtgtgattgtttacgagttaagtatattagatgcttgagggagtcaccaagacataatgagtaatgtgcataatctttatcattctagttctattgtctagttcctcattcttaaacactaatgcgaacattcagaaccttattaactaaaaaccatgttattttataaagcagttttaggaaactacattaattagttaaaaatataccttaagtataacactgcattgggtattcaaaagatgcagtttagcttgattcatttgcatctaattcttgataagactgctgtttatttgtggcataatttttcctatacattattctaaccggtacatcacaattttagtttttaacatagtcagttatcacttaaaactcctttcaactgttcaggtagaggttctgaaactggttataatgcatcagggatttttattttggatactacttttacaaaagtcaatcaacttcaaatagattgttctagccacattgatggctttgttctttgaatttcatgaactgaggatactactgggctgaggcactggtatatcaccgtcgtggcttactcctgaacagtggcttcacaccaaggagggtgaacaataagaaaattgttgaccccatagcacaaagccgttgccaagatctctctctgctggtttgaaactcacactacacaaaagtgacttgtgatgatcactgcagttcaaaggggatctgttatcccattgtatatttgccaggatttgaagagaaaatgtaggaagaatttttttcgtaattatacctcaattttttaaacatcctttaaaaattattgtttttatgtaatctatgacattgttaaagtaaaagatgctcaatatttgtcgaaagaaaaggaagacaattacaacaattctaattttgagaaataggtttccttattcactggaatccactgttctttacttgaacttgtttcctttgctcattataataaccctacaagctaaaagagaagttgtctattaaatagtacacatagaaggttgtgcaactgcacagagtgtaatctgtattgcagtaactgaatattaacatccattgctacctctcattaggttagccaattctcagtgcttgccatagctaaccaaattaactgtttttggaaaattcagttgctgctaaaaatgttgatcagagttcattattagattatactcatagagaccgaatatcctgtgctagtgtcttctgtttgtgatctgttgtctttaaagtaaaacaagctcatggtttatagcttaaaatgatcatcacttagtatttacctgctatgcttacatttcttgaattctgtgcttggtgtgttatcctccagctagtgtgatatgagtggaatcaaattgctactggcatattaaacataacatataccttaacactaagtaaataggctttaaaacattagaggctttcccagtcatttagttcctgtccatgaatacaaacagtatattgttatatttaacagtggtgggcctcagctccatcttaagcaatttacctacacttcttttgaagtttcttctctgaaaaattaggataaccataggttttacttggatatgattaagattatatgagataattgctccaaaccaattattgttactgttgagcccatgctaactaaaggcacaataataacatagtacaaaaaacatatatttaaaatgaaaattaatttgaatttggaaatagtcaagttatatacatggatttttgtctttttcttcactctctcttttccacacttattactgatgacctgttacattccagacactgtgctgatacagacacagatggggcatggtcattgccttctctgaaattatagtctagtagaaggacctacagtttacttttagcaaattaaatgtattaacttgcatagacacttaagaataggaatacagaataaatattcattcattgacccaattcaactagaatgtattcagcatcttcacagagacccaatatcctgtggatgttgttcatggatgttaggagaaaagacagatactgttggagataggagtcagattaggtggttgaggagccactcaaagatcagaaggtcatgtttattatactttacccttttaggtggggggtatccttaacgattaaacacgggtgcactcacaaacaggattgatgtttgtcattcctcagctgaatttgtagagaaccagagactgctattgaatacctagtgtgtaaaatgttgaatcttgcagcatttgacttacatgaatgaattagaagattgtgaatagtaaaaactatgaattatgaaacgatacattccagtgattcagtatattaaggctatattataatagtaaaaattccattaagaagtctgcaagtttataaaaattcattattttttttttctttttctttctttttttcctcagagcatctgctgcacccaagcctgagccggttcctgttcaaaaggtgtgtttttaagctagcacccagagtatcacttgattgtccttgctgagctactgtaattcccattactgtctcagaccatactgacattcatttaatttatagtctcagtacaattttccttgtagttcttttccttcagagatgagtagggaaatggagatcagcacataccatttgtaattatacatgttataaaacattatttccaaagccatatgttacaataacttatgtcagatttcttacatttctattcacttttgatgagcccatctttatccaaatccttatattttctaaagagaataaataagtggttactgaaaattaatatcacaataagtctttaataacattttattaataagtgcttaattacatttcagagtattcttaggttattggcaagtatccctcttcttgcatatatgtcttcaaaataatttcaaaccattattcatatatatctgttttatgcttttgggggctttctccctaattttatctgtgcctatttattgaactacttattatacagattgagcatccctaattagaaaatccaaaatgctccaaaatcccaaactttctgaacactgacatgctcacatgaccattgcagcatttcagattttggattcttggattagggatgctcctgcattctacaaagattcaaaaatctgagaatatctgaaatctgaatgcttctggtcccaagctgtctaaataagggatactcaacctgtattgattcgtgtgggcactaagctacttatttttctcaattagttttcttcttcctataagatgaattgaggctgcgcgcggtgggtcacgcctgtaatcccatctttttgggaggccgaggcaggcggatcacctgaggtcagaagtttgagaccagcctggccaacatggtgatacttcatctctattgaaaatacaaaaattagctgggcatggtgtcacgcatctgtagtcccagctagccaggaggctgaggtgggagaatcacttgaacccgggaagtggaggttacagtgagctgagatcacaccactgcactccagcctcagtgacagagcaagactcctgtctcaaaaaaaaaaaaaaaaacaagatgaattgagattaccttttttcttaaaattaaacagtagaaccaccattgtatgatttttcaaaaatttgattttttcttttgatatggtagggtggaatagggatttattcttgatctgaagtctaacgctctacctctgagctatcccgcctcctgggatttattcttgaatgttgtagaagcttagtctgattttgtttaactttaaatatgctttggaataaggattggcaaataaaaattctggtaattttaggaggaattgacctttcttactagttgttttttctttggctgctgacgatggggaaatattgaagatttttttttcttcatgtaactattaaatatttattttggaaaaggaaaagaattttattctatctctgaatcatatcttaaaacattcagagagagaaatggaggtggattacaagaaagaaaggattttgttttatttgcttttttaaagtttttttttttttttcaaattctttaagattattaattagagtttgcacattcctgagttaggtgaaaattatcttattccctgtgttttttgtttttttaaacttaaagagttagaaatgtgctgctccttctgcgtgaaacaaatgattccactctggagagaaatgaaacatgtttgaaaaatgggactatgggctttgaaagatggaaagatgggctttggatattttaacataaaaaacacctcagttagcaatgttttgtttattgtagggtatttaaacatttttcctttggaatatgcctaggttgacactgatgaggggctttaggctttctgatagttttcctgctgtatttccgaaatattttgaaactactttcatttttatttttaaaaattatacctaatgtgtgcatctgtgttatgcatgttgggactagttagcatgcacgttatgctttatcagcccattgtttttatctggaaacatgatgtttgagctgctaacctgattgtgtttgtcttttaaaaaatcagctctgtgttcttttcggtgaaatatattttgcatgtgtttggtgtggttttgtgtatgtttatttttgttttacatagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatgggtaggtggctaaggtgctttctgctcttactaaaactcttctttcaggtaatttccaggaaatactctacattcctctcccccaaaaccaactttctttgaaggaagggagatgaagtattatttgcctcattaacatatggcctttatatacatagggtactttctgcaaagcaattatcacttattcaaaagctacttgtgcattttgacatgttctgaaccatgtaacatctctgtaactcattttttgtaagtcccgacacagcattgagcagctggcacttgtaatgcaaggcaaatcttgaatctttcttcctcaattttttcattcttttaaataggccaccaaaagttcaaacagtggttacagttgctgtcaccttacacaactcatcgtaaggagaggggaaatcatgaatttgtaaggggttttttttctaggaggtaatcttaggaaaaccagtccgcttttgactcatgtctatatgtgaagcattagcttagagcagagagctaacaacattgttttcagataagtttaagttagaatttattctttaaaagcagacagtaatgaaacaacaaggcacgcttagaaagcattagaagcaaattataaaatactttcattgtaaacgttttctgaaatgagtaaatttaagccattggacactaaacatacatgttagcagaacactttgaaaatctgtttcttatcgtttttcccttttgggggtatctttttattaaaaaaattggttgaagttattaacttatttgaactacacatagttataagatcacacatctgtttttcagcaaccttcaattatttgtttatttttttttaacactttcggttcaaatataatgttatcagatagtcagaaatttatgttgaggagcaaggatttaagttggccgtgagaggttatgtacagtatcttttttaaaaataattcttttctataatgtaatcctacttgcaaagaaaaaagtaaagaaaagagagagaataatgatggtcattttattgcttttggaattcagggatgatactttaaggcagtcatttatgtaaaatcatttttatcagatttattgtgacaaaaatgtaccttaaaaggaagacaaagggaaatagtctacaggcctgatggtttttaccaatgccagttcccaggaaaatataattaaaatacttgtgtggataggtccattctctgagataatcccttctgaatgttaattcctgtaatgaagaggctgtgctttctgtagcactgctgccatggcaactttggggctttgaaagagaaggtggcaaaactccaggctgctgctgagagagggagagcaggagctctagaagaacagctcctgggctgtacatacggtcttgaggttgtgggtggctttctaaagttctgatatatatatatatatattgaggaaaactagtatccttcaaaaaagaatgttattgtttctttcatgtgaggaagagaaacagtatggagtgttcaggagtgtttggtcgtaatcttttttttttttttttttttttagtatgtttattttaagacaatagattttcgagtaatcagagtagatatcctgcaaagaaagatgctgtctgtcaaatgcaagccacacagaagactaaaacagaagtttaccatgtttattaaattccaagttcagtagaaaaacatccattgaaggaagtgtcttaactaaaatcttttctactagtgcttcttgaaatctcataaaaaactcttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaactcttcttaatagaaagttgtagaggtaaaagcaaacaggttatggaaaagtactgcatttaaaacatctgaaaataccaagcttaagttttgtgttttataagcacagctttggtgataaaacttgaaatgatttaaagcttattatttttaaactgaaactaggcagtattatagagcctttatgatggcttcttaatcaattggcagtgtttattaagcacatgcctgctgtccagcactgtgcaaaattcaggagaaaagagattactacatattttgcatcattttcaggcaagttactgctttgcatttgcaaactgggtgtatttaaaaatagcttgatttcaagtgtctagatattaggacaataaaaacttgattactctgaaaataaagtgtgttgtctgtgaaactctgagacacattggtagcgccctttcattcacgatatttagactgagaaataaaaataaattacacactttactagtcagtgatgtgtcattttgaagagtaggtgttttgtgctattaatggatgcattttttgcataagttgtcaaactttttctggaatcagtgtcaaacttgttactattatatttcccagatttttataatgttgcaaaatacctacaacaaaactcttttaaagttgagagttgttaccttatatttatattagttattttttaatttaaaaaataatacataccaatgaccaaaaatttaagagttcagaaggatgtaaagttaaatgcttaggttgtctttttcctgaaagcaccaggaggactattagtttttagtttttaagctagtttgatagctattccacgcaaatttatatagcattgataaacagacataaacagatgcttattaatgaagcatcattactaagaaataattagctgttcatcctaatagcatgaaatctgtacataacgtcgatatttttagaatattttaaattaatagtctgtaagcattcctgttccttcttatgagtaaggattaaggcatgttaagaaaatttaaatctttcttctgtatgtacaaattattggtcatagctggctgttttctttactactctccttactctactaagagccaaatgggactttatatttcaaactggaaggattgctgttttgcatcaagtagtttaagtgatttaccttttccctttccatatatccttgcattataatgtgccactgctttcaagaggtaagtcttttagtatcttataataattttaattttgttggactgaaatttcttctaacagctcctgtgtgatactttgaagaacctggccttggaagattaaaaaaaaatgatgtggtagtaatattttaaaatacttttctctttgcagaaaacacaagtgacaaagttagtatccacattactggagaggaaatatggtgatttatatatgagtaaacagcatgaatgcctgatttttgcaaaattaagttaaattttgcaaaagagctgtaatttagaataaccacatttagtattttcagtaagcttggtttgcattgctatgttgtggtgaattgttttatagtaataaatagtagtgtttaacataagtcataaaatgtatgtgggttttactatgtattggtttaaaagaagcagtgcttgggaaaatgtaatttatatcagtcaagactggtagaacacaaagatagaagagaaagcataaacatttataccactagtgaataacatgtaaaactgagttgatgtccaaatcagtgtcaaaagctgatggtaaagtctcttaagaacctttatgatttttctagagttttaattcaatgttgctggcaggttcagacctctatatgtacagttgtgtgtcagtggataatagaaagtccacacatctttgaaatttgttaagagagataaataccaactgattaaatgtcaccattggtgtagatgttgggaatcactgtggtataactttcaaacctcacttttgtgttccattggtattgacactacactggctcacgattactagctttaaaaacaggcaaaaatcacattagataagaacttaaaataattttattaattagcttatggttattctgaacgtgtactaaaagtttttttggcatcacaccataaagtcgtattggaaattcgaagtatctgtcttgggacacatccaagagaattaactactgaattatcagagcaacttcattccgatgtagttgtggtctccctaattgaacagttttatgttttttatatataggaatattgcataccagtgtaaacatccccaaaccctgttttatgttttgtccatttaaagttaaatttttctggacggagacttaggctatttactagattccagtgtaaaaatgttagacttgtaaagggggagaatggcgtttggaaaaataaacatttaggttagatagaatttttttttaattcaagattaagattcattaatctgttaggtattactatgcattgttctaggtgtttctaaatgcattatgtgatttgagtctttaaactctcatgccaagagattacatacctttctcaagtcacacatcttataattaatagagctaagatttgagcctaggtcttttgaagccaaattttgatgtgcctttccctatatcatctgcttgtgacttgggcttatttctatggctttgaattaatatttattcttaatgattatagaattgaattgaagctatgtgaatcaattgatgtgcatatattacaattaggttagatattcccttttttattttgagcggttggggaatctattccaacaataaacctgtatttgtgtagttttcaaagtgccttcaaatatgctaaacataaacccttagaggaagtctgaaagacagagaaattgtcattgatttcactgttgaggaaaatgaggcttctgtagattgcagtttgcccagggcatgggggaaagtgggcagcacagccagtatgagaaaccagatcacctggctatcatgttagcacatttaccactgctgtgtatgatggactattccatttgggcacattttctaaaatatgtaaaaatatttatttgacatactcaaattgttacctttaggttgaaatcagtcaaccctccacttgctgccgctccaccacaccattgaacatttgcccccatttaacttcatattaatataaaacatttttcctaaactttaaaatgtttaaatatacatctaaaactcaactctgttcaggatgaggttattttgcaaaactatttccctgctacttaaaataacaaggcagaggagagaatgctgtgcatttgtggctgcagaagagtaaatacaagcaaactattgagatcaacttaatcctgcatctcaccctcactcagtgtaactcaaccctctgagtttatgaaactgattttgacatgtggaaatatagcaacactgaccagtcttagcgttaaaactggtaggcagtttttcttactatgtttataatgaattgttacttactctgactaaacatcattgcagaattgaataatgctacagtgtgttctttggcaaactatacagtttatactttagtcttttctatccctactgtaatatgaatgtgttgttaatgattctgcacttaataggctatgtgaatgaattatgttttgaggttcttccacttcaggtgtcactaacttagttcctttaccatgtcttatcagacacgccttctgggcaataattatatcactgataatacagagctatggaattcccacaaatcacttctgaagttactggaacttgcttgtgaatgagggtggtattaatgagggacaggagagagtaagaaaattgagtgatagctcattatttatgatccactgtgcttcctacatttttcatcatagtcgctactaagaaacaagaaaaatttcaaatggcatattattcttttataacatatgattcaggataattcatgtgagaaattgtacttgctattaatatatacttctgttatgtgagactgaaagatttttctcttattctcttctgattttaagtgattctaaaatgatctatttctacattttacatctgattgctttctgtcctttgttaagaacataataagaatttggattcatgtttaaatgatttttataaaaccttgtccttttaaaaaatagtggatctttcagtcacttgatacttgaattagcattaatacataaaatagttttcagtgttttgtgggatgggggaacaaaactgttgtcttgattataacagtgtagtagaatttttactaacatttgttcattttttggtctgtgtttacataattattttgaagcatgatgtttgtgtaacatcttcactgaaaatcattgttttgaattttatttcattgtcttttctttttcttcttttctcccctctttgtctgttgttcatcttccggggaacatcaatgtcttctctactctatcgcatctttttttgtgtgtgttattcttccctcagtaaccctggcactgtgtaagtacttaaccaatgattcactttgtaattgtctctgtaactttccttcttgctttcaatttaatactaccagcaaattttgttaggattttctcattataagaattttcaaaaatgttaaggagcataagaagcatttttttttatgctagataattttgtatgcatcagaggtatgtttagaacacccacacttctgtaatgaaaaacttagtaagttaaccttcattgagatatagatgagtattatggacagtgtataccagagttagaactgtagtttgggctttcctttagcttattattattattattttaatgtctgtattttgaaataaattacttgctcctgagagtaaagtttacattatatcccaaatgcattttttaaaataaaattattgaaatttttcttttctttcatcatggtcatcacactctggagtttcagaaccagaaaacactaaatgtttagaaactttatatcatttgacataagaccttaaggtgtggtaaacaacacaaagaatctaaggggtagtgtactttttacaagtgtgtcataactaaaaatactacttaggtagtgtcattctattattcgtgatatcttagcttgacaccattgttttgtttttagacaccaaaccttttatagaggataaaatagtcttacacttgaaattggcatcatttaagagcaaactacactcaatacttgtagagaaatttaaaactataataagtttagtagctcaatataaaatttttcaaggacttgcataagataaagagttgtctgttttatggctgccaaaggcagtgtgtttatgaagaaatgtatgcttatttcttaattttaaaacattttgttcatttttaaaagaactaggttttgttcaatattagtggaaggtcttttagatgttttacttgtggaatcatgatattaccatattaccataagttatagtattttttatgattttttgcataaatgttactgatttgttattttgtatatgcagattattcatagtcgtagaacatgtattacagttgattttctagtaatcataaaagaatacattatgatgatcattacctcatgttatgtactgcagaaagcactttacatacattatctatcttatttgttcttaaataaccctttaagatgcaagtcttatttctcagatgaggaaattgagcttagagaaatgacttgcataaagcacacactgaatctgattttaaagccagtgttactaactgtaattctatcctgttcttcactggggaaaagcttttccagtgtgctgagacagttttggttatgtaactgttaaaatgatgacagtcgtgtggcctgcggatagcactatgattttctcacagtgagttgaacctggcaggtgttgccactcacatctgaccacatttataacactttctgtactcgtatcttgtgccagtagtctgctagtccagattcatgttcctttttctcttttgaaattaaactcatagcctccaaaaatttgcatttgccctgttttgaggggggagaagtggagactattcatgatgctcaatatatcatagtattaaaatatacattgcaaattcctttgtatttatgcccttttgaaataaaaatgaatgttcttagcaaactcaaagttcttgaactctgtagtttacacatccttagaacagcactaccttgtatgtgatattcaagagactgactttctaaagagtcttagagccaagctttaaattctgatctgttaatatatatttcagtagttgctaataatgccatacctcttcttcactatgctgatcccacacacagctttctttaggagaaggaatacctgtacatatgaatgagaaaactgtagaaataatagttcggacccttttcaaaattgtattcggaattgctagtttagcctctactaaaccatacttggttcctgggcctagtgaagatttgatcatttaatttcgtgaaagccaatacattctagcagcatattgatattaatggccgttgtgaatattgtccgcatctgtgtttcgtatggcatacagtgaacaatacaaataatttcaagaagtttgattttgactactatggactttcattttctagttgttttctttttttcttatcattttcctttcctttttcttcatgttggaaatctttcttctgctgccttcctctgtcaattaaaaggaaaatcccacctaaacggtaatctttctgttgaatacattctaatagcattattttatattaacattataagtgcagttttttacttataatttaaaaggtttttttgttttgtttttttgtgaaacagagtctcgctctgttgcccaggctggagtgcagtggtgcgatcttggctcactgcaacctccacatcccaggttcaagcgattctcctgcgtcagcctccccagtagctgggactacaggcacgtgccaccattcccagctaattttttgtatttttagcagagacggagtttcactgtgttagccaggatggtctcaatctcctgacctcatgatccgcccacctcagcctcccaaagtgctgggattacaggcgtgagccaccgtgccccgcctattttagatagatcttttaaaaacttgagaccgaatatacttgcaaagcaaactgtttatataaaaggaatattgaagattaatcatataaattataaataatttagtagaagatattttatccttttaatataactttacaatttttaattttttttttctccttaaccctagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacattgtaagtgaacttctaggtatcctaatggatgaatgtttttttgccccagagagtggcattgagactgattggtagttgtcagaaaacaaccccgagacagtttgcttttaaattatgctgtgcataacatgggtaatataaataagaccccaggccgggcacagtggctcacgcctgtaatcccagcgctttgggaggccgaggcaggcagatcatgaggtcatgagttcgagaccagactagccaacatggtgaaaccccgcctttactaaaaatacaaaaattatctgggcatcgtggaagccacctgtaatcccagctacttgggagcctgaggcaggagaatcatttgaaccggggaggcagagattgcagtgagctgagatcacgccactgtactccagcctgggtgatggaggggctctgtctcaaaaataaataaataaataaataaataaaacaccagcccaggagagtaacattgaaaagtatagatgtaatagtagttgtactaactatagtttatggccaataacaggctactatggaattcgttttagtggctccatggaagttgaacatttgatattgattggtgcaggtaattgcttaagtgattttgaagttaaacaaaacaaactaatattggatattgcttattatatttcagtgaaagaatctgaagccgataatacaaagaaggcaaagtaagttctctatctttttgacaattgaatgttttcctttcacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataagaagtgggcagaagggtatatttcggggtgctttgctaacaatacatatgtctgtgaatgagctcgtgtgttgtcttgcagtcactttattttgaacataaaaatgtatgtttccaagagggatctgtggattaattgctatatttctaaaaatgctctacccttaaaatttttgccacttaataaaacagctatgtgaaattaagcttttataaggcatgttttctgcatgatggaattagtctagaacctttttccttctatttcttatgactcttctatcactctttttttttttttttttttgtatttccacagggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacatttcatttggaaatcatttttaactttgtgaggttactaaaatatgggtataaaacacggcaggccaggtgcggtggctcacgcctgtaatcccagcattttgggaggccgaggcgggcagatcacctgaggttgggagttcaagaccagactaaccaacatggagaaaccccatctctactaaacatacaaaattagccgggcatggtggcgcatgcctgtaatcccaggtactcgggaggctgaggcaggagaatcgcttgaacccgggaggcgaaggttgcggtgagccgagattgcaccattgcattccagcctgggcaacaagagcgaaactccatctctaaataaataaataaataaataaataaataaataaataaataagacacagtaaaggatcatgtttgattttccccctgaattattacaatatgtagtatcctatgtgagtaacataaaatcagttgactattgtgcaacatagaattattgtttgtgtgaaattaccgctgaaggaccttgcctacattcaagggtctatttttatttttccaggtattctttcacattagtgacattatagtctagtacaactgcttgataatttggagaaactaacattaattttagatagtgattgataaaatttggcctgccaaatgcattttaaaaataattctaggatttatctatgctcatttctagtatacctcatgatatataagacatctttcttttgtcatatcagttcttcagatactaagacagaggtcctgcctgcttgtgtttttatgatgctgacatcaatcccagttataactgtgtctctggcctctgtaagaaaatctactttcttagaccaggctttcctatacccagtaattcttccaggatcctaaaagatgatgtctgagagacgatggaattaaagcctcataaaaataaatggtgtggtagagtaaacatggtattttccaccaagaatccaatttctagaataactacagagttgacagaaagaagactcaaaagaattttaggtaaatgggaaaaattttccctaatacagacaagagaacatgtatagagttacaacttaaaacagatgtagttaaaataaaaatttattaccttgcttaattaaaaatgaagtatttagtgtttcattaaaagcatagacttagataaatggaatgatccatacttgagtgtgaggataaatattcagccaggatcataaaggacattccatttgaccctgtcagaagatgaattcctgagttcagtgaatctcctgggacattttatattcctagcttaaatgctagccaaaaattataaaagcttcttgcaaaaatattattgtaaatctagtgacctaatttatgacttgtttttgtttgtctctcttatacagactttcttcattataggcttgtttttaaagtgaaattgggaagttgctcttaagaatgttttcaacctttctttctctctttctctttctttctttcttttcttttcttttcttttctttccttttccttctttctttcctttttttaaatttgagacagagttgtgctctgtcacccaggctggagtgcgatggtgcggtattggcttactgcaacctccacctcccaggtttgagtgattctcctgcctcagcctcctgagtagctgggattacaggtgtgcaccacctgcccagctaatttttatagtttttttagtagagacagggtttcaccatgttggccaggctggtctcgaactcctgacctccagttatccgcctgtgcctcggcctcccaaagtgctgggattacagatgtgagccaccatgcctggcctcaacatttttttcttacagtgttttattcagaagactgtctcacacatggtccaatgtatttttgttacctcaaaaattacagtatttgtggaaaacaaaagcattctttcgtgcatcattgtgccctttaggaaggctcagatagatagacatcttagagtttatttaatacaaattgtggtattaggacacagagtagcagttccttctttttttcaaaattattcaaaaatatagaatgaattgattttccctccagatatgtaattttgtaattattgtgtttctgatgtgtatttaaaatcatataaattgtaaatatttactcattgccagcattcattctttcaaatgcataattgctgtatatgtaaatgccaggcactaatcaatgtactagggatacagtaatgaataacagataaatgtataagcaagatgatctgaggtaattgtgttaccaagataataagttaatataaaataagtttggcttagtcagggaaggattactttagattatgtggacctctgaggagacgaccttaatgccagcagctgggagtggaaaaggagtcagccgtgtgatgacttgagggtggggagacaagtgtggaaaggagcatggcaagaatacagaacagaaaggtcagtgtggctggagtccaggctaggcagggaagtgtgctagaaaaacagaactcctgtacatagacaaaacacttatattcccattcctatccatagcattttaaatgggaaattattatatcatatctaactgcttgcaaataaaattagaaaatgaagaagcagggaggttagtcaggctgctaattgcagtgtgctcatctagttggtaccagccctgattattaacaatttaatatttttcctgttgagacccaatgaagacctagaaaagagaggcataaatatatgttggtaacatgaatgtagggaacacaaacagaatatcctgcagagcatacataaagccatacagaaaatacgaaaacactttggtgtattacatttgacatatgatgctcttcacaatagtgatgaatttgaggatttagtcttctctgtaaaatcttagctagaattgtctggacactttgcttttgttcatcccattccagaaaattccttaaaccaagtaaataatttccttgcacattctttccaaaatagggatcatagcatttttttcttggttagaagtagtaagaagcagcaagtgataaattctggggtttagactgagatttgtaactcactgattactttctgtccccaagtttccacttctttaaaatatggagttggaatctgtggtggacactgtgctgcccactcagataccacttcagtggaggacttgatacctctgctgatgggagtgtcgtaggcagacagccttcacgtgccagccccttcacaaatcacctcagctgcagacagtccctcttcaagaccctaggcttggtggtgctgcccacatgcagtgaactaattgataagtgggaagagagggaagtaaaaaacctggttatttcatcccaattaagaccaacttggagggaccattctagctcctgagctgctgtggtatcagctgaggctgtcctaagttttgtttgcaactccacctctcctacccactcctgcttccttttctgtcctttccccttcacggttgttgaccctagagacatttcttaataagcatcctgcatgctaagcgctaagctctgctttctggagaacctgatctgcaaaagaatcatatttttgtagaccccagtttagacctcagttgcacaggttctcttttattcatcttctcatcactttctttgccttggtcacttctcatcttttctccttagatcttcaacccagatcacaaacacagcatttagaagtcttcaaagtaaaagatcagttaagggaggactgaaagtcatgtggaagtcaaaaggaacatgcatttactttatttttttgccttaaattaaggatgtttatttgttgacttcatcacaggcagcctaagagtaatgagcaagcaaatgtatttagaaatcaaatataatcagagatatgtgaatgaagcaatgaaatgagaagcttcaaaatgggaaattaggatttactgagtaaatgtaatgaacacttaaaacaggaaagcagtacttaaaatattatgattttgcatgttatagtcttccatatatagcatttggaatcttaagtattagccatttaatttcacttaataaattttgttagaacacatctgttttcttcacatccttaaaagtttacttctagttctctcctggggagattctgttgctgagtagcctttggaaatgtgtaggctaatgtacagacattaaaaggaaggaggatgctaaatatcttgtaatgcactgaagaatcccacagactgaagaatcatccagcccaatatgccaattgtgtgctactgagaatgactgcattgagtgtaaatattcccttttccaagttttgttttgttttgttttgttttttgagacagagtctcgctttgtcacccaggctagagtgcagtggcgccatcatggctcactgcacctcgacctcccaggctcaagtgatcctcccgcctcagcctcccaagtagctggaactacaggcacacaccaccacacctggctaattttttgtaaaggcaggattttgccatgttgcccaggctggtctcgaactcttggcaatctgcctgcctcagcctcccgaagtcctaggatcgtcggtgtgagccattgcgtctggcctagattttcttattccttcccacaatcatacattctcacctacagagcgccctctccactgccccaccccacagtaggaataattttgtcacctctgaacttacatgctacacaatttttacctctcatttgacacttgattttctaatttgtcttatggatattggtctacatgtcttaagtttcctaccgaagtttgagctctttaaaaacaaaagtcttagtgtaatagtataaattggaaggaaaaggcattctagtagtcatcgtatttcttcctggatgcaactgtagctgcaactgtaagtaaaggcctagcaattcaatgaaatgactaatcttgaaggtggttgttaagattataaaattcatctctggtgaactgtttcttcagttagaaatatactgttttcagtcagtttaggctgccacaagatacacagactggttaggtgggacagtagaaacttattatctcatagttctggagactgtaagttctaggtcaaggtgccagcagagttggtgtctgttgaggcctttcctaacggttgtgtatggccactgtctcactgtgtctcctcacatggctttttctctgtgggggcacagagaaagagtgaaagctctggggtctgttcttctcatgaaagctctggggtctcttcttctcatgaggacatcagttctattgggtcagggtcccacccttatgacttcatttaaccttaattacctctttaaaggacctatctccaaatagtcacattgtgggttagggcttcaacatatgaataatggagggatacagttcggtccataacatacactaactgtctttgtatactaatcctcattttgacagattgtcatttaagaaaaaattattcttaagtagaatcattgacttggacccaattggaagcattgttgtcacctctcttttggtgcttcctttttacctttggatgacaggtatctgtctccatattctcttttctcaactacagtaaaagttctttgaatgtgagaattttagtatgccccaccatgtttggtactaaaagttactaattatatataattgcatatttttccaattctctaattttagggaagttgtttacagcgtggcacacactatctctaatggaatataagttcgatataaatatcaagacattaaaatatcaaaacattaatacctatattgaaagtaaagtgaaaccatacctaagtcacttgaaaggggaattgtactttgttggagtaatctaattgccaaaagttgacacttttttcttgatattttctgtttgttaattagtgaaagactttttttcattaaatgaacatttgttttttaatgtcttcctttgtgtttttggtgtgtttcaacatgaagagcatggtgattcccatgaggagagaataacaattttagaaataggtatatgagatgcttagttagtgctctgaacagaaatactaatagagaaaattttatcattaataaggaaatgtttaaatataagaatctaatctacaacattgatttaaaagaggcaacagccatcttatcagtaactattaataatagaaagttattaataatatatggcctaccagaatagagaattatgggagaccatagaaaattttatttagagataattatgttatacatgcacacacacacacacatttatgccaaaaaatcatattgtcaaagtatatttaagttaaaaaatgtttttcttgatctcaccatgttctcaattttctactatattataataatatcaatctttgtagtttcaaatttttaatgctatatataagtataaagtggtattttagtttagcaaaaggatatctaaaataatgatcaaaacatttttatcagtcttttctttatctcccttgcttaaagaatgatgggttctgatttttcacatatttattatggttgtattagtctgttctcatactgctaaaaagaactacctgagacagtaatttatgaggaagcggtttgattgactcatagttccacaggcttaacaggaatcatgggtgggagtcctcaggaaacttacaatcatggtggaaggtgaaggggaagctggtacatcttcacaatggtggagcaggagagagagagaagggggaggtgccacacacttttaaacaaccagatctcatgagaacaatctcactgtcacaagaacagcatgggaaaaccaccccaatgatccaggtacctcctgccaggtccctccctcaacacgtggggattacaatttgacatgtggtttgggtggggacacagagccaaaccatatcaatggttaagaattataaggtatgatatggcttcccaattgtcaaagaattaaaatgctcattaggagaggagtgactgcttctccctttagtagaaaaacaattcaaactcaggttaccaattacaatacacaaactaaaacagttatgttgagccgggaaaccgtcttcttgtaggctatcttctagcaccaaataatgcccacatgatttctggctgaaggccatcagaatggaattttagcactggaagaatagagttaatgttacttcttaaggagaaacctattacctttgtacattcattgaaaatttaggaagcataaattacatatttctgaacatactgttttgtaagtttttttaaaactttgttgatattcattgacccacacaaaatagattaatgaagaaatagtttgctgacccatcccatgtcttcattattgctgtgtttcacaaacatactggtgtcttgtgacatatccttattaagacacgttagttgagtatattacctaaagctgctattcttaataagctatgcaaagaaagcaggaattattccctagcctgatatttgcacatattttcatgagataagaattagcaattggacttgccccaaaaaatagaacagcaagatacattcccacaaaatatgtttgccaacctgtaaaaaaaccacctgtcaaaaaatggtgtatatgatcaagtaatttttgtctcttgcaaaatatggaatatttgtaattgatctttgattttctgctggttgagtatactgttttatgcaaatactgttttgctgactacaatgtaaaggtcgccatctgttgaacataagtaattactacacttcagttccttgtgagactagtacttaaaaattattgagccaagaaacatagttcctatgtattttcacatccaaattgtttaattctgtttaatgctggaaatgcctgttgttgttgttgtttaccaaattaaacgtgtactattagcacttataaagatctgttatttataaaagtcagtgttcgtaatatgccaagttggctttcataatcccagaatattcaccacgttccttagaggcagaattttgtcagaccggtagtccttctcttataatgctgtttggataagttgttttccatttcacctttagagaagtaaattacacaataaaattattttattgaattaaaccagataattaaagaaacttatgtttactaaaactcagtattgaagaagactcctgcactttagtttttttttttcttcaaaagaaatcacaacttcaaaagttaattaagagcattgatgataggcagacttcaaaatcatggaaggcttaatttctatcttttgctgctattctagtttatgtatttcagacacattgcaggtttcagaagtccaagttttcctacttttatattatgtgaaggtttgtttattagaatgatatgattttataaaagaaaattgaaccaatatattatattatatagtataaagcatatgacaggtatggatatttagacatcttcactttccttttagtcaaattaaagaactatctacaaattgcttttatctaaaaattagtctcatgtgtccatgtattctcttttgtgtttttctatttttgtatctattaaagggtattgtttgaatgctactcctgtgtccaactctgtaataggtgttcatctcacagatgcacctaattaactactcccaaagattctgaatttatatctttgaacagaagaatgtgttaaaactaaggtgacacctgttgcggaattttcaagttagtggtacacacttattttgcctcttcacacactttattctttatcctgatatgctagtaatttataagaagaaaaaaattgagaataaatttctgaaagattttaatgtcttcaggtagctgtgtatcattggttagacagtgagtgaacttgaagctttaatacagagaagtaacacttaagcaaatttggtggaatcaagtttacccttggcttacagcagtggaatcacatacttgttaaaatcagcaaagctcttagcagggatgttggagcagcatcacaggtatgtttacaaaaagtacacccaccaacagtaaaaccaaaaatcctttatatatgaaaggtaaaacaatcagataacatctattcaagggataagtaaaaaacagaagtgatgtcgtcaagggtgatggtgaaactaataaatgctctgtgttgaaagacagcaaataaaaataaccaaaacccagaggtttatttatatcctggagggatttgaagccccccatacagaaagtgattctaaatggttctcactagactctttttcttaatgacttaccgctcagggtatgtagaggacttacagatgagattcactgagtactatctgcgtttgtttcaaatcctggatgggaaagaaaatagaagagtggtaaaaggaaaatatagtactgattttcaaaaaaggaaaaaaaagttaacttctaaccataaactaatttgaacttgagatcatctggaaaaaagtcaagcaggcattctgaaaagcatggctagtgagcactgagaagaggagggcagaattgccaagacccagaataagttctcaagaaacacatcacatccaacttaacacattttggatagattgggagagatgttaattttaacaattgatcaaagaaagacccttaaaattcctttgaatttaataatgaaatgaggttgataagtatgtttttaaatgcataaaaggttgaagtagtttaaccaaagaatattgtttaaaggattaattagtgacttggatgaggagatccacaacttgctgcccatatttgtgagtaccatgaagcagggagatatagcatacatgttcaataaccaataaggttggcaaacctaaatatcaaaggagaagtgggaattttaaaagaaaataaacccagtaagagttagtcatgtcgtatggctcctaaaatgataagcagtagttctgttctgcactagtaaatctcacctggtggcatattatgctagtccttgacgttaatctctgacaattacatagataatcccaagaaaatcaactgaagactcactgagacaattaagctgtctttgggtgagaagcagttatatgagtagttgatattagacgataatctgggctggttctttgacctaaatccaagtgggtcttttcctctaaacattctcctttagtctcaggcctcacttattagcagtggcccctgctcatgtttagcatatattatatataataaatacgtccaacaaatgtttatgaggcacttatttgtgctggtttctaggaaaatgaagatgctattatgaacttagtctagtagagcagacatgcaatgaaaaaggaaaataaggaaaaatacagttttaggttatgatatattctataaagtaatatagtacaacatgaatataatgaggggaggggaagagtaaggtcattagactctagttagagaaaaagaaaataatttgagctgaaatgtgagtgccctgaaagagtcagtcatgaggatgtggagatgtcctctccaggcagaaggaacagcaaatgcagagtccctgagacaggaatcagttggtgtgtttagggaactgaaaaagagccattatgaatggggcatagtaaataagagacagaatgataagagattacgtgaagtactcaggggccagattattgactgccttgtaggttgtgttaaggagttcagattatttttctaattaaatgagaggcccaatataggactgtagtcataggagtaacatctgatgtatatttttaacagatcaccctgaatactatggaaaattaattgtaagggagaaataatgggagcaggagactgttatgagtatccccatagttcagataagcaatgtagtggcagtggagatggagagcattggataggtttgtattttagacaaagagctgataggtgtatagaaatattgaggtggagggtaatggagagtggaaaattggtaagtcagtgaatttgtaaagaattagttcagttgataagagctaatgagattggtcagagtcaatttggtacagtaaaaaaagctaatagaatcgagggatagcagactgagtgaggaaaaaaaagggtccttaaaatttagatttcagacatgttgtacttgttgatgaaaaattaaaggttatgaattttggagtgcatgctgatatattctaggtgtaaggcttagccttaggggaatgtatcattaaagtgaagaaatcaaacaattcaatagtaaggttatttattcagtgattgtgcatgattattgaaataatcatgagagattgttggaatggggtgaagaggaaggcagtcaggagctaaaacagtgggtgaggtagagacaaacagtgggaaggccctatagtgaatggtatagtgagcctccaaggacttgggattttggaggatcaaagatgactgatagtagttaaaacagtaatgaggaggacacttgctccatctccaggtttataagaataaggcatatgaaagaaaaagcaacatctgtttgaagagactgtaaagaaggtatagtaaaacagtaatgggtttgtgagggctgtgatagatggtgaagtgattagattaggagatacacaaagcagtgaagaaataagagtccaggagatgctggatgacccaagggatttgaacttctgattgtggcaggtaaacaagggtaagtgggaagcatgatgtgattaatcctcagagtccattacaggaaaatggatactagaatgtaagcttcatgagggcaggaaattaaagtagacaataggatgtgtgaaggtgcttggcacaaagtgggaattcaagtaattgttttttgttattgaatgaatgagtgaatgcaatgagtgattgaatgggtgcgtttgggacatatgatccagaatatttggctagtgagtgtgtagccacttggctattgttctgtaatgccaacaggacactctcactggagcatgaggtactgtgctggctttctcaagacatgtggcctctttaaggattcactgtgggtggctgttcagtgggacacattcagacgtattcttttatattttcaaacaggtaacttgacttaacactatttattaaataatacatgcctttctcctctttatcccgaatctgaaaaatacctttattgtttataaattctttttctaatattaggattatgttaaaactacaaaatggcagatttttgtcacatataagaagctatttctaactagtataaatctctgaagtcatggatcagaatgatccagtgaagaaactgatgatggaaagtgagagggccaaaggttagtggtaagtgccctgcagttactgagggagtcatgcttttatcaggggattgctccaagtgacttttaagttgtcattacacgttaaaatcttcatattatatttgcattttgtatagataaaaaatgctcattctttacctggctttagaccctatagaacattttctatatagagatcaaagaatactctagataactaaagaatttacaaaatattaagtattgaacacttaataatgataaaatccattatggagtggcaacagcagagaaatgtgtaagagttataaagccatagtttgaaagatgtgagaaaatggaaaatatcatcaaagaggaaattctttccctaatacaaatgtcttagtcagatcaagctgctagaacaaaaatatcatggactgggtggcttaaacaacaaacagttatttctcatagttctggaggctgggaagtcaagatcgaggtacctgtacactcagtgtctggtgagggactgcttcttagttcatagatgatgccttctcactgtatcctcatatggtaggagagagggagctctctgaggtatctcttataagggacccctttcatgagcgctctctgcctgtgtgacctaatcatctcccagaggcctcacctcctaatactatcacatagggcgttaggattttgacatatgatttggggctggggggacacaaacgttcactgtataacaacaaataataagttccaattccttcagcaatatccctttttgtttgcctatcttttccttgcttaagtaagtgggaagctcctagaaaaatgatttctttgagttagtccttctttgctcttacaaaaaatcaacctcattttgggtagtattttcatgtttgataatttatttcataaccttttagcctctaagatccagtcctccttgtctgccatgtgcaaagcaaggataactctacttgcttatttttaaattctcaagatgccatctatgtaataaaggtagaattagcaggctcaagtaacattttcaggctgctacagaaacaaagactattgaaaaccaattaataaatggatagcttatgattgagagtaccagaaattcccacctgaggtttagttgatttagttttccagaagggagatcatagttacaaatgagcaaactcaacatatttattgtcaggaagccagcagaaaatacttatttttttcacatgcctagcagtttccttggctaaaataaatagctttgctatgccagtgaaccccaaaagggcagaatctagctatgactctgatatattctagtttctgcttagcaatattattacataaaagtttgctttgtggaagtagaataccaaggacaatttattgtcattttcctcctttaccttttaataaaacgtatatttcaaggtttgtgaatttttcctcttattgaaaactcgtcgtgtgggtatgtaataagtcactagtctatttgatcattttatcatatttatattcagaaataggaagcatttaaaattttaattgaagatgccatttttatgttgtaaaagaaaatgtttgcattatttttaagatttttttaaggttcgcctttgtgacagatttcttcttagaacatagtttgcatataattccatcaaaatctggatgacccaaattaacattttgaaattttattactgatagagaactttaccatcctgcagcctggtttctttttgagacggagtttcgctctctcatccaggctggaatgcaatggcaggatcttggctcactgcaacctccgcctcccaggttcaagtgattctcctgcctcagcctcccgagtagctgggattacaggcacccaccaccacacccagctaatttttatattttttttagtagagacggagttttgccatgtgggccaggctggtcttgaactcctgacctcaggtgatccacctgccttggcctcccaaagtgctgggattgcaggtgtgagccaccacaccaggcccctgcagcctggtttttgttctcctcattccactgaagttattctaaccatgggtgccagtacagtagctccaccatataccaaagtactaactttagtaaattaccaaggataattttagtaccagggttgaaagattattggaaggattaaatatgatgatacatattaagcgatgaaaaaatatttgcttttattattaacaaatgatttacatgtaagttaaaaaatgaagtaaaagtaataatattatcattaatgaccaagagcctgaatcctggaagaacttagtttgttcaagacattgtacaggtagtctaatgtgactggagttcagtgaataaagggaaaattggtgtggaaagataattgagaggttgatcataacaggtcatttggggattttgtagagaatgttaagcactttgggtattatcctaactgcagtaggaatttgttgcaaggttttaatcaaaagaatgatttgataaaatgtgttttgttgttttttcttaaggcacatgggctatactaaaccatgccagaaaacacaggggctggaaggggcaggatttggcaagagaggaagcaagagagcagttagacagttcttaaatcactagtataagttagtgcttatcatagtctggatgagagagggtggtagcagagaaatggggtagatggatggcgtaatgagaaaaacttgggactgtaatgcccccccaaccctccgcaaactgggaaaactgggacgttgccaagagaatgactcagacaagtccagcttgatgagtagatgagtttattaggacatacatacagggcactgctggacagcagcagtatggctccaagagatccacaccgcctcccatctctaggctgcttttaagctaattttctggctctttgccgtgtatgtgtgtgcgcacgcgcgcgtgtgtgagtgtgctgggacttttttccttggtatattcccagccatgcctcaggatgtttgcgttctcagggacccctgcttctcggctaggcaccatggccttagctaactgcctggccctcaagtttcaagcattgaatataacacccttaagtaacctggtaggggacccatcacaccactgatagattaaaaatataaatttggaagtagagtcatttggacatggtgaaagatgatttgagacagagagatattagaggtattaataactaaagggcaattcaaaatatgggctactgctcataggagacagctgggctagatataaatctggacattaggtggtgttaaagctacaggacagagtaatgtcactgtactaatgatagcagagtacagagaaataaagcctaggacagagaactctcgggcaacagaatagccagtgaaatactactaaaaacaggcaggtaaatagggttgaggcacaaatgacaggaaaagagaagcagtagtcaattgagccagacactaagtaaaatgaggaatgtgcacaaaaagacaaatattgtatgattccactgataggaggtatctaatgtagtcatcttcgggtcaggcttaggaggtatctaatgtagtcatcttcgggctgggtgtggtggctcacgcctgtaatcccagcactttgggaggccaaggcaggcggatcactggaggtcgggagttcgagaccagcctgaccaacatggagaaaccccgtctctactaaaaacacaaaaattagccaggcgtggtggcacgtacctgtagtcccagctattcaggaggctgaggcaggagaatcgtttgaaccagggaggtggaggttgcagtgagccgggattgtgccactgtactccagcctgggtgacagagtgaggctccgtctccaaaaaaagaattaaagtagtcatcttcatagaaacagtagaatggtgctggttaccacaggctagggggagggggaaggggtagttgttcaatgggtatagagtttcgaatatgcaagatgaaaaacttctggagatctcttccacaataatgtgaacgtacttcacactactgactgtgcacttgaaaatcgttaagatagtaagtttcatgttatgtattttttaccacagtttttaaaatgaggaatgcaaattgtccattgaatttagccacaagaaggtcatcagtgaccttagcaagatgcagtttcatagagtgttgggggttggggtctagttgagatggctgaagactgacagtcaagtgagtataatgttatttcagagtctggctggtaagtggaacaggaaaatagaaagtaaagatagtctgttgtttttaagagaaactactgcattttaaaagaggacacaaagcatccagtagagaaggagagatggattaatcgaggccactgagattaagggaggagatggagtacacagcattagaatgttgctcttgggcagttgtccggactaggggatagaaaaagaattcttcttactggtcctacaggatggtaaggatggtaaattagtagatggacaactcacacctgatttgctggacagattgttcacaagggtccgtaatgaacaagtgcagagatggtgcagaaatagacacaatgcatgaatagctctttgttcatgtatcctgagaaaagcaagccaaaagggaaagactttatctgggaaagaggaagtcttcataaccctctctggtgagaaatgaaaactcatttaagcaagacaaggcagaaaatttggctgctgcagatatgctattaatcagagcttcctccaacctaaaaggagtaaacactggggaatgtcagaatgagaacagatactgatgtttgttccatagtaaatgaggtagtttaagattttgtcttaagtcaggtttttagagtttggctaagcaatgaagagataatcaatacgtgtaacacatgggaaacttcccaagtgcgtttgcttggaagatgacttggagatcatcttcaaaggtatttcatgatttatatgaaatttattctcaaatggcactcagcttttttccaatcagcatatttcacggagatgttggaagactcaacttctccaactcactcccttttctttttttttttaatctgtcctgtggtaatatgtagatattgataataatttataaccatattttcttttttcctgaaatatttataaatttttaatattaaaatatttatttaaaggtattttgggagcactattcatttctttcaagttatcatgtgtccacttaggcaaaaatctgtttagtcagaattgtgacacagtctctagaaggtacaaatacttttcaatttacaaatattgtgaattcgttatttggaaaaaataaatttcaagcttttatttcacaaatatttgttaactttatggtaagcactttgttacacttcatgtatatcagtaactattggtatcagggagcttctagtcttctgagactgtctggatttaaacaaataacgacacaaattgtataataataataacaaattatatgagtgaaaagtacagactgctatgacagcacatgacaggggcagctaaggtggcttggggaatcagggaggcttctgggaggaggtgacatttaaactgaggccagaaggatgccttggagttatcccagtgagggtgtggtagaacgagggctgaggacagtgaggagtaggagactgtgcagaggccaggagggggatagaagcagggcctatttcaaaaagagatggaaggcccagtggactggagcaagccaaagagagtggacaagcttcatgacataatgctgaagaacaggtagcccaagatcacctagagcagggctggaaggtctaagcaacagacatgatggcatttgtatttttcagagttcactctggtagctgtgtagagaagttattttctaggacaggggtcagcaaatttttttctgtaaaggtccagataggaaatgtgctagatttttcaggccatatggtctgtcacagttagtcagttcttatatcatatgaaagtagccatagacatatgaagaatgaacctggctatgttccaataaagttccaataaaaccttatttatggatgctgaaatttgaattttatataatttttgtgtgtcattgtattgttatttcgattttcttaaccattaaccatttaaaaatatgaaaactattcttaggccatacaaagacaggcagggcctgaatttggccagcatgccgtggtttgctgacccatgttatggttcttatatttcttagtctcttaacctttctgctctacctcttaatgttttagttctatcatgacatttttcttcaactgtctacgttttttcaacactctggtaaaggtatgactaatgtgaaataaaaaacaggaatataacctctcctttcctattttttaatccatttgaaaatcagtgtaacatgactgaccattctatttttttatccacagactttttttttttaatggctaattttgtatttttcctgttttatttttcttcccaaagttttatacttggtgctttcttttttttgaacttaacattgagttcttcattttttctttacctggcaatagttcttctagaacttacttctggcattctatataaaaaataatacagatatcagaaaattaaagtaaagaatactcaaaaccctacgattgcatgccaccatctgttgtatgagcagataaaatagtttgtttacatcaagatacacaacatccatataacttcagatctacagacagaacattctgacgtgaaacttttggttgctttcttgtaggacacttttaggtagctgtctcacaatgttctggaaaacattatatagtggaaataatacaggcagacctggtccaaattccacctggcccttactagatgtatggtattgggcaacttaattaacttcttggagcctaagtttttttaaagcattcaaaacacgtagtcagtgaatgggaatttccacctccttttcccctgtaagcgtaatattttattacatagaagtagccatattaaagaattttgggggaaaacagcccatattttgtggtggcagaagtgttgggttttgttttaaccatttgtagatgtgaagtaaaagaaaaccaatagtgttcccaaaattgaactagtagacatttaaaagatggtatagatgataaatgtcttttgtacttttcattaatatttcctttgccttatatattttacttctgaaaacttaggtttgacagtgctctggaagacctacctaagagtggacctcaccctcctgcaactcctcaggtgttaactattggtagccaagtggccacactttctaaagtagcaactacttattctaggtagactcttccttcttggtgtttctaaatttcaaagctggtagtgaatttaaatatactaaactgtttgaaaaagaaaaaatgattgttgattacagaacggacatcattaacctatagacaagaaagcttggcactcagcctcaaaacagcgcttctcactgcttttatatttttatttttgtttagtttataacttctaatatagaatcaagaaatctctttcatttattcactttgtgatttggaaagttaacttgctggctttgtcataagtctccttttctgaattagagcatttgcctcaaagacaggtaaaggtcatacacaatatgttaccaggtgcccagacatattctaaagatactcagataagtaactgcttatgagatataactagattctgctgatactaaatccttttctattatttgtgatgcaatatgatgaaagaaattcattaccgtttccttttcttcctggagaagaaaaaattagctgatttatttttaagtgatttttcaatatactaagtttctagttcttattattcaccattatgtctccaaatagtaaccattgtctcagagatgcagagtaatgcagaaactcagaagtggaatcacatgataactttattattccctttgacattcatgttacctaccctgctctgccattgataacatctttcttttctctctccagaccctgacgttttcttttctaaccattcattaacagttgttaaaacttagccatacagtttaatttaatggatagacttagatagaccaaaagaaaaattacttaattctgtatcattttgaaaacatagcttgcaactatttccttaattttttttctaatcgtttttgtaaagttatagcctgtggaaattggaagaatgacttatcaaattcttttgacaggaaaaagagacttatgtcaaccctcacagtttcagacatctaagctcacattaaccagaggtcgagtttgccacgtaattactttgtgttggaggtggccattgaaaaaagtggtcatactgtagtgatgatgctcattgataagttgcacccataaatgaagaagagagactacaagtttcacactatacgtttatacactctttttattttacttaataaccaatttgaaaatcactacagtcataattatagaatgttcattcctgtccaggcatttgatcttttctaaaaggccaagggaaaattattattttaattaataaatacttattagttctgaagataaaatgctatacctgcatttaaaaatgcttacagaactaactgaaaatagaaatatggaactcagcagaaaaggtgatgttttgatcatattcactgtaacattggtttattttcgcaaaggtactttccctccttacatagctttactctcaatattttaaacaattatctcttttcatgttaatatatattgctccttcttgataagcagtctgttgtgcctgcttctcctgaaaacataagtcgtattaaaatgtcacgctgtcagtatatatcgtctctaaggtaaagctcattgtatagagactttttgggaaaaaacaattttccttctttctatgcttatagaaattcagacttcacgtttagatttattttctactaagttgttggcaagtcagtcttcaaatgtgtgatacgaggtaattttaaataggaatacagtcagtgaatttaaatacattgaagagtattcgtatgtccaaatcagctttatggaggattatacatcagcttttagcttctgagagaaaccgtaggagcacagactaaatggcctgaactcctattacacttcttacacttcacacttttataatgcttagatattaatatgaaatggttgctctcttgtatttattatgctaccctttctcactttcctttttgttcctctcctgtttttctttccctacctgtcagtttaagcagctccacaggaaatgtggaagattctttcgaaggttttcgaaacttttctaccttctcttctcctgctagatatagtgctgcagttctgagcagcgcagctgctactgtgtctgctgttattgctacaaaaaccaggtagaactacacgtacagcgtctgtctgatgtgatctcagcgctcttcactgtcttacaagtcacctcaaagaaaacatgcccctttgaagcaatcatagctctattgtgagctcttaattgtgtagtgcatattttatctaggttgtggataaatctcacagtatttgttactggttttttcttaaaaaatcaccttttaatctctccactgctgccatttatgtatggtatttctcagttgcgtgaattattacatgttgtgtgcttattgtcacttgggtttttacatttttcaggttttatatttgaaacaataaagtattaatgaatattttaagtttctattgattttatcttctcccacgacctttaaagggtgatctgaagactactctcccctaaaaaaataaaattgtgtccttccccaaaaagaataaattggttttgttttcgtggtttggggattttagataatttctatagtctttagagcttcaaatgctttctaaatgatggctttgaccattttggtgaaaatctaatcaatgttatattaatgagtaaagggatagaataaactcttggtgcttctttttatcttctttcatcctcctttgctgctttgtgcttcccctccttcttcctctctctccccaccctctctctcgtaaaggaaatgtttcaaatcacagaccttaagaactactgtctgctattggtagtgtgatttttgacttaaaactctttctaaatgcttaccaggctctacactcctgaaagatatcactcactcctggatgcactttgcatcagccctgtctccaagcctttagctttttcctatctgcagtcctcaaggaaatcaactggctctatccatgttaagaaaacaaggtactgtgggagcagatatggcaagtggtggttcgctgttaagcatactgctttctctaacactccaccactgtattaacaggccaggtgagaacatgctagagttctagggatttgtgcccaattttgaatgaactgtaatgtcagtggcatgctaatgcacaagcacagtatgtcctatgattattaactcaccttttaaccttttgtgacatctttccttagcatacttgatgtttggtgtgcaattctgagtaattgtgcaagtatttaaattgcagtagaatttctgtctttcattgcatggatatagctatattagaatcctcaaatgtttggtaagacatagcttttagaaaaatgaaaatgataatgatcaattttgattggctacatattatagttgttaaatatgaaggttttgcttggaaaagcaacttaattttcactgtatttgggaaatgctaaacaccaaaatagatttttctcctaagcttaaggattaagccagaaatttttaggcataatataaaaataaaactatcacaagtgtttactaaagatataatctcaatgaaataactgtatacaatgatttttgacagaacgtaaaatcagtggcaaagtgtacaacatatatcaggcaaagtgaaaacctgatataactaggctgtctattgattagatgtttgtattctaaccattcttatagagatttttcaatatatttacctgggccaggtgcagtggctcacacctgtaatcccagcattttgggaggccaaggctggtggatcatgaggtcaggagttcgagaccagcctagccaacatggtgaaaccccatctctactaaagatacaaaaaaattagccgggtgtggcagtgggtgcctgtaatcccagctactcaggaggctgaggcaggagaatcacttgaacccgggaggcagaagttgcagtgagccgaaattgcgccattgcactccagcctgggcgacagggcaagactctgtctcaaaaaacaaaaacaaaagcaaacaaacaaacaaaaaatatatatatatttacctattattctgggtaacttttaagggaggtgtttaaacaagggagaaagatcatagtacatttttctctaagagaagacaatacctgaaattatattagaatattgtgagtgttcattgagcagaagtctttcattgtcagggctgagattgtacagaggcaggttactgaccatgcttagagtacactttgagtacttgagtacacttagaccacacttttaggacccggtaagagctatagatcctctctccagaaaagtgcctgcgtgcatatacatgcaaaagtgtgcaagcatttatggactgactgtgctatctatggccccacctctagagcgagtattagtagtcatcaccattgcttcttattaacaataggacacagacaaaatatagtgtgatattgagagagggaaatggtttctaaaaagatagtctagttggcattctggggtttcctgaggagacccttgctaacttagtgagaggagtacccaaaagaccagatatattttatcttgtatgacagtaatcataaaatgtgtcagagacattttgtcttgatttttacttttgtgtgatagtaatctttaaaagtataaatatagtataatagtttttatttatttttttccattaaaatatatttttccattaaaatatatttccattataatatatattagtatattatactttaaattttggtttacaaactctaagttaaagaattttgcttaggaaaatattaaaaattttcttctaaatatagaattctggaaggaaagacactcattaccctctctacatgtccaggtcttttaaaggcgttctgacagaggaattctataaaataaacaattgcttgtaactaaggcctttccagaaatattcctttcctgccatttcagaatctgtatattagtataccattttttgataagactttagccaaaaactgtttaacttaaacattgataattaaacctgtgatgtacagttgtcttttaaaaaatttaaacatgtaattagaataagttactctgaaaagtattcttcaagcagagtttttcctttgaaaatggacttaaaattcccaagtattcttaatctgtatctgagctttatttgttgcaacagttaaacaaatgtgggaaaggaatgtaaactcaagataaatcaggttgctgacactgaggttaactttcttccttttcgtttttcctcattagctccatcttgaaaataaacttttgctctattagtgtacttgtctctattttcagtttttgaaaaaatgaaacaaaaaccttggtattcttaagatagaagtcatatcaatctattatttcatttcagtccctgtttatttggtagattagtgaaaataaccatattttaatatcagtatctgtggtatcagccaagggtatttatggatttacaccaatttcctcattagaattatttagaaaacatttaaattttatttaggatttagttacaccttaaataatttaaatttagaaaatatatttgaatcattagttcagaaataaaatagcaatctaatttaagtaacaatgctatactatattaatacattaatcattagaagtttcttgctagtgattattgataatattttattcctacatataaaataatatggccagtgacttttaatcctttttttttttttttttttttgagacggagtcttgctctttcaccaggctggagtgcagtggtgcgatctcagttcactgcaacctccgcctcgcgggttcaagtgattctcctgcctcagcctcccgagtagctgggacttcaggcatgcaccaccacacccagctaatttttgtatttttagtagagacggggtttcaccacattgtccaggatggtctccatctcttgacctcgtgatccgcccacctcggcctcccaaggtgctgggattacaggcatgagccaccgcgcccagccaatcctttcatctttagtacaatgtttgtttttttacagagacaaggtcttgccgtgttgcccaggctggtcttgaactcctgggctcaagcagtccttctgtcttggtctcctaaagtgctgggattacaggcatgaactactgtgcccagccaataccaaatgtttatgtatgctctttaaatagtagctaatagttaaaattagggaaaaaatgttagatttttaggggattgggcatcatatattcagatatatgattgtctagataaaccctaatattcttccattacaacattaaatggttcaattaaattttatcctcagagaaaattgaacttcagatcaattctggatttaagcataaatggaaaaactgccttggtaataacttagatttctatgaattctttatagtctactccaagccctttgtagctaaagagtactgtttaagatttaaacatcttaggcctctgagagagaacgtatacaaacctgtgtacaaaaggtacaatcaaaaattgaaatttctttagcttatatgatacttattctgtgggaactttaagaagtattgtgtgtttttaaaactgaattgaggaagcaagattttgtctggggtcaataccctgcacccaagtgatccatagtacatttagaagcaaaattcttagtgcagatgaaggatgcttatttagtaaatgtacttattgctaattttattatcaccagaccagatattacaggatgtagaagtaagaatcctttttatttcctgagcatatactctctgctgggcactgtgctaagtaatttgcatgtattatctcatatcttatttaattcttaacagtaatcttgggataaaggtagtatttttataccattttacaggtgaggaaatttaccaagtttaaataatttacccacagtcacagtaaagtccccaacctcaggtagtttataatgaagtggaggagacaagatgcataaagaagtgactattaatagtaattttaaaacagctattacaaatcagcataaaattatatgccatgcagttaacgaatgtcctgaattaaaaagagtgtctctactgctggaggcttcaataattaaacaaaataatgtatgttaatttgaacacagtgcatgatgcgttattatatttacttctattattattaattatggataagatgtggatgggtgcagagagagagtaggaagaggtacctcgtatatagaatctggaaaaaaaaggtagaattgtggacgacagtaggggtggccagaatatagtttgtatagcatagtgataggagataagattagactggtagattgtagctttatcttagaaggctttgtatgtcatgctgaaatataactgagccttccacaggctaaatggctaaattcgttgtgcggcattccatcctctgcttaagtggcttctggtgacagggctctcacagaaagcctcattaggaacagatttttttcctttggaggatttttttatattaggaatcaccttttattgaagcaaatccatctcactgtagatttcactccttgaaattaggcaaacaatgtagttacatagagtgaatctgcaggtcagacatttgaggatggctgtcatgcttctctaggttttttcataacctgggctactattaccagttccttcacccaaactatattaagcttgacactgaattcctctcttttaagtcagtttgtctggcagctctcctggaattaaattttgattctttcagatgactacacattaaatggtgatggattgggttttgttatttccagactatatatttttgtttcatctataattcctagcattgcttggtcataattttttttcttagaaccgtgattatatacattattaattagttttaaaaatcaaatccgcaagggtaatttaatcccagaatgaaaatgacctctatataagtatttcaaaaatcatttatttgtaatgagtaaaaatgttgaaaataaggcttacttttattatttgaatatggtaattatgtaattatccttttaatatgttaaggttatattctgtgccttagagtatgctaagcactttatacataattatcttatttaagcctcgtagaaatcttatgagcaaaatgttactcggtacacttaaagtacaggtaactgaggcttagagatgtaaaataatttgtccaccacagtgcttttaaaagatgctcgtaaccactatattgtaatttcaaaccctgattccattaatgctttttgttgtgttgcctttactgataattgtgttcaatattcccatgagggaggcagtctttgactttttatttatgataaagattattaaagtgcttaaagttttttattgtatagcgtgttttatcatcaaacaggttttagttttttaagttaaactgatcaaaaataataaaagctgatggctctatgacacttgcatttgagagaacaagaatagggagcaatatttcaagaaaatcattcttactgtttttcaaaactgtttagtgtcagagatgccccaagaccactcctaggtttattgtttcgatagaaggacttacaggattagtatatagttgcactcctgactaagatttattatagcaaaagaatacacagcaagattagcaaaggaaaaaggtgcatgggaccaagtctggaggaaatgagtctcgaactcctgacctcaggtgatctgccagccttggcctcccaaagtgctgggattacaggcatgtgccactgcacccagcctgaaagtattacttttaagaattgttattatactttacttgaaagaaataaccactgctatagtattatatcataccaaagcatatattttataatttgggctacctagaattattattttttttttggaaatgatgttatatgtagttataaatcacaaatgacttggtaataaaggccatatgatcttcaaaaccaaactggaactagcatagataagacctgctgtttaaacaggtaactcttggttgagagaagataatggcagtcttgtctcttttttccctttattatgaatgcataacactgggtgttctgttaggcaagggttgtttcttgtttattgttttgtggccagtgcatagcacaaccaacgtttggcatatagtaggtgcttaaatatttatgaatgagtgagtatgtgagtagaaggagtaactgggctgggaatgatggctcacacctgtaatcccagtgctttcggaaactgaagtgggatgattgcttgaggccaggagttcaagaccagcctgaggagcatagtgagacccctgtgtctacaaaaaaaaaaaaaaaaaaaaagtagaagaagaaaaagagtaactggtaagggctgaggtgtcagggagacttttatcatttaaaatgattaactgtgtaaattttcagtagcctaatttctcatggtagaccttttagaaagaattttcaaagtatgaaacaaatgcaatctgactcctttttctttttttcagttttaaagagaggcaatccctcagtcatgacttcaaagattttcttttctaaagaattgattaatcaatggattttgattgattaatggattttgaaaagaaaggattattgctgagttacgttgctaccacttcaccaaagatgtttctttatttcctttacagtaactctcaggagccttctccgcagttggcttcctcggtagcttccacacggagcatgcccgagagcctggacagcccaacctctggcagaccaggggttaccagcctcacagctgcagctgccttcaagcctgtaggatccactggcgtcatcaagtcaccaagctggcaacggccaaaccaaggaggtagcccagagaaatctcttgcgtcttgcttttcgtaatgagtttcattatgaaaatgtgttctgggatatatggtagaattcactggtaaaacccattctcaataacctaagatttagaaaggactatcaggattaaactatagctatttttctctctgagacatctcataaacattctttgtgtgtatttgatacagtcgcatttgctattcataattgtaggattgggcatttccttgtttcccagaataggaagcatgtgttaaattgtaaatttgggtcttatttaataacaactatattgttggaaggttatccttggaaatataacattttagttttgatgatatgtacaaataacaaccacagaaacatttattgccatcaaacaattactgaagaaagcatcttccaattcttgttcttacagtttatgtagcataggggaagaaggacacagtactagaaagagcatttgagcagcaggatggaactgcctggcctcagtttggaaacctgagttctcattgacttctacagattaacagctttaaataaagtcacataacctctttgacaccctcagttttctgatctgcaaaatgaagaaagactaaatcatttcctatttctcccaacatgaacaaagtttatgattatgtaaaaaaaagtaccccttttaacaggaaaatgggactgtacttaaatgttgctaatctcagactcagccttcatctcttctcactctttatgctctccctgggtgatctctcatccaggttcctttcattacttagttatcgataatttacagatctttctctccaactgagtgatctatttgccatctcctggtggcacctcaaatccagtatgtctgaaaataaccatttcctatctctgggaattgcacatccactcagtcaccaaagctagaatgtagacttttagaccccacgccccacattctcacagtaactaacatctaatggttttactttttattatttctcaaatttcttctctgtgtcatcagagccattgctttgattcatgacctcttcattacaaatgacttctaatttccctgtctcctttcccctccttcagtctgtcccccatacctccatactacagcaagtgatctttcttttttttcttttttttttttccacggtggctcacgcctgtaatcccagcactttgggaggccgaggccggcggatcacgaggtcaggagatctagaccatcctgggtaacacagtgaaaccctgtctctactaaaaacacaaaaaattatccgggcatggtggcgggcgcctgtagtcccagctacttgggagactgaggcaggagaatggcatgaacccggtaggtggagcttgcagtgagccaagatcacgccactgcactccagcctgggcgacagagcgagactccatctcaaaaaaaaaaagagagacaggatctcactctgttgcccagtctcccaggctgaagtgcagtagcacaatcatagctcactgtagcctcaacctccaaggttcaagtgatcatgccacttcaacttccctagtagctgggaattattattattattttttttctggtagaggtggaatatcactatattgcccaggctgccctcgaactcctgagcttaagcgatcctcccaccttgtcttcccaaagcattgggattacaggtgtgagctctcatgcttggccagcagcaagtgatctttctcaaactctgatttgctgctttactcctctgctgtggatgcttgactatcccacccttccttaacaaatcatttaggaccttttatactttggcccctactaacttctcagcctcatctcctgcttcacccaatttataatctgtgcttggttgcactaaaccatcttcagtttccaagacatggcatactaccatgcttttgaaagttcttaccactctgtacagaatgtacttcttcacctagccctctaatttctagtcgttcttcatcagttttgagatgaatgctgattgagtacccaaggggccacttttcacaatgtgatagctttaagaattgatcatagctgagtgcggtggctcctgaggatcacttgagcccaggagtttgagatcagcctgggcagcatggcaaaaccccatctctactaaaaatataaaatattagccagacatggtggcacatgagcctgtagtcccagatacttgggaggctgaggtgggagcatcatctgagctcaggaagttgaggctacagtgagctgtgattgcaccactacactccagcctgggcaacaggagtgagataccttgtctccaaaaaaaaaatggtcactcattattcttttaagaatatttttgagatttgtaagagtgaattttttagttaattaagtaggaatccatctttgtttttgtatttttcacagtgtttaaatatattagatactaaataaattatttataaattatttttagaaaacgttatttatacagtctattttatagtggcatgtgttaacatgtcactaattttgctaagaagctagaagtggctgggcacagtgactcacgcctataatcccagcactttgggaggctgaggcgggcggatcacgaggtcaggagatcgagaccatcctggagatcaagatcacctgatgggtaaaaccctgtctctactaaaaataaaagaaaagttagccaggcgtggtggtgggcacctatagtcctagctactcaggaggctgaggcaggagaatcacttgaacccaggaggcgaaggttgcagtgagccaagatggtgccactacactccagcctgggtggcagagtgagactctgtctcaaaaaaaaaaaaaaaaaaaaaaaaaaaagctagaagtatttctattgtgttggaaagaggacaggccatggcatatgagttagactattttagaggaaagactttcattacttctaaaaacttaaaacatttagtctaatgttattagtctctgaaatttctggactactaaaaaacacttagtctaatattattagtctctgaaatttctggactattaactgacttaccatgatctattcttttggggaaaaaatgctaagctcagccccatacatttttgagttatttctatttatttaaagcctatgtatgatgatgaagattttctgtaattactttgtgcatttgaatacagaaagtaattttcagaaaaatgctattggtatggtaattggaagctaacaggagaatgttttgtaaaaagcaacgaaaagactaaatttctgaggtagaaaccgaagagaaggcacaaagtatatggacagtggaggacagaaagtttatatacggcctttggaagttcagaagtttatggttaaagtactgctctgccttttaagtggaaagaaaaagttcatttttttgaactcttggcgaatatagtacagcaaaattaccacaagagggcgatggagtgctttctccaagtctaatgaaatttgtgagaataatcaaagtaggccaatattagcaattataataatgagtcacatggttagtgtttaaaacattatgctttttctagaaaatataaatgaattttatatgagcaaaactacaatataaaacattatacattatataacattataaaacaaaattataaaaagaatgttttcctgttgtgaagtcacagttgaattacatcataattcttagctcaattttgaaaatatttactgagttcttatttatcttgctccaggtgctataaacaggcatttattcagttattacgttgtggcaaagttaacttattttgtactattttggaaaatttaaaaataaaaacaaaattcccagccactcaaattcttctgccctacacaatggtataccatagtttaaagacaataacaacaacaaaatcatctcagaatgtactcttagtcttagataaatagtttcaaaagcttcctgatgcaaatgaaaaagtcttttgatttagaaggtgatagcggattcatcatgtgtttatgcgttcctgtttaaattatggatagcagcttaggtaaatttagttcattagatacaaatgtatgtataaaatattactatcttacaaatgtaatgaaatgtttttcacaaattcagtcataaagtcatgaagagcctttctgtgttggaacacatcagttttctaattttagtttaatcatatacaaaatgagaatgaataattcattagaatataagcaatgctttgatagatctggacccgttgttcattgagccagttttctgactggtggtggccccccaaaatagaaatgcctgccctttgcaggtatgaatttcagaaggttagcatttttgtgagccttttccctctctccctccctccttccctccctctctccctccctccctccttctcacctttccctccttccttcccttcctccctcactctgtcgcccaggctggagtacagtggcacaatctcggctcactgcaacctccacctcccaggttcaagtgattctcctgccttagcctcctgagtagctgggactacaggtgcctgccaccacacccagctaatttttgtatttttaatagagacggggtttcaccatgttggccaggatggtctcaatctcctgacctcgtgacccacccaccccggcctcccaaagtgctgggattacaggcataagccaccacgcccggcctccatttctttaactattaaaataaagaccttaaaagcttctcctatagcattcttgtgaaatcaaatgatataactaggctgcagatacttagaggatactcagaggttaactttctatgcctttattccttttcttgatggcattaataacttacattgttactgtccaaaaactggttctcatgtgatgtccctgcttgaaaatgtttggggctgtctgctgctggtcaaaatgcttagcttcttaacagaatttttggtccccttgcaatctcaggccaaccttcttctccagcttcattttataacactgttccctatagtccactcacactgaagttcatgagttcatatcattccttggcacacacttttctgctttgtacaagctgctccttttatttgaaatgcttttccatcccttctactcctgacaaacttctctttaccttttaagaccagcttgttccccctttgtgaagctttcttgagccctcttgttacctgttctttttcaatactcctacaaaatttcaataatgtctttgttatagcattcatcctgttcattttaattgtttacataggtgtcttttacgactgtttttagattcctttgaggacagggaccaagtcatactgatctgttttacagcatctaaacaatgcctggcacagtttataggccctcagtaaatgtccccgagaaagtgagtgggtagagaagtcagttgtcttatttaggacatcatacgatctgaaggatgcagaattcatctgccaggatattgttctgtcctcctgccaaacttgaaattcccacaacagtcattgaaaaggtgggagcactgtctgccaaaggctgctattagaaaataagcatgttgctaaggagaagggagctccactcttcttgaagcatttaactctcttcagaattaagatcgtgaacatgagcagtaccataactagtaatacattatttatttttggaaattaaaaaataataacagttgtaaagccccatgataggaatttttttttctcaaaagtatgagggctaggcactgtggctcacacctgtaatcccaatagtgtgggagttaaggcaggaggattgctggaggtcaggggtttgagaccagcctgggcaacatagcgggacccccatctccacaaattaaaaaaaaaaaagaagttggctgggcatggtggtgcacgcctatggtcccagctgctcgggaggctgagatgggaagatctcttgagcctgggaggcggaggttgcagtgagccaggattgtgccactgcactccaacctgggtgacagagctagacccccatctaaaaaaaatgtgataatttactgcatataaggaaccaagcagtggaatgcagaggaaatattaggaatgtgggatcgcccattttgtcattgtggacaaattagctcggatgcaaaacaccagtatataatatagaaatcatcaaaaaggtgcaaagaagagtcaaatcaaactatgagtcccagttcagaggcatggaggtgtggatcagtggaaagggaagaaaaagacttaaagttctgaggatacaatcttgaggtaaaatatgtatttgtttatagtgaagtcctattttatgcaggaacaatattttaatgtttgtgcctaaaacaaaatagcatgtagtcaacgacccttgaacatttttaggaagaggccgatttggagagggagcaacatatgcaaaaactgagagaatttggcttcgggtaggaaagacaagtagttcagtatgtttaagactgtctagtggcccagagagaaggttggctgcattaatgggggttttgaatgtaagagtgtggacttgatgctgaaaggaagctattaaaacatttataagccggaagtggcaaaatcagacttgcattattaaaagattattatagcattaatgtgtttaaaagatcatcatgacttcattgtagagattaaggttggagacctggagaccatttaagaagttattcaggtaatccaatctggagatagataatgaatattgccctgggcagtggcagtgttttggagagaattccctgggcagggtgactgcagggtatttacactttaacctaactgggctgctggttttaaccattgccctctctgggaacttgactccctatagagtacctatgtatcctctgttaaaacacccgtggaggattgtattcagtttatagcatattagaatgctaccttcatactttctttaattgtgtgtacacacaactcccagttgagccctgtttactctcatgtccctggtgttgacaagaaattagtggatattattaaacgtgtccatggaggcaggcattctactgaggaaaataaaaacatatattgatattagttgatatgatattatggcgatatactcaaggcagtagtattttatcatttaatattagactttttttttttttttgagacagagtctctctgtgttgcccaggctggagtgcagtggcgctatttaggctcactgcaagctccacctcccaggttcacgccattctcctgcctcagccccccaagtagctgggactacaggcgcccgccaccatgcccggctaatgtttttgtatttttagtagagacggggtttcaccgtgttagccaggatggtctcgatctcctgaccttgtgatctgcccgcctcggcctcccaaagtgctgggattacagacgtgagccactgcgcccggccaatattagacattcttaacctctgatagtccgtattgaacagataacagtttctctatgctcttgttgaggcaccattccctttatgtgaattaggtgatatgtatataagctttatcttagtgatttgcttttctctgtgagacagtttggatatgtagtaaagacaaaggctcttaattgacaagaatgtaaaaacaaaagtttatgattcttttttagaatataagttgttttgtgttttgaagaagcatgatacaagtaagctatacatataaaagttgtgaccatttgaaggtcttttggggacagtataaatttcttttgatcaaacgaaacgggaaaaaacacaaacttgcttttcaaaatgaatagttaatttttgcttctgttgtaccccatctgaggagttttcaccatccctatttgaggattgggaactcatgaatacaatgggcggcctaaaaggaacaaacatttaacatttaacagtagaatgatgactatcattgattagtagtaatcattgtttttgtaatactttcagttgtaacagatatttttataagaatgcacaataaggtaatgtcattaaaatttaaaatttaaataggcattatttaatgaggtagcagtgtctgagaaaagtcaaaagaattgtttagagttctgtagtgagttgaacccagctgttttgactctgaatactgtattttcctaagtcaaaagacagtatcagtgaacgtatttaaggaggactgtatctgttagggatgggatagaaaggattcttgccttggataatagggagcttcaagtgactggcaactgctaagatctgtttcaagtaacattttctttgcatctaaactccgtttttgaaatttagatcatttggctaagattctagttaatgtgtttttcttttttttttaatcatacccgcttctggtgtgtgctacatttagcaataaagaaaagcttgtttacttcattgtagactgagctttggagagatctgatatgttgtttcggtgtttttttgttttttttttgtgagaaagactcaaatatatttgtgagatttgattagatcaaagactgaatgatgtgcatctcagttataagtggatataaattctatcttttatttgaagtctaagggagataggggtgagaaaggaaattactgtttctacaaccatcccaaatttcattgtaggctttgcactacagtaataaatcgagataactaaatttgcctagctaagatggatagatttattggttccattttaaaatttttatatgaataagtaaactgctaccagttgcgtatatttcatctcttctaataatgttttattgccatctgctcccctgcattttgacatcattaaactaaacagccctcttgccgtaaagccctgactggagctgtccattgtcaaaactggggtgtgaaacatgtaaatatgcccatctccttacataacaagtagatttttgtttctgattctcaggaaaaaataaaagtaacaaccattaattgcctgttttctttttcttctaattgttccttcattgaaatttatttgcgtgttggaagctttccagtgctgatgcaaggcttcatctgtgaaagctgttctttctccccattttcttctctttctgagattaaaatattaaactttttataaggcagacatctacatttgttcatatatgcttttcataaagaattgttctattaattgatgcatatggtttaaaccaaagtttggcaaatggtgttccttggtcacatctggcccaccactgatttttgtgaatgaagttttgttggaaaacagctacggtacggttgtttacgtattgtttatggctgatttcatgccacaatggcagagttgaatattgcaagagtctgtaaggcccacaaagcctaaaatatttattctctggctctttacagaaaaagttttgttaacactggttttcaaacgcatgaataagaataacaatgcttgataattctgcatggttagttgcagactttattgacagccatcagcacccttggtagcactagtcctgagatactgtgattgcctatttgcttgtctgtagtgtctttaagaagataaactctttctgggcagatatcttatccttaaatgtatcttccacaccagaagaattcttacatctaaaacgttgtatgtactaagtagttgttgaatgagtggatgttttattttttaactatgtaagatcttatgtcagagtgtaataataattgacatgtatgaagcatttcttacagattcaaggaagtataagtaaacacttttactacttcattgaatcctctcaccctttgaggtagttattattgctgttttacagatgaggtaacttaagacccagaatgatgacatttctaacatcacagctagaaagcccagaactaggagcctatgtatcttgaaatttagtttttatgctagatgtgctgcttcttccaccataaaatagctgacctaccatctctgcttttaaaagatgctaaattcaaacataactttgaaaaatgataaagtatcatttattttggagagctaatgactttaattgagagatatcttagagaattagtggtagtaatagaaatttaaggagtatcccaatttttaaattttacaataacttgtattcatcattagagacgttgtagatattgacattgagaaatcttaaaatatctctttttttttttcctgcttcattttttttcccctacatgattagaactctatttatgtggtcaacttaaactgtaggtacctttctccttcatttctgaaattaggctgctttcttatttgtataaatagttgaaaattggtgggaaaatggtaaaagccaaacccatgtagctttcgtgtgactttggaagtaagacatgtcagaactctagacataatatgagtataaaatgattttaatgtatgtccttatggttttctcatccaaatatgagcaaaattgtacaaatttaatattttaaatatattctaagcttacaaagtctgcatgagtttaccattgatcctctttagtattcctgaggtcatgcattatgtctcagttttgttttgtttttttaatatttcaattttattcttttttatttcttttcctttttttaagaaaatgaagcccattggcctcctacaataaaagcatagacttgtcttcccactctaagtagaaaatggaacagtgatattaagatgatttagaagattctgggccaggcacagtggcccatgcctgtaatcccagcactttgggaagccaaggctggcagatcattaggtcaggagattgagaccatcctggctaacatggtgaaacccgatctctattaaaaatacaaaaataagctgggcgtggtggcgtgtgcctgtagtcccagctacctgggaggctgaggcaggaggattgcttgaacctggggggcggaggtcacagtgagccgagatcgcgccactgcactgtgcgagactcagtttcaaaaaaaaaaataaagaaagaaagaaaattctgtgtgtatattgtggtaaataatttgttgacttaattgaatgctggtagaaccagatatgttaagatctcatatctttatcttcagggtacatactgggttgcttttacttgtatctctgaccaaatggaagttttctatataagatcagctaggagaaaaaggcatgaattttggttatgtgtgatataagaaattaaaaagagaaatgaacataatccaagtccccacactcactttaattaagatattgtagatccagtttaatctgcgttcttaaagttgaaaggctggttgctaatggaagaagctagcctcctgaagatgtggaaatatttgatacttagacttgggtgcacctgttccagtgctttatagcaaacataccagcattctccactgcttagagaaatggtaatagtttaatctgtccaatttgcttttaatcactgatttcattttttaaaaattgcacaatcgtctccagaatgtactttcctctgatcccagatcttggcttaactgtctccatttctgttggatatgatttcatgcctggattatgaagagtagactattgtttaggctttcagcataaggagcttgacagacaaaatgcacatattctttgcttctgttggccaccatctgtttgagatggctggggaaggggcagagaagaaagcacttgctgcacacaatagtatgcaagcatgttgccatgactgctacccaatttagtatgtgtaaaattgctaccataccactgagaacatatttcctgagatgttgaattacaatactttatctccccgagagtgccactttgatgtatcccagttatttatacaagcacaacattagcttcagtgtttttaacaagaacacctcttgcagttgagccagttgtttttcacaccataaaatctcacttatgacctctgccttgttggggctgtcaacatttgtcttttgtcagggggagtattagtatccattgattgatatatatatgtatatatttttttaagacagaatctcactctgtcacccaggctggagtccagtggcgtgacctgggctcactgcaacctctgcctcctgggttcaagcgattctcctgcctcggcctaacagtagctaggattacaggcacgcaccaccatgcccggctaatttttgtattttttcatagagacagagttttgccatgttgtacaggctggtctcaaactcctgacctcaagtgatccacccatctcagcctaccaaagtgctgggataataggcgtgagctactgcgcccggcctagtatccattgatattttcaatatcagcctttcttctgacttaatgagaatgaagtattataggatttttaaaataaggaatcaaaatgtattttatagttattcctagatttgtccccataactttctttgctgctttagcttaatccaaatgtagtagttgaagtattcacaccaatatgaagtttgtacaataaaatagatttagtactttaagcctgtttgtccttagcaaaagtattagatctataattatgtttctcattctgttgcccaggctgaggtgcagtgatgtcatcacagcccactgcaaccttgagctcctggactcaagttatcctcctgcctcacatccctgagtagctataggtgcatgccaccatgccaaactttttttttttttttttgtagagatgggggtctcactgtgttgcccaggctggtctcaaactcctagcctcaagtgagcctcctacctcagtttcccaaagtgcagggattgcagatttgagccaccacacctggccacatttctcttctaaagcaatttatgtaaattctcctaaatgtttctcaaaacgtgaagaatacagccttttatccttaagttttatttcaggaaccttgcagccattaattataatggctaaaaactttgggcagtcaggtttatggaaataagtagtatttatctaagaaactcatattttacagaatacatgaagggcttaaaagtgataatctaagctgttaagagacttcaaggaaaataaaataataacgccttcatacatttttcctacatttatcctagcaggctcagtaaggaaattaaaatagcagaaataaatcacctcaactatcactatcccctcctccaaactggtccagaagtgagtactagcaggtttagatcacatttaaggagctctgacttcatattttaatgaatcaagacattaactggcaaagaactcagcacacagtaggtccataataattattgatgaattaatgcataaggacatagtttttggagtgaaatagacatggttttggatcccggattctctgctcccctccactggcttccgtgacatactcttctggtttttctcctgcctctctgtcagtccctaaggtatttgtgttatttgctttccgcctaaggagctcttctgttttcatgctgtactttccctgaaacagtctcattgactcccacagactcaaatgtcgtcaatatgttggtgactcttgaatcaattcttctagcttagatacttctcctgagtttttatattcaataaatgatctgtacaggcgcctccaactttaacatgcatgtgctgtcctccactgtgaacacacgcatagcgtagcgcctgccgcattacaggctcttagcataaacttgtgagtgaaactcagcattttcccacctttctggcagttatcccactataatataattgactgtttactggcttataaccttctttaaactcagtaagggcagaaatcatgtttgtcttgtccatattggtagagccagtgcattgtttggtacatagcagttgttcaaaaaacatttgcctcatttcgtgattctacatgttttggggcaagttacttatcctttcagaagtttatattcttgatctgttaaatagttgacagtaccttgaaatgttgttgtaaagatgaaacaattcagttattcactcttcaaaactttttactatagaaaaatgttcaaatatatgtatctgcactccagcctgggcaacagagtagagaccttgtctctaaaaacaaaaaaattaaattagaaacaaagaaaaaaattactgtgttgggagatgtgtggtagggaaaataatgcccctttacagatgtccatgaacacagaacttgtgactatgttatgttatatggcaaaaaggaattaagtttgcagattggagttaagattgcttgtcaattgaccttaaaaatggggagattatcctggtttgacccaatgtaatcacaagggtcttcaaaagtggaagagcagggaggcggaagagaggatcagagtgatactatgtgaaaacaattcaacccatgcttgctggctttgaagaggtggaaggggctttgaaccagagaactgggcagcctcagtttccctagagtcttcagaaagaaaaatagccctaccaacaccttgattttgacccagtaatatctgtgtaggttaactgttaggtttaggtaataaacttgtgttgtttttaagccagtaagttattagtaatttgttacagtggcaatagaaaactagtgatcagataatcagaaaaaaattgaaaattgggtatttcatgatattaaggaatatttttaagtgtgataatggcattatgattatgtttttaaaaagagtactcttttagagattatattacaatatagattaaatggcgtatcttgaatttgtttcaaaatagttcagagatggccggggagcgaggagtggaatattaatgaaacatgatcaattatgaagcaatgattaacaaagcttgatttttccatttattaagttgtactagtttttcaaataatgaattggttccttagcatcttctatacctaagcaacgtggatatttttttaaattctagaatcattgtaaactcatagacttagatacatttgaagtatttcaatccattgtagttattatttttatttttctaaatgctgaaactgtcccatctacttcttcaagttattttgatgcaactctaggagtctttaacattttccttgctttctaatttgacaagacattccaaactctccttactcattttttgccccaatcctagaatcagcaatttctctaagacgtctggttccctttagtagaaagacaataattctggtgcaggagtcattttttctctgaataaggacttactgagcaatatgccagggactgctgggtgctagggatagagcaatgtacaaaatagatggtgaccctgacctcaaggtaggagaagacagataataaacaataaaaagaatataacatgagtgctgtagataaagagaaactgctgaggaatattggaactgctgctttgtggggaatggggtgctgttttgtataggatggtccaggaaagctacattgataatacggcctttgagcagagaccagaaggaagtgagggagcaagccgtgtgaacaactggagaaaagatttccaggcagagggaacagaaagtacaaagggcctgaatcagaagcacgctggccagtacagaggaataatcagggggccagcatgtctgggatataatgggcaaggggtagagtggcaggagatcaggtcagagagatagcaggggtcagatgctctaagacctttggttttagtgctgagttaaacggtcactattggagggttttgagcagaggagtatctgttcaaaaccctccaattatatactgacttcatttttactgacttttttgttggtggcaagagtagaagcaaggagatctacaggcagtcactgctctaatccaaccaagagatgaagatggtggcttggaccaagatgtactatggaggtggtgagacatcattatgtgatgtgttttttgtatcaccatgagcagttcatcttccaacaccaaacttgctctcctgctgattatgtttagcaatacagaagcactacttctaataagagtaagctgccttagaagacactagcaacatctgttactgtttaagtttgttctttgggatatcatcccccattcccagctgacttaagtttccaagtaaagtttgacaggatgtagtatttttttcgcatagtgtatgtcggtagtaagaatattttattggtagttgaaattttatttgaaccacagaatcaactgattaacttcatgcctattcaagtacagtctggccaggtgtttaatctatgcattgtaatcctcactactgtcttttaagtgtgttggtttagaattaacagctattatgaacaggaacagagaccaaaaatatcaaataacccccactttattcttaatccggtgagaaaacatctgttttcaaaaaattcacacgtactaccgggaacttgattgattttaattaatattttcttactggaaactctagcaactctgtatattgtggattaggtatattttactggactaacttaacaaatttatacattgtatgctgagaaagttttctggtatgttgctaggttttccagtaaatttatgtttacttatttaatggtaattattgtaatcttaggtttgactatcagtgttgaaaatccaaagaaaagattaaatatgaatgttattctgaacctttagaagactcataaatagcaattttaaagttaacgaaagagattctcaccaacactattggtttggagagaagctaatggatttgaatttctagttttctggtggtgaaatgtatttggtacaaaagaaaaaaaaagtaattttcaaacaagctcccagggagtagagattagccataaaagaagccaatatttaatgaaagttgctcaagccttgagtcaagaaccaatttcctcctgatgttctcattgtgacagtttcctgacttgctcattattcagttcgaaaaagtcacactttttgtgacttacattcctagattgtgaaatggggctgattcaacgctcctgtttaatgttatcattagaacttaaaagaaaaaaaaaactgtgatgacaagtagattgtcatccttaagctatctctaaagaggtgtatttttctttctacatagaagtaaatggtttttgcaatgggttcaatgcatttggagcattttagaggtcaatgtgctacccatggaagactggttttctttgtatggtagtgtagttctccacaaaattataatggaagcagggctcatttatggtgcttcccctgtcccaagacctcaccctgttacacgtccctcttccccgtaagccaagtgagcagagactaggaggctagcacttgactgctcaaaggttgcccattcctgtgctagagcggtggtgagaaattcagtctgaagaaatgaaacatcactttgttcatacgggaaatagctgtgccgtggaaatgttcaggacttggtaattaatagagcttgtgtagctttgtgtgcaggccaatgtgctagcaacacagcaacaaatggaggtgtgagaatttatttcatatccaaagtggttaaaatggggcagtaacggaaagcaaggcttttcttcccaagaaaggaatagcggtagaacttagagcctttttatgtgtgtttgagatacagtcacatgtttcatgtttaagaatggcttctcatgctaaataagttagttccccgtataccttctccttgaggcatgggccagatggattatgtcccattttacaatgactgatggagaattaccacactcttttattgctaaaagtatctcagtgactcagtactttagagcttatgcatagataatgtgataaaataaaggcatatggtagatgaaagggtttggctttctttgaggtctgattttcagattttccaattggttactttcccattatttgaaatcctgaacctaatccacatttttaaagtatctatctctacagtcttctttaaaaaggcaaaaaaaaaaaaaaattgggaatcttccttttttcatgtaactgattaaataatattttttcatcatttatttgtaaggtaattttttggctgtggatagaaagaagtatatagagttcgtactttttttttttttttttgagatggagtcttgctctgtcgcccaggctggagtgcagtggtgcgatcttggctcactgcaagctccacctcccggcttcacgccattctcctgccgcagcctcccaagtagctgggactacaggcccaccacgcgcagctaattttttttgtatttttagtagagacggggtttcaccgtgttagccaggatggtctcgatctcctgatctcatgatccgcccgcctcggcctcccaaagtgctgggattacaggcgtgagccaccgcgccgggccactcatttttaaataattaataattaacttagggaggaaaagatattgacaggatattgataaatagctaataaattatacaggtgaggagtgttacttctagctggggtggtcagagaagacttgggagaagaaaatgaaacttctatgggctttacagaatgggaaaactatgagtagcagtaggaaaagggacatttccttggctgagggtcacagaggcagtgtctggtgtggcatgttcaagggatagtgaataaactatagcatagtttaagagcagactctggagccagacagctcaagttcaagacttttacttgctatgtgactttgggcagatttttaaacctctctttgcctcagattcctcataaattaaaaaagtggtactaataacaaaatcaaagggctgttgtaaggatttaagaatagtgccttcaagatcaggcgtggtggctgatgcctgtggtcccagcactttgggaggctgaggcagacagatcacaaagtcaggagttcgagaccagcctggccaacatggtgaaacctcatctctactaaaaatacaaaaattagcccagcgtggtggcagccacctgtaatcccaactacttgggaggctgaggcaggagaatcatttgaaccctggaggtggaggttgcagtgagcagagatcgtgccgttgcactccagcctgggcgacagggcgagactccgtctcaaaaaaaaaggaatggtgctttcaaatagtattaaataattgcacaagttgagtattaagtaactctaatttagtctgaagatgatggcagtgatatgtggggaaacagaaaggataaggttttacagaagattggagtgggcttattgagggacttgactttcaggactacatatagtttgtaatgagttacagaggctttattttagaagcaggaacatatgatcagagtagtgtttttggaaaaataatctagcagaataggtagaaagggagactggcagcagagagtggttaggagacttgcaatagtccagatttgaggaattcaagaccagaattcaaaagatagagggtgggtttggattagaacggaaggacagacctgagaaagaaacattttctatgaaacagttgttagggtctggggactaacccttggggacacaggaggccgagttctgtgcctgcgtgagtgggagaattctagcatctaggcgttcttggcaagagctggtaatatgtgcaagaagaagaaatacattttacatttcttgaatttaaagataataacaggtgttagagttgaaaacgtcctggagaaaacatatttggtgctccagaagaaatcaggcctggataaagaaattaaagatgcacagaggtaagagttgggctgtgtgagcaaattaggtaacaagaaagtagtgtaccaagtgaatattacagcacttttctttcccatttctgtaagagaaaagtgtgggtctaagagaatggaaacatgttcctagtccagttgactcacttgaaacatgggcaataatagagctccctggcctgaaagtggcgtttcacagatcgagtgccaggcagtgcactgtagaagatgtgtgaagtgtctataaatgctgggtttctggatctgtaattgcacattattgcaaacaggctttattctagtgagggagaattatcatatcaattatcctaattaatctttcccaattccaactacactttaatatactgtcaatgtgtttttacatatatatgtatatttatgtaaatacatttatctgtatacactctgttaatttgtattatttgtatgcttttcttaaaagttgttccttttggactattttcacatgcaccttttctcttccattagattttaattgcctgtggctaaggagcagaccatctgttggtttcaatcctcactgttttctcattcattcacttttgtattgattccagtttatttattcattcatttattctctccagacactgttaagttgctagggtgctgaataagacataatttctgccctcagggagtatactatctagttaagggaaggaaaggcacagaaatatatagcagaaacagtaacacattaacagaaaattatgagaacacagaagagaaacatttaatccagattatatggagagcgttggggagaaatgtaattcagggagagtttttggagtagtcgacttctgggctgagacttaaacaataaagtagtggttactaggtaaataggaagaagggtagaaaatggcattaccgatggtgaaaacagcctgagcatacatagacccattcacaagaaaaagtgaggcagtttagtgttcttggagcataaagtgaaaggcaaagagcagtgtaagatgaggttgtggggcaagcagagaccactggggggatttgtatgcagcacgtggaagcagggactacattcaggggtcaaatagggagatccttaaatgctgttgggtcagatttcagtcttaggtggctgttgagaggatgaatgtaagaaggacatttctggtagctggtcgaggttggtgacgttgaggatctaaattaagacagtattataggaatggggaagaggaggcaaagtcaagaacaatgtgaactatcaaaccagcaggacctattactataaatgagagggaggaaggaccaaggatgcttcttatgtagctgccttctattcctgggtgactggttgcacagtctccttagagaatccaggaacagagagaatatagtgagttaatttttggttttgttatcttcaatacattgggatttttaatacatctatgactatatttggaattaaatctaattaatggttagcagagatgtctagagaattagaaataactcaccttcaatatttaccttaaccatgtcttctcgtagaagcagaggtatgtatcacctgaggtcaggagttcaagaccagcggaccaacatggagaaaccccgtctctactaaaaatacaaaattagccaggcatggtggtgcatgcctgtaatcccagctacttgggaggtcgaggcacgagaatcgcttaaacccaggaggcggaggatgcagtgagccgagatcatgccattgcactccagcctgggcaacaagagcgaaactctgtcttaaaaaaaaaaaaaaattctatgcatacgtctgtcataattcttttactttgttggaatctttggttttctttcccatttacctacatagtcacagcctagtgtttgattcataacctcactgtaaatgtgagtgagtgaataacaagtgaatagattactgttaaaataataatttttattatttgattgttaggaaaggtttatatgtggcttattctcattctgattcttctgttttaactcctagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcaggttggttgttttttgaaattttcttgaaagtacttaatatcaatgttgggttttttttttttttttgcatttggaagtatgtgtaatgtaattagtgaaaatattcttgccataatcctatagagtactaattattgagtaaatacgaatatctatctatgagaatctattttaatgaaaggtaatacggaggtctgtgaaaataaaagtactaattgcgttcgttatcagttatcaattcctattagaactaaggaaaaagtgattaatgtggcctttcagagaataataaaattttaagactcaaagggaccctgaaagtcatttatcctaatttcattattctacaaattatagaagtgaggacattcatttagatgaaaaataactagtgacattaaagaactttgagccttagagaaaaagatgattggatttttgagtacacaagcactgaaaggtaccttcagacctattcataaatgttttgaatgttagattacgtaatgacctgcttctttaaaatacgttttatcccaatctattttattgtctcttaaattacaagaagaaaaagtctcagatcttaagaatgcactgtactgcagcttattgaatctctgagtatttctgaataaggggcttttagaatgttaggtggtgtaggcaccagtgctgattgcaggcatcccacccaaaggaccttgttgcacttcgtgagttgccttgttggcaataacaaatggtcctttgaagtgacttctcaagctctcttctttttaaatttatcctactttgaaataattgaaacagtggcttctctaaagttgaataaggttaaaacttaattgcattttcatctcttctattacataattatagcataatgtttctaggtaatatttaaaatggagtcaggaaacctcaatacttcatttagagtcaaatataaacacccctctctttagcctactattaattgaataatatatgtgtcaagaacatagcacacagtatgccattcaaaactgaatagtttttttgtttgtttgttttaaaggtagtcaatgttcattgtgacgtttaaaaaacatagaaacacagaaaacaaaaaacaaagttcacacataatcccacctcccaaggtaacctctattatctgttttctttcagacttttaaaacattcacacataaggacagatattattttacaaaaatggaatcctaatacagtattttgtaagctgctatttttcctttaaattgtatttttcagagtgagcacctgcttagtaagaattagccagcagcagtggtagtagtaatagtggttatggggagaaagggaaaatcagtaaaggtttccaaagtctagagcagtattcaacacacagaaggcattcagtaaatgtttaactgcatagatcatgcatgactctagacccattcatcatttaggccataatgtcaatttggttagtcattttcctgaaagtgctagtatggggtctctgtcttatagaaatatttaaactaatgtaagatctggtatgttgctgctttatcctaataaagaaaacaatgttttagtactacctgcatttagctgttatatttttggtttaatatcgataaaatagaaacaaactctgacttgtaacattgcttctgtaagttacagtactttggttgcctagactgatgcttagggatactatattctggataaaaacacctttgtggagacaggagtcactgctgttatttgtatgctattgtaagcaagtaattactgggtgagttaacaaaatgtcataccacatcagttgctgattcatgttgtgtagttatcaaattccatgatatcctgtaatcaccacttccggcacttctaaaaaacttacttaatatggagaaaatgtgaagatcaaagtagaaattacatttcaccacccctacctgccttggttttaaatttaatgccaggccagtatgcaattttaatgcacagtcatcctgccgtgtaaaataaatatgtattatgctaacatgagtagccatcacttattgctccctcatctgttaaattttatattgttctggattatccagtacttgttatcagttaagcattaaagcttcatttactaaggaagttaataggaatggggattagttcatgtcaagatcatgtaacagtaattaacatagcacatttgcctggtgctcaaatgcttaagcagcttgaatcgattgtggtcagttcagaggcctagtcaaagcataattctagttcttggcctcagtgtcactattacttaaccaaagcaagaagactttagatcaagtgacattctcttggacacctgttttaaaaacgagctgtagtttcaggcttgataccttcaatgcagactattataccctagcaagcttggagaagtttaaatttataatttatattgtgagttttctgtcatataatttatattgtttgtaccaatttatattgttttgttttatatttacttttcaatatttcgaatttgccaaaaaccattttttatgtaaaggcaaactaaagcacattttatgttttattttattttatttattttttttttttcagcagagttgattgttttagaaaacctcaggaatctgaatgttagaactgaactggttatctctttatagagcacattcagtttaaaattccgtaatcttatttggatctaaagtttaaaaattttttggtttatttgaattgtgaaaagtttatggatgttttgcctaaattgtattatggagacattactttgactagctacgaatgaataggaagttacattttaggaacttctgttgaagctttgattaagtttgctatgggacattttcagtcaaattatgttagaagcaccatttatttgactcatacttatgaatagattaactgttggagtgctaggataatagagaatcatagaaaatcaggcagttgtagccaaaatcatatttcagtttccgtggtagaatggggttttgaacattctagtttatttcttaagtgttacatctagtggcattaaaatctattgaccatttgtattacatggagttaacggaactatttatgtttagcttgacctctctgtgaaagaaataaggggcttatagtgcttgaatttcttcttaaatatggaatgcttaaatagccacattactattgttttgcctttgcctacagtacagcaccagaaaaactatatacagccaatccattgtttgttccagtgagagaaaaaattttaacattattgatttgttttttgctcagtgattttcaaacctctctcataaggagcaccatctcagtttaccaaggaaaaacatgcataatttgttgcctgttttaccatttatttcagtctctgagcacccctttatttataggttttatttatcatccccactaattaagattttacttgaaaataaaaggcctcctggaaatgtattattagcccttgtatttaaggaaacaactaaagacattgaccaagactcataaacaagacagagaccaagatttcactatttactgttgtgaaagattagaaagaacataaatgtgcagcatctatataatgtaattttcagataatagttaaagttaaatgtgtttttagcatattccaaatattgcaccaagaattttgcctgaattttcataacaaccctgtgagacagttgctatgattattccacttcaaggttgagaaaattgaggcatagagaagttacgtatttgtttgaagttgcatatgtagtagataatggaacctgaatttgagtccagatttgtctaactttaatttttattcatgcttttaactaccactacataggaaaatgtttatagtatcatatgaatatggcaaaaatgaaataaggaactcaaaagtatgattccaattttatgtaaagaaactatacaccaagatatatatttaagcctgataacaataaaaatagctactatatattgaacttgattggtatcatgccaagaacttttttttttttttgagatggaatctccctctgttgcccaggctggagtgcagtggtgcgatctcggctcactgcaacctcggctcactgcaacctccacctcccaggttcaagcaattctcctgcctcagcctcccaagtagccaggactacaggcacctgccaccacgcccagctaattttttgtatttttagtacagatgggatttcaccatgttaaccaggatggtcttgatctcctgacctcatgatccacctgcctcggcctcccaaaatgctgggattaacaggcgtaagccaccacacccagcccatgccaagaactttattagtattattctactggattcccaaaataactccagaggattgatattattcttttttttttaattttttatttccataggtttttggggaacaggtagtatttgcttacatgagtaagttctttagagttgatttgtgagattttggtgcacccatcaccagagcagtatactctgaacctaatttgtagtcttttatccctcacccacttcccatcctttccccttgagtcctgaaagtccattgtgtcatttttatgcctttgcatcctcatagcttagctcctacttatgagtgagaacatacgatgtttggttttccattcctgagttacttcacttagaatagtagtttctagttccatccaggttgctgtgaatgccattaatttattctttctatggctgagtagtattccattgtgtatatataccacagtttctttatccattgattgatgggcatttgggctagttccatatttttgcagttgtgaattgtgctgctataaacatgcatgtgcaagtatcttttccatacactgacttcttttcctgttagtagatatattcttatgcctgttttacagatggaaatacagaggcttagattaatttgcccaaagtcacaaaggtggttaaatagtagagccagggctggaacccatctgcttgattctgaaatacattcattcattcattaaatatttattgagggtcctataatgaaccaggcactgttttatcccactgtttttaggaatataatagtaagcaatacatatagccagtgtgctttagaaaaaagaccaaaagagaactataccccaaaattaagagttataatgtccagataatagattggatgtgatgtttattttcttctctctccgacttcagtctttctaatttattgcacaagagtttgtgtgtttgtgatgaatgaatatacacacaatgatatctattactgtattacatcagaaaaacaccctcagtaaacctgccataactgaagactatggcagtgtacttttattcgtagtgtttgaatgagaaagaagataatagataataaacaagttgaacagttaaatattctcatctcccctctaaaattattttgtacagcatatatgtattcttaaactcatgtagattacttggggctcacttttctagtttctcatctaatgcaggagtataagcaacattcgttgagtattttgtgtgccgctgtccttagatatcactggcacagaaatcaaagacatgctcttttttcttaagaaggttactgttgtgaaccgaattgtgtcttcccaaaattcatttgctgaaatcccaaattccagtacctcagaatgggactatatttgaagagggcatttggtctttaaagaggtaaaatgaggtcagtagggtgggccttaattaaatttaactggtgtcattataagaggaaattgagacactgacacatattgagggaagaccatgtgaagacacatggagaagatggccatctatacactaaggggagaagccctcttgacatcttggtcttgaactttagcttccagaactgtgagaaaataaattcttgttgttgaagccacccagtctgtggtactttgctaaggcagtcctggcaaactaattcagtttatagtctaataaaaaatacagacaagcaaatcaacaaccaaattaatatggtaagtcgaacagagatgcatctaggattacatcagtgcaaaaaggagaggtaaggattatccaactttaacaaaccaatttattttatttgaaaagaatggaaagcagtaaggttcagaagtctattcataatcaaatgaatattttgtacaacaaatgtccattgaaaacttctatgcaagttaccatactggcaccatggtatatatttctagtctaccccgtgctcacacccgaatgatgggtgtgactggaaggaatcccacaatcacactaaccagtctccttttaaattcatcactactaatctcaggtatgttccttcttttccctgggtatattcttaatagtaatgaaagactgctgtttctctaatatgtttactttcccactttccccaaaaaacccatttcacatcttctttctcctcaaacttctaaaatctcctttcccatcctcactattagctgatgactttgattcctctttcacttttttatgtaggaaagggaacaaaaaaggcatacaacatagagaaaatagatagcaaaatgccactaataaatcctactttatcagtaggttacattaaacataaatatatcacacactccagctaaaagagagagtggaagggtagataaaattatgatctaactataagttgtctacaagagacacagtttaaaataaaagatacaaatatgttacaagtaaaagtatagaaaaaaatatattatgcaaatagtaaccaaaagagagtgagaatgactgtactaatatcagataaaatcgatgttaagacaaaaaaaattactagagacagagtagtacattttataatgataaaaagctcaatccattaagaaaatgtgagttataaacacatatttacctaacagcatcaaaataagtgaaataaaaactgtcagaatggaagggagtaatatatacaattcaataataatagttggaaacttcaacactccatattaattaatagatataattgattactggtcagaatagcaaaaagaactagaaaacttgaacaacactaaataccaagtatacttcaccagatatctatagaacattccactcagcaacagcagaatccagcagaatatatattcttctgaagtgtatgtggaacattctccgggatagaccatatgttaagtcataaaacgagtttcaataaatttaaaaggactgagatcatacaaagtatgctctctgaccagaatggaatgaaattagaaatcaataacagaagaaaatttgggaaattcacaaatatgtagaaattaaaaaacacattccttaaacaaccagtgggtcagaaaagaaatcacaagggaaactagaaaatactttgagctgaatgaaaatgaaaatgtaatataccaaaacttattgaatgcagctaaagcagtgcttagatggaaattgatagctggcaaatgtctgcattcagaaggaagaatcatctcaaatcagtaacattgccttctaccttaagactctagaaaaagatcaaactaagtccaaaacttagaaggaaggcaagaacaaagattacagcagaaatgaatgaaatcgagaatttaaaaaaaatcaatgaaaccacaagttggttccttggaaagatcaacaaaattgacaaacattggctaaactaccaagaaaaaaaaaaagaagactcaaattactaaaaatgacactaaggtgtctcacaggtttttgttttttgttttgagactgagtctcactctgttgcccaggctggaatgcagtggcaggatctcagctcactgcagcctccacctcccaggttcaagggattctcctgccttggcctcctgaatagctgaggccacaggcctgcaccaccatgctcggctaatttttgtatttttagtagagacagtctggcctcgaactcctggcctcaagtgatccgcccgtctcggcctcccaaaatgctgggattataggcgtgagccaccgcacccggccagtgtcccacagtttctgtgtcatgagtctatgggttagctgagtaccctgctcagaatcgcaccaggctgaaatcatggtgtcagctgagctgaagttatcatgtagagatccagatcttcttccaagcccacgcaggttgttgggcaaattcagttccttgcagctctgggactgacgtccttataggccgtccccaccttagacagttcacaacatgattgctttcttcctcagggccagcagtagagcctctcctgttgctttttaacttcttttaagggtttacctgattaggtcaggcccatccaggatgatctgtcttttgattaacagtatccactgattaggggatgtaattgtttttttttgattttggttttggtttttttttgagacagagtctcactctgttgctgacgctggagtgcagtggcgcaatcttggttcactgcaacctccgcctcctgggttcaagcgattcccctgcctcagcctcccgaatagctaagaccacgggcacgtgccaccatgcccagctaatttttgtatttttagtaaagacgaggttttatcatgttggccaggctggtctcgaactcctggcctcaagtgatccgcccgtctcagcctcccaaagtgctgggattacaggcgtgagccaccatgcctggcctaggggatgtaattgtatctgcacaatcctttttgctatttacagttatctaatcacaggagtgataccctgtcatggccacaggttctacccacactcatggagagggtctttactcaaatatcagagtgttcctggtcacctatttaaattctcccatttcatccctacttcctacctataccatcttcctctctgccctccctgcttaatttttcttgtcagcctttaatatctaacatgccatatattttatttatcttactgtcatctccctgccctatgttagcatataagttccatgcaatcagggctttttttggctttgttccctgccagatttcctgtttctagaacagtgcctagcacatattgcatttagtaaagtcttgctcaattgatagatgaacttttaaatatttgtagaatgtatattagtgttgccaaattgaaattatatctcacttgtcttattattgaattacatttatcctgctttgcagattttataataatctcaaaaagaattgactgtagttgtctccagtagacttttaaaaaattgtcaattaaggttaccttctttagaacttgttctctttatttactattatgtttaaactcattttacctgtgcatttattttggagaagcaagtcatttatgcctttcagatataaaactataggtggcctcacaaccctttaaatgtagtatgttaaaggactgaaagttaaagttgacattcagcgaaagaattactttttaatgttccaaattggaaagtttgcatataatccactggaaatgaagaattaagagtgacaaatacagtgtttccaaattttaggaaggattgttaatgtctgcagttttgagtattctaagacgatagtcactgtgtttctcttttactctcttcctgcttgtgtctttgtgtgtaatcgtttgtgaatgtatttatgtgcagtttctcctgattatcttgttcctatttcactctattcctgtggctgtgttgttcttttgccctttgctcacgccaggcccttcctcaatgttggcaaatacaaaaacataaaagtggtttgtacatttgtattagtatatttaactaagtagaatatcagattctgtttttattcttgagcacgtcagtttttttatagctttgggaaacttgttttttacttctattgatacagtaattttcagtcgaataaaatctgttgtggttgggctttgaaaaattccagtattacagttagttcgtcatccatatgatcttaggaaagttggctgatttctctgacgttttcttcatctacacgtatatgaaaaagttaatttctgtcattgggattattgtgagaattaaataacaaagagcagcaaaaaataagcatcagattttgaggctaaatcccagttaggttgtgcctgttgaaatctgagttcctttcacctttgtatttgtaagctttcctttttctctgaactcttccttggcatccttccctacctttcctttcttccccccacatgccccgcctttttggataggtctcacagaagataaacagggtgaaaagtttcatgccgtagctcttctctcacagccaaccaaatgctttaaatccctcctctccctccatttgtcagtcaacatgtacttagtaagggctcacaggacatcgaatactagaagagatagctgaatacttaattccactctgcagttatctaggcctgtcattcctgttcacaaatggaaacccaatcctacctggaacaagaagaacttctttagtgttaatcctgtgttaatgaatttgttaaattagtctttgctgacacagagaagaaaacactttgctatatgtgaaagattaattttattgtttaatctgtgcataatttcaagggcattgatggagaaagatgctctttcaggacagccaagaagtatcaagttaggccagtagttgccctgagcatgcttgtttaagaaaggagatctgagaggagcaagggtcattttcagcttgttttttaaaggtgcagtgggaatttctttactgtctaaaattccttttgctatttgaaaggaactaatgaaatattttaaagtcatccttttaatggactgtagttttaatttatgtatttatagtgaactatattccagcaagtttgtaaaaagacttttacaggtatgtgaaatataagataatcttataaattacaaaaggggaaaaagaatgaaattcatcgataggctcgttaaaaatgaagctaacgtcgagactggacgatactaaaataatgacctgcccacttgcctctggttagactgtaaatctggctttaggccttctagtagtctaccaaaaatgaaaggtagttttgcaatttacaataagataaaaataagactactgctgaggaaaagcataatagttcttgctgcagaaatcagggaggaatttttctgaatgagaccatgtgaaagtgacgctggatgagatctaacaacactccagcaacaacttgcaggaagagcaagggtgaatttcatagagctgtgtcctgtaacaactaccagtacaggttcatgtatcacaacaagcaccgttcataaaaggaataatcctgcggggtgcagcaggcccaatatgctgtgattcacagaacccagttttctgatgatctgacttgaactcaatacatattttagaaaatctggcaaatggaatgtattttccttggtcagttattcttaaatgtctttttttcttctcagatgaactttgtcaaatatttgatagcattgatagacatgttccaggagcagagcttttcattttgttccaggtacataccaacacttatgctttaacagaatgcagtttgaagttggattgacttctttgaaaactgagaagccaaataagaatactagcctcaagagtcctccagccttatggatgagctaaagatgtgccctagtaaaaaactcaccctagtaaatggctttgaatctgttttaatgtgcagccagagagtagcatgaaaccccaaagctctaccatgctctgtgttatggtcacagtaaattgagcctggaagatttttcatgcgtgtataaccagttgcccacctggcggaaaaacacagggcactcatcaaactttgtctggctttgagcagtgtgattcctggtttatctttgctgataaactacttgccaaacatacactgagaaaattagatgaaggaactcgttgaataggattgttattttataagtcagttgaaaatgatggaccacttaccaaaagtaatatattcgattacagaataggtgatctgtagcctttcttttctggcaggaattagtaaacaaaggcattccttattagtcataacaaaattatggtaccctaaagttttaaaaataataataataaactgcctatctcaaacttaagagaatgatatgtactagcttatacaaaatggcatcatgttattaataagaaacaagttaacaaaaagtagggctagaaaataccctcttacaccccacgtaaaaatttttaatcactcatcaagagcctttctccttttgtgactcttgcagaattaggtgctgattctgagtaaacatcaatatggtgacaaagaatttacagtgggagatagttattgaatagcaaggtttatgttattgtcagaattttaaaaatgctgtgactttgcgatactcattgctatgacttctcctgttaataatctgcctggaagtctggtgtctgatgcttaccaacaattaccatgtggtcgcttagggatgataagtgatgttaatgaggtcaaaggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggaggtaaagctgctctatgaatataaattagtgtgatatagctactgaaaagtatgttgcagaggctagaatggttagtctctgcaggcttcatgactagataaggcttcataatggattcctgccaagcaaaccaagcccatcttatcagttcatgaccataaagtatttaatggggaaaaaaatctcttacaaacatttgttaccttgatacaaatgtgtgttaaaaatcggtcatgttggggaggggggagagggaagttggtgcacagtgggtataaaatttcagttatacaagatgaataagttctagagatctgctgtacaacattgtgcccataattaacaatactacattgtactcttaaaaatctgttaagagagtggatctcattttaagggttcttaccacaataaaattaaatttttgaaataaatcagtcatatttgagtgaaatgaaacctttctgagtagtttcagacaattgataatacctagtttacagttcctgtagtcattttggagggtgaggacttgatgtgtttagtaaagttgagaaataaatacatgaaagaatgtgtggggaagagaaattgtggggaagagaaattgtctcaggtaatagttattactatttttagcactatgacttaccaaattgaagtttttgtttgtttcttttgtagaagtgtcaaagtctcatctctgcctaaaccatatatttttttctggttgcctcatgttctgtcacagtcacagttaacatcctcattctcaatcctacccatgatgcagacagattgcctcatttcagctcaataaaacatcaccaaattcccttaggcagaaaaagggtggggagtgccctttcttgaaggaatcccttaagtgcacgtctcccgttttcttttcacatcaatgcagagtccctctgtgaatttacaacacccaacacccatgagttcagtccttaagaaggaaaattgagcaagtatttaattggttggacattgcataaaagaggtccatatccaggctaactctagaaattttattctcaaacttagttggcctctttttcttctgtcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagtaagtattggaaacgtttttattctgaatgagttttaaagtagaataattttttgatatgaaagtcttctatcactttaactttttattttcttcttgctttatgccctctctgctttcggcactatttattattgtaaagcaaaactaaatagacctctgtggaaatatatcggactcatggggttaggttgtctttggttttgtctcactgagtgctggcttgtctggtgaaagtctagccactgtggggaaaaaataatttactgtgggtgtgcttcctcaacaggagcctgtttgctcaggaatgaagaggtcgcataggaccacacacatctgagttcttagaactgacaccttcactgttttaaattaaattccatagcttttataagagcagtatttccctacttgtcagagttcaagcacaggacactgatttcatgaaatatataaaacatgaggtttataaatgatatatttttcttgaatacatacagtgtttaaaaatataacctcagttttatgagagtgcacatgtgatggaaaaataattttttttccttttttgcaaaaaaaggagtaatttaggaatcagatacagtacataataaataatgaatacatgaatttcttgctctggaatacctagtttccaatgataaagtaagggtcaggcatactttatggtgactaggagctggaatctgatttcagaagaagccagagtacctggcttcacacaaaaattggacatggccctgctgaactctaatatactctcaatgtgaaaatatgataatgaaactctaattattgttaattgagagaataggtagtatgaattattgagtagtcttaagatatctcttaggatatccttaaatatgtctgaaacgttgaagacacttaaaattatatatatgtcacctgaaatatttctagattattgatttgtgtaatatgttgggaacaaagaagtggaatggttcagactgtaccttcccaaatgataacaaataattaatagaatattcattaatactgttttagtgtatcaaggtattctataaatgttagaataacaaaacaaagtgaagttagagtcttagacccaaataaagttctgggaaatggaaatctcatactcattgccttggagatgggccagaacttcaatagcttgtctagattgtattttagttatttgattacctgttaaagatttctctcaaggatggaaagggaagaatattctggaagccttgggagatagtttgattcaatatacatcttctacaaatgttcatggtgaattttttggatctaaatgtctgtttcttcccattgtccttcagtagtgaactgtgacaatttctatggctaataagtctatattatttcattttattttgatattttttataaaagaaaatagttcactcaagcacaattagaaaacacaaaaaatttaaagaataaatttaaatgacctaaatatttaccaatcacagataattactgttaaccttatgatgtgtttttttctagtttgctctttataagtaatgtgtttacaaaattgtaatcatgctttatgtatatgattttttgtgataaatattatagaaagagtattcactactcatccaaaattattttaatggctccatctttctctcaatccaaagaaatgatttcttgtaaaaccaacacccaaaacctcttttactaactaatatctggcccaaatctttataacttggtatgtttaaccattgggccattgctgactagaatatggtccaaattttacacattcgagtctgtgcttagtgccatcttagctgatttccaaaagcctaaacacgtgttaaactgattggattacattatatttttattatattttattacattatatacatttatatacattatatacatgtaatatatacaactatatataattatgtatattttattatttttatttatttatttatttttttgagacggagtcttgctgtgtcacccaggctggagtgcagtggcgcgatatcggctcattgcaagttccacctcacgagtttatgccattctcctgcctcagcctcccaagtagctgggactacaggcacccaccaccacgcccagctaattttttgtattttcagtagagacggggtttcaccgtgttagccaggatggtctcgatctcctgaactcgtgatccgcccgcctcggcctcccaaagtgctgggattacaggtgtgagccactgcgcccggccccattatgttttgttattaaattatatatattatattattgcttctaaaatgcaccaaagtataggtttgttttaatttttaaatgcttcctccttcccccagaacttttgcagataataccataaaaccttggtaagttaatgtttcctgacaccctttgagaagaagcagaaagttttgtagcaagcatttatgaaatgcttactttattcactgtacatataatgtataaataacatagtgatcattctttaagtttattgattggcatttgtaaagaacacacgtctaaatatgcatccgtttagatgatttgtgagtctgttcttaagtatctcttgttactttgagggaaagctcaagacaaaaatgaagtatgtgtgcctactttggattagctctacagggatttactggtacagatattagaataaacatttatgtatttattgtcatcttctttttttacatccaattacctttctgtaacaggaagtcatcagtgcgttgaaacaaacttggcatgtttcctgttttgtgtgtgtagcctgtggaaagcccattcggaacaatgtttttcacttggaggatggtgaaccctactgtgagactggtaagatcagggagccatttgtttcttgaattttgaataaaggtaaaacattaacccttatattactataaagctcaagaaaatattaggcaaagttattttcttaattgttttggaagcatttaatgctgctctaagcatgtagaaaaaactatgtagatttttttttttcttttgagacggagtctcacccttgttgcccagactgcagtgcaatggcccaatctcggctcactgcagcctctgcctcccaggttcaggcgattctcctgcctcagcctcccgaatagctgggaatacaggcatgtgccaccatgctcggctcattttgtatttttagtagagacagggtttcgtcatgttggcccggctggtctcgaactcccgacgtcaggtgatccacctcccaaagtgccgggattacaggcatgagccactgcgcctggccctatatagactttttaatgtgactttgtcaaaacagatattcccaactttattattagaattgagaatgtaagcattacttagtaggaaaaatattttgcttgaattcccaatgatttgtggatataaattctactaaatcatgtaccttaagtccacttcttgtagtccagtagtgaattttgtaaacatcagaaatgttccactttagaatatgatattgatttgccctttaaggcgactgccttgaaaataaactggagatcgtttgttacttttactgaatgagaaggtaatcctgacttggattgttcccttggtaaaatgatttttaataaactagactaaaaggacctatctactgcatttgtcttattacacaaactcagaacgtttccttttccttcccaaagtctgtaagtgaacttttataacatttattaatagtgcccttacttagatattactaccacatatacatgtttcaaaatacaaaacatttttcctttattgtgcctctattcactaccagtgcattctcactactgagttttattgttattctaccttgaaattcaaagctctgtgctgatagaaggaggtattccaaaataatggagttaaaggagcagtcagcttctaagttgaagctgtgtcatcatcattcagcccttctttgcccactcagtattctcttattttcatcttcctttcagctccttagtttaaaccaacctggatatattccagactgtctcccaggaaccccagaaattccagtgaagtaccccatgggctgttttgggacaggttggccacaagctgccttcctcaattcaaccagaatacttcatattttgtaattccacttaatttttctgaagaaagggctgggttttgtttgtttgtttgtttgtttggtttttagtttgatttgtttgttttagcagctttggaagacattttgactaactggcaggtagcccatatctagccaaaacacataaaacagtctagccttaatacctatatttaatgtatttgaagtcatattttaaatactaaataattacttataggaaaggaaaaacattattgaatatttatttaaatgtcacatctaatcaacttggtctgtttttgttctttttcttcttttaacctccaaaccatttcttaacccagtttcctctatctcaataaataaccccatcgtccactatccaaaaacctgcaggccatgttggattctgcttttccccttgttctttccttatccaatctaaataggaaattctggcagctctacctccaacgtatatcatattcatttatttctctccatctccactaaagctaactaaagctaaagtcactgaagctaacttgctttcaccctttttctggacattgtaattggcacctaaatggtatagcccctcaccttccttccaacctccaaacagcaggcatagagcagctgtagtatatatgtgtgtatgtgtgtgtgtgtgtgtgtgtgtgtgtgtgtgtgtgtgtgtgtgtattgtttagacggaatcttgctctgtcgcccaggctggagtgcagtggcgcaatcttggctcactgcaagctctgcctcccgggttcatgccattctcctgcctcagcctcctgagtagctgggactacaggcacccgccaccacgcctggctaatttttttgtatttttagtagagacggggtttcaccatgttagccaggatggtctcgatctcctgacctcgtgatccgtccacctcagcctcccaaagtgctgggattacaagcgtgagccaccacgcctgaccagtaatagtttttgaaatgtgaattagatcaagcttaaaccctttagtgggttccactagaaaaaaattacacttttttttttttttgagatggagtctcactctgtcacccaggctgcagtgcagtggcccgatctcggctcaccgtaacctccacctcccgggttcaggcgattcttctgcctcacctctcaagtggctgggattacaggcacctgtcaccactcccggctaatatttttgtatttttagtggagacggggtttcaccatgttggccagggtagtgtagaactcctgacctcaagtgatccacctgcctcggcctcccaaagtgctgggattacaggtgtgagccaccgcgcccggccaaattacacttttgaaggcctgttttgccatccttatctcctctcaccttaccttctgtcaccagattctacccataagcagccctttggcatttttctgaacatgctgagatccttccttctttggggcttttgtgcttactgtttcttctaacttgaatgttctttgtcagtttttctgcggcgattcctctatattcacgtttcattgcaactattacctcttcagagaggccttttctaattttccttaatagtgtagtgccccccccaattattttgtattaaattactattttctttccttcatggtacttatcataatctgaaatttatttattatcatttattttttaaattcaataaatcatgacatcctctttccaatgagaatatgagccccatgaggaaagcaacctcaactgtcttcttcaccactgtacccctgcagtgccttgaacaatgcctggcacacagtagactgcatgaatctatgctgagcaaatggtgctaaggaatactaaagattgacaattgccaagtaaggttaatcgagttgcaaattatagcctgccttcctctccagctgaggttggattgacaatgtcaaaggccaaagggtgaaccatgagtcaacacagtagtgagaggagctgcataaaagaaaattaggtcaaccagcctgggcaagatggggaaaccctgtctttactaaaaataaaaaaaaataaaaaaaatagccaggttttggtggtgggcacctgtaatcccaactgctcgggagactgaggcaggacaatcacttgaacccgagaggtggaggttccagtgagccgagatcgcgccactacacttcagcctgggcaagagagcgagactctgtctcaaaaagacaaaaaagaaaagaaaattagggccaggcacagtgactcagtgcctttaatcccagctctttgggaggtgaggcaatcacttgaggtcatgagttcaaaaccagcatgggcagcctacgaagaccctgtctctacaaaaaaaatttttttttaattagctggacatggtggcttgtacatgtagtctcagctactcaggagacagaggcaggaggaggcttgagccaaggaggtggaggctgcggtgaactatgatcacaccactacactcaagcctgggtgacagagcaagaccctgtctctctaatgaaagaagaaaaaaaaagaaaattctaatttagtaatagagaaacatctcaaaactgcttttgtcagaaggaaatcctgttagtattcttataactgtaatctatgtcaagtaaatggtcttttctggctaagggttttcaacatgaagtcataaaattgaaaggaaaatacagcaaaataaattgtggctaatatcgttgtgatacagtctagctagaaactcagtcatagcacttattcatgtaagtttcctgtaatgtttcttttttcttccttgaccaagtcagatacgctatgaaatttgccaatatcagattttgtttttgatctctcttcattagtcttattgttgctagttattagaagtcctttgtatttcttcagaacagtcatgtctactgataactggtcacagaacagttcttttttttttttttctttaagacagtctcactcttgtcactaggctggagtgcagtggcgcgatctcagctcactgaaacctccacctcccaggttcaagcaattttcgtgcctcagcctcccgagtagctgggactacaggcatgcgccaccacgcccagctaatttttgtatttttagtagagacggggtttcaccactttggccaggatggtctcaatctcttgacctcgtgatctgcctacctcagcctcccaaagtgctgggattacaggcatgagcaaccgcgcccggccagaacagttctttatatgtatttaggcaattaagtagttggtgagaagtgagaagtattacatggaaaattataatcaagaatgttaggttgtataaataatatttataccaagggaatcctgaaacatgctaaacatctctctcaagccaaatgttatgccatctcctgaaatttttcaaattcctaatatctttgtcttcagcatctcatctaatcctgattttgttgctgccttctaggaacgatcattctaaaacttcatcatgtttaaattatgtctctctgccctcccttaatacagattattatgccctctttggtactatatgccatggatgtgaatttcccatagaagctggtgacatgttcctggaagctctgggctacacctggcatgacacttgctttgtatgctcagtaagtagagtcttatttcctaattaaaggggtatagtatggccaattctagctttagtatttaatggaaatatcagcttctgggtctttcagtccttcaaacctaaggaaaaattatttttaattttttgtaaatttcgaaagttgtttattaaattttttggcatttttgaaattatttggcacacagtgagatccttagtccttagagaaaatacaattttaatatatttttgtctataaggagaagctatgtatttcttaaaacagtaagattcctttacttaaaaaaaaaaaaacctctgttactggagtgtttgttgtagtttttggaaacgttaggtacttcttaaaatacaaataaataattataaaaatcggctattggattaacactgggaataaactatatgttgagtcatttcttttcttagcaatagcccctggatattcttttctttttgagactatggtccaataaacgtgataaagtatttgcctattcatttgatattttaatatttttggttttatgtttaatgattaggatggattcaaatattaaaataaatagtttttaaatgtaggaagtaaatatccagtaaacgtgctctgttcaggtgtttgactttttaaaattagatttaacatatctacagttttcaatactcattgtacaaagggggcaaaagtaatattaatcggtgcttaatgatttccccaaacattaccattgaacttttgcttgtttacctcatccatctcttagacttcataaagtctataaaaagcagaacttttagcagatttgccttttcttttctaataaagctgttcattctaattaacaaaggcaataggaagaacaaggagctgtaaatgtagatagtggactgactgtataatcctcagcagccagatactgacctggttataagaaacaaacaaaagaggtctcagcttgaacacaaggcagcccttaaaaaaaaagggtctcaggtattctgtgcctgtgtaactggcagcaagctaatgttgggcttgggaaggtttggtaaagcaaatgagtctctacaacacaaagcaaaattaggacgttgtttataatttggggagataaaatatatttaacgagccccctttctatattgattttcaagttagggataaatcttccctctggataaagaaaagtgatgatcagtgctttctataaattagaatacattctaggaaaaagcaatttttcattgcttttgaaagattatatctaatgttatagtaatcgtcaaatattagggagtctaacttaaccaactaaagtgttttgtcatattatccattggggggaaaaatcactctctccttctccagcatactgggtaaaatcctcttaatatcctcttaaataatatctcttaaatgctgcttctttttcaggtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactctgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctattcattgtgtatgcttcatcacctatattaggcaaattccatttttttcccttgtgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctctt

SEQ ID NO: 36373 - DNA, 213564 bp, Homo sapiens; identical to SEQ ID NO: 36372

SEQ ID NO: 36374 - DNA, 44755 bp, Homo sapiens
cccgcggctcgggatggagggtgagtgagtaaacaagcctgggccgggcggtggggccgggcctcctcccctcgccgccctgggcctgagggagggagaggcggagggatcaggaaattggaaggaatccgagggacacactgcctgcctggccgggggtagcaggcgcccctcctcattccgagggtgggggaatgggggcgacggggcgagagagacccaggcgaggacagcgtctggggctgcgagggctgtgtgcccgggaggaggagcggcgggggcgggctcggggacggggaatcccgttggatggcggtgtgggccggtgggcgggagccccagcgcccaaagggcgcgggagggcggtggcacctgcgggggcctttagcgaggtggactctggggacctggagctgtgcttggggagggctagagaccggggctgatcttgcgatggctttcggggatgttgaggaggggtagcagtaaaaacaaggccgggactagggtgaggtgagtaaggctcccaaggcacaaagtgtaaaggagcactgactcagggtcgcgcaagtgcagtgagcgcctcctcacgtgcgtcctgggtgcctcggtcgcctcaccccaggcctggccctgagcaagaatctccttcactccagacttttggtctcacgccaatgatcgctcacccccaccattcaaccgaggatcaaatgatataaataaaagtgccttgaagcacagacaaggtgttgtatttgggacatgcctgttaggaaatgtgggacaaacttttatttcaataaaaagtgactactgaggaattgtttcttgagcagggaagggaagggatacctgaaggatgttagtgccccccgtggaatgtgaaggaatatggagggtgaaatacagggttgtatgtgatgtagcccaggccgataggaacctgacgcttggcaggggaggatgaaagcaaaggagctcaggtacactaacaattaggtgggtgcaaggatggcaatgaaaacgcgagtctcctccacgtttgctgccatactgccgctgaataaaaaaattcccacaccccatgttttttaaatttaggaaactgatattgaaggaggtttccagcctgagaaggtgctaaccctattagaggtttctgtgaaagcttgtctattttaagtcttggaatccccagatatgccactgataaaagagattacttacataggagagagtgtgtgttaggagataagtactttagactgggctcggtggctcatatctgaaatcccagcattcgggaggcccaggcaggagaatagcttgagcccaggagtttgggaccagctcaggcaacaatagcgagacctcatctctacaaaaaaaaaatagccagatgtggtggccttctcctatagtcccagctgcttgggaggctgaagcaggagtattgcttgagactgggaggtcaaggttgcaatgagctctgatcctgccactgcactccagtctgggtgacagcacctgagaccctgtctcaagaaaaaaaaaaaaagcctggcacggtggctcatgcctgtaatcccaacactttgggaggctgaggtggaccgttcactcgagcccaggagtttgagaccagcctgggcaacatgggacaactccatctctactaaaaatacaaaaattaatcaggtgtggtggcacacgcctgtagtcccagctactcgggagggctgaggcattagaatcgcttgaaccgggaggtggaggttgcagtgagccgagattgcaccactgcacatcaacctgggcaacagagtgagattctgtcaaaaaaaaaaaaaaaaaaaggaggcctggcacagtggctcaggcctgtaatcccagcactttgggaggccaaggcaggcggatcacttgaggtcaagagtccgagagctgcctgggcaacatggcgaaactccttctctacaaaaatacaagaattagctgggcgtggtggtgggtgcctgtaatcccagctattcagggggttgaggcacgagaatcgcttgaacctgggaggtggaagttgcagtgagccgacatgcaccactgcattgcagcatgggtgacagagcaagactccatctcaaaaaagaaaaaaaaaagggagagagaagtacttaaaaacgcacatacataataggagaaaggactatctataaaactgtaataatgctatcattgtcaaggtttatgcttattgttgtgtgtcacaaacataatgaatcaactccaaaggcagggatatatgttttattcattgatgtaccccaaacacctaaaatggtaacacatagtagatactactattaagtataatagtaggtgctcaacatatatttgtggaataaatagtggggaaatttctggcactgggagtcaggtgatccggatgctagtattgtcagtaactggcagagtacttgtatgctaatcgtggaacttgatgctaaggcccagcttaaaattccttaaagtgtaaatgacttcttcattatgatggttacattagtgccctttgaaacagcactagaggctgggctgatggcttacacctataagcccagcactttgggaggctgaggctgttggatcacctgaggtcggggagttcaaaaccagcctggccaatatggtgaaaccccatctctactaaaaatacaaaaaattagccagacgtggtggcggacacctataattctagctcttgggagacagaggtgggagaatcgcttgaacttgggagtgggaagttgcagtgagctgagattgcaccactgcactccagcctgggcacgaaagagtgagactctgtcttgggaaaaaaaaaaaaaagagagacagcactggaataaggaggctggaactaaaaatgaaattttactcccaagaagacatttgggagaagggaaagttaagaaaaatgtggtcgggcttgtttcttatatatttgcctttggatgataccttcaaacaaccaatttaagtctggacactgtggctcatgcctgtaatcccagtattttgggaggccgaggtgggcgaatcacttgagttcagaagtgtgagaccagcctgggcaacatggcaaaactctgtctctacaaaaacattacaaaaattagccaggcctggtggtgtgggcctgtagtcccaactactcaggaggctgagtagggaggattgcttgagcccaggaggcagaggttgcagtgagccgagatcaagccactgcattccagcctgggcaacagagcaagaccctgtctcaaaacaaaataagaaaccgattcaaaatattaattttgtctatttttaattcctagggtctgaaacctggcttcattactctgtaggcaacagttccttccctttgatttgctgtttatatgaaacatgtaacaattcatgtcattaagtatatctttttctggtcttagattaagtttaaaaagtttcactttgggccccccacgttgtggctcacagctgtaatcccagcactttgggagcaggccgagggattgatcacttgaagccaggagtttgggaccagcctgtccaacacggtgaaaccccgtttctacaattagctgggcgtgggcatcccacacctgtcatcccagctacttgggaggctgaggaacgagaatcccttgaacctggaaggcggaggttgcagtgagctgagatggcaccactgtactctagcctgggcgacaaagggagaccctgtctcaaaaacagtttccactttgttcactatttctattttgttcactagtagcgtcccagaaaagatttgaggtagcaacactaaaaacacactaattccatttctacatagaataaactaaagagaaaagagaaaacaatttgtggagaaaagtgaagataattagataggttgggattgaggggaagggttaaaggttaaaaaaagaaaaattgtgcttctccattctggaaagtccccagctttttctttgttttgttttatgtccaaactgtgtacatattggattctttcctactccttagtctatcagtcaatcatcagttgagacttgagtacactacaccctaaagtcatgagttacttaatgggtagttggaattcagtacctttagtgtgttttattctctaactcacctacccgaataatttgattcaaaatagactaaaaagtcttatttttattggatgatatgagcaggcactaaatacagtacagtattaaactttgggctgacacagtacagaaccagtcaagatagggctctagcctgttaggagattgcttttactcttccaagtcagcgttctcactgggcacggtggctcatgtctgtaatctcaaccctttgggaggctgaggaagggggattacttcaagtcaggagttcaaggccagcctgggaaacatagcaagatcttgtaggctgggcgtagtggctcacgcctgtaatcccagcactttgggaggccgaagcgggtggatcacaaggtcaagagatcgagatcatcctggccaacatggtgaaacctgtctctactgaaatgcaaaaattagctgggcgtggtggcttgcacctgtagtcccagctacgcgggaggctgaggcaggagaatcgcttgaacccgggaggcggaggttgcagtgagctgagattgcaccactgcactccagcctggcaacagagcaagactccgtttcaaaaaaaaaaaaaaagatcttgtctccactgaaaatataaaaaattagccaggcatggtggcatgtgcccgtagtcccagctactagggaggctggggccaaaggatcccttgagcctgggaggtcgaagtgcagtgagctatgatcatgcctggtcggcagagtgggaccctttctcaaaaaacaaaataaaatgaaataaaattaaaccagagttataaatcctgtgagccagcattttcctttgggtctcataaaaactaatcctgtttatggtgaaaccctgtctctactgaaaacacaaaaaattagctgggcatggtggtgggcacctgtgatcccaggtactcgggaggctgaggcaggagaatggcgtgaacctgggggatggagcttgcagtgagccaagatcgcgccactgcactccagcctgggcgacagcgcgagactctgtctcaaaaaaaaaaaaactaatcctgtttagatttttgttaccattacctccagtgcatacgatctaattttttttttgagacagaatttcactcttgttgctcagactggagtgcaatggcacgatctcagctcattgcaacctctgcctcctgggttcaagcgattctcctgcttcagcctcccgagtagctgggattacaggcatccaccaccatgcccggctaattttgtatttttagtagagacggggtttctgcatgttaggctggtctcgaacccctgtcctcaggtgatccactcgccttggcctcccaaagtgctgggattacaggtgtgagctactgcacccagctgatctgattctcttaattaagcaacactaggaaatactaatgttataattttattttaaattagaattcagagtcacaggttcctgttaggaaggttctttctgtgtgtagtgcccagaagctcaaactaatgacagatgaaaatacctcagagaagttggagggtataaattagagatgtgctttatagatcctaactgagagatcaggctgtgtacctagtcacagaattgattttaattgaaatgttgatgaaattggtgatcaccagaatgacccaaaggtgtgttactagagctctttgcagggataggttcacccctatcattcaggtttcaattacactatgaatcaaaaaaggaataggatgaaatatttaaaaatataggccaggggccaggcgtggtagctcacgcctgtaatcccagcactttgggaggccgaggcaggtggatcacgaggtcaggagatggagaccatcctggccaacatggtgaaaccccgcctctactaaaaatacagaaattaacccggcttggtggcgagcatagtcccagctactcagggggggtggaggcaagagaatcgcttgaacccaggaggtggagattgcagtgagctgagatagcaccactgcactccagcctgggtgacagagtgagactccttctcaaaaaaaaaaaaaaaaaaaaaatctaggccaggcccggtggcttacgcctgtaatcccagcactttgggaggccaaggtgggtgaattacctgaggttaggagttccagaccagcctggccaagatggtgaaaccctgtctctactaaaaatacaaaaattagctggggcagaggttgcagtgagctgttattgcaccaacgcactccagcctggcaacagagtgagactccatctcaaaaaaaaataaaaaaaatagactgggcacggtggctcacgtctgtaatcccagcagagcgagattccgtctcaaaaaataataataaatacaaataataaatacaaataaataaaattaaaaaataaaaatctgtagtgccatctgcctccaaaggcttacttagccttgctggttaataaaattattattcaagagaaactatcaaagacactgaatttgcccctaagacaaagaagctgtttctgcaaagggacaccttatgtagatgaaaaaatttaatagtttggaacttttgtattctgatctcagtctctctaagtttaagaacttgttccttaaattttttttttttttttttttttgagacagagtcttgctctgtcgcccaggctggagttcagtggcaccgtctcggctcactgcaagctccgcctcctgggttcacgccattctcctgcctcagcctcctgagtagctgggactacaggtgcccgccaccatgcccagctaattttttgtatttttagtagagacggggtttcactgtgttacccaggatggtcttgatctcctgacctcgtgatccgcctgtctcggcctcccaaagtgctgtgattgcaggcgtgagccaccgcacccagccgttccttaaattttttattgccatacaatttcagtaatgttttcccatttccacctagtgacagactacattctagttttagcctttgcagcaaattgagatccagttttctggggaaagattgctacatttttatagctttcttttcctgtagagatgtgacagtaaataaagtggttcgtatttccaatgattaatctttttaaaaaataaactctattttttagaatagtttgttttttaagaaagaaaaaaaagaaagaatagtttgtttgtttttggtttgtttgaaacagggtctcactctgtcacccaggctggagtgcaatggcgcagtcacagcttgctcctgcagccttgatcgtgcaggctccatctgtcttctcacctcagcctccctggtagctgggactagaagcacacgccaccatgcccaactaatttttgtatttcttttgtagagatgggatctcaccatgttgtccaggctggtctcgaacaactgggcccaagagatccacctgcctcagcctccaaaagtgttggaatttcaggcatgagccatcacgcctgccctagaatagttttagatttattttaaaaattgtaggctgggcgcggtggctcacgcctgtaatcccagcactttgggaggccaaggcgggtggatcacctgaggtcaggagttcaagacgagcctaggcaacatggtgaaactctgtctctactaaaaatacaaaaattagctcggcgcggtggcatgtgcctgtaatcccagctacttaagaggctgaggcaggagaatcgcttgagcccagaaggtggaggttgcagtgagccgagattgcatcattacactccagcctgggcgacagagcgagactctgtctcaaaaaaaaaaaaaaattgtaaagctagtacagggagttcctgttctgcaactggccagcagaacatcttaagtggaatcatatgcagttatttgcgtcttatttttttcacttagtatggtggtttcattttattattactattattattaatgaggcagagtctcgctctgttccccaggctggagtgcagtggcgcattctcagatcactgcaatctctacctccctgcaatctctgccctgctaggttcaagcgattctcctgcctcagcctccaagcagctgagactacaagtgcacaccaccatgcccagctaatttttgtatttttgtagagatgaggtttcaccatgttggccaggctggtctcgaactcctgatctcaagtgatctgcctgcctcagcctcccaaagtgctgggattacaggcgtgagccactgcactcaaccagcatagtcttttaatggtcttgagatgtggtgtgaatgtatagaaactattcatggctttttgttgctgaatagtattccattgtgtgtgtatatatctatacacactacattttgtatccattagccaatccattgatatgtgtgttgttttcacttttggctattataaataaatatgaacatttgggtacagatctttgtggagacataggttttcaattctcttggataaataattagaaattgtatgccaggttctgtggtaagtatatattcagctttatttttgaaaaactggcaaactgccttccacagtggctatatcactttgcattcctaccagcagtgtatgaggattccagttgcttcacgtcctcaccaacaagttgtattatcagtcttttttcattttagccatggtagtggtgtttaatagtatctcattgtatttttcatctgcatttccctaatgactaatgatatggagcaaccttttgtgtgctcatttgccattcctgtatcttttctggtgacatagctgttcaaatttctgctctttttttttttgagacggagtctcgctgtctcccaggttggagtgcagtggcacgattttggcccactgcaacctctgcctcctgggtttaagcaattctcctgcctcagcttcctgagtagctgagattgcaggcagacgccaccacgcctggctaattttgtatttttagtagagatggggtttcacaatgttggtcaggctggtctcgaactcctgaccttgtgatccacccgccttgacctcccaaagtgctgggattacaggcatgagccaccacatccagccttctgctcactttttattggtgatttgtcttattattgagctataggacttgcttatataaatattttttaatttcttgatcaaaacagcatatgttttggagtttatcttcaatgtgtagatgaacataatgaaaggctgttaagtactagctaagtacctaactggaatataagtgctgttttgcatgtgtaagtaactaaataatagatctggtagaaatataaagtatttttttgtgtgccactccctttgcccaacaccaatgaatccatctctccaaatctgcctgttctagtgaatgctaagttttttatttgttcccttttttttttttaactttgatatgataattgttggttagggtccagctgtggtgaaaactcatcttatggctgagtttcaggtgtgtgccaacatggcctgctaaattttgtatttttagtagagtcagggtttcaccatgttggccaggctggtctcgagctcctggcctcaagtgatccacccgcctcagcctcccaaagtgttgggatgacaggcatgagccaccacagccagccagacacgacagcatctgtagattatgttctattccattacttaatacttcttttttcttttctttccctccctgcctttctgtttccttccctccctcccgccctccttcctttcttcctttcttttcttttctttcctcttctttttttgagaccgagtctcactctgtcacccaggctggagtgcagtggcgcgatctcagctcactgcaacctctgcctcccaggttcaagcgattctcctgcctcagcctccgaagtagctgggattacaggcacccaccaccacacccggctaatttttgtgtttttagtagagatgtgtttcactatgttggccaggctggtttcgaactcctgacctcaggtgatccgcccaccttggcctcccaaagtactgggattacaggtgtgagccactgcgcccagcccttccttccttctttctttctttctttacttttttttttttttttgacaaggcctcactctgtcacccaggctggagtacagaggcacaatcatggctcactgcagcctctacctccccatgcttaggtgattctcccaactcagcctcctgagtagctgggactgactgcaggcacaggctaccatgcccgggtaatttttgtaatttttttgtagagactgggttttggcatgttgtcccagctggtaatcttcattttcaaatacgtggagaaacctaagcttactatttcaaaaaggaaaataggaaaaaaggaaaatgaatgccaaaaaggaacggaagagggattgcaatttaaaaccattattttggccaggcgcggtggctcatgcctgtaatcccagcactttggcaggctgaggcaggcagatcacttgaggccaggagtttcagaccaggctggtcaacatggtgaaaccttgtctctactaaaaatacaaaaattggccgggcatggtggtgtaatgtcagcaactcaggaggctgaggcacaaggatcgcttgaacttgggaggtggaggctgcagtgagccaagatcgtgccactacactccagcttgggtgacagagcgagactccgtctcaaaaaaaaaaaaaaatccatgtgcatgagatataatcatgagcttattgtggtatatgtgtggtaatgggttaaattttgttgttttcttgtccgtgctgatgattttttttttttttttttttttgagatggagtctcgctctgtcaccaggcagcaatgcagtgatgctgtctcggctcactgcaacctccacctcctgtgttcaatcgattcttctgcctcagcctcccaagtaactgggaatacaggcacccgccaccatgcctagctaattttttgtatttttagtagagacaaggtttcactatgctggccaggctggtctcaatctcttgaccgcgtgatctgcctgcctcagccttccaaagtgctgagattacagacgtcagccaccctgcccggcctttttttttttttttttttgagatggagtctcgctctgtcgcccaggctggagtgcagtggtgcgatctcggctcaccgcaagctccacctcccgggttcacggctgtctcctgcctcagcctcccgagtagctgagaccacaggcgcctgccaccatgccaggctaattttttgtatttttagaagagacggggtttcaccatgttagccaggatggtctcgatctcctgacctcgtgatccgcccacctcggccacccaaagtgctggctgggattacaggcgtgagccaccgcgcccagacctttttttttttttttttgagacagagttttgctcttgttgcccaggctggagtgcaatggcgcaatctcggctcgtcgcaacttctgcctcccaggttcaagcaattctcctgcctcagcctccagagtagctgggattataggcatgcgccaccacgcccggctaattttgtatttttagtagagacggggtttctccatgttggtcaggctggtctcaaactcccaccctcaggtgatctgcccgcctcggcctttcagagtgctgggattacaaccgtgagccagcgcacctggctttttcttttttttttttttttttgtagagatggtgtctcactttgttgcccaggctggtctcagagtcccaaagtgttgaaattataggcatgagccattgcacgtgacagagtctcactctgttgcccaggctggagcgcagtggtgcaatctcagtagctcactctagccttgatctcctaggctcaagtgatcctcctacctcagcttcttgagtagttggaactacaggcatgcaccaccatgcccggatgatgtttttgattttgttttgttttgtttggttttgagacagagtctcgctatcgcccaggctggagtgcagtggcacgatctcggctcactgcaggctccgccccctggggttcacgccattctcctggctcagcctcccaagtagctgggactacaggcgcccgccacctcgccaggctaattttttgtatttttagtagagacggggtttcactgttttagccaggatagtctcgatctcctgacctcatcatctgcccgcctcggcctcccaaagtgctgggattacaggcgtgagccaccgcgcccggccgatgtttttgatttttaatagagatgaggtcttaccatgttacccaggcttgtatcaaactcctgagctcaggctatcctctcagcttggcctcccaaagtgctgggattacagatgtaagccactgcacccagcctcttttcctttaaaaaataacaaaaacaacagcaaaagaaaattttgaaaaatagagataggatctgactgtgttggccaagctaatctcaaactcctggcctcttagcaaccctcctgccttgacttcccaaagtgttggaattacaggcatgagccactgcacattgcctgatcatttatttttcttttcttttccttttttttttttggttttgttttgtttttgtttttgagacaggggcttgctcagtttctcaggctggatgcagtggtacaatcatggctcactgtggcctcaatctcctgggcttaagtgatcctctcacctcagcgaaaaaaataaatgtgtaggaaattttaaaaaatagggtgtgaaactttagtttctgtttcaaattttggctcttcatagctccttgtaatgttttgttttgttttgttttgttttgaggcagagtctcactcttgttgcccaggccgcagtacaatggcgtgatctcagctcactgcaacctctgcctcccgggttcacatgattctcctgcctcagcctcccgagtagctgggattacaggtgcctgccaccacacctggctaattttttttttttttgtattttttagtggaaacggggtttcaccatgttgaccaggctggtcttgaattcctgacctcagcctcccaaagtgctggtatcacaggcgtgagccactgcacctggctagctccttgtaatgtttttaaacatttttaatgttaggtggaataaatagagctagttatctaagaaacccaagtagttattatagagtaaaagcatcatcttgtggattttattgaatttttacatgtatttagtgtttgtactttctctaaaataattggcaggcctgttagctgagcctagaaattggttcagaaaagcattatgggcaggtgcaatggctcacacctgcacctgtaatcccagtactttgggaggccgaggcaggcagatcacttgaggtcaggtgatccccagtagagatggtgaaatcccatctctactacaaatacaaaaaaatttggccggctatggtggtgcgcgcctatagtcccagctacttgggaggctgaggcaggagaatggcttgaacccaggaggcggaggttgcagtgagccaagattgtgccactgcactccagcttgggcaacagagtgagactctgtctttaaaaaaaaaaagcattatgaaaaaatagaatttaataaagtaaagggcctcttcccaaatggcatcaagtattatagggacctgtcttagacatacaaaaatagtaggagaaaccttgaagtctttctgattctgggggaaaatcctactgagggtgtcagggtctaacttgctgcactaacttaatagaaccactgtctgttctcttttgaaaagctggacacctgttctgctgttgtgtcctgccattctcctgaagaacagaggcacactgtaaaacccaacacttccccttgcattctataaggtaggtaaagtatattagaatacatacttcttggccgggcgcggtggctcacgcctgtaatcccagcactttgggaggccaaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagaatacatacttctttaaaacgttgaaccttaattcaaataccaaaaagggggatttgcattgctatctatttccatatgtcttgctgctgacttggagatgagattatactgctgtcatatcctacttttattactaggcatgtggtaaatttagaccatttggcagtatggttttgtagcatgggtggatctttccatgaaacccttggatgcaaacttggttcttgctgaccacttctcttactcaaagtaaagagaagacttccatatcttgaagtaatccaagttcctagtacctgtgggagaacttcttgagtgctaaattaaaaacaagataccacaggaggacagaggctaagctttttgataattggaccacaaattgctgatgtgaaattttgttgttgttgtttttttttgttttgtttttgtcttttgtttttgttttgagacggagtcttgctctgtcgcccaggctggagtgcagtgatgtgatctcggttcactgcaacttccacctcccggtttcaagccattctcctgcctcagccacctgagtagctgggattataggcgtgtgccaccacatccagctaatttttgtatttttagtagagacggggtttcagcatcttggccaggctggtcttgaactcctgacctcgtgatccacccaccttggcctcccaaagtgctgggattacaggcatgaatcaccatgcccggacttttttttttttcttttttgagatggagtctcactgtgtcacccaggctggagtgcagtggtgcgatctcggcttactgcaacttccacctcccaggttcaagaaattctcgtgtctcagcttcccacataactgggattacaggcacaagccaccatgcccgactaatttttttttttttttgtatttttagtagagacggggtttcactatgttggccaggctagtcttgaactactgacctcagaagatccacccaccttggcctcccaaagtgctgggattacaggcgtgagccaccgtgcctggacttcttgttgttttttgtttttttgttttgttttgttttttgagacaaggtctcactctgtcactcaggctgaagtgcagtggcgtggtcacggctcaatgcagccttgacctcctgggctcaagcagtcctcccacatcagcctcctgagtagctgggactacaggcactggccaacacatctggctaacttttgtattttctgtagagatggggtttcaccatgttgcccaaggttgtctcaaatcactgggctcaagtagtgctctcacctcggcttcctaaagtgttggttttacaggtgtgagcccctgcctcttttttttaaattgaaactttctgttgaactcacacatttgggttctttaaatgtgtgtttttatgagtaaatttaatgggaatgaaagcataattgatcttttttttttttttgtatttgaggaatgctttatttccaggcaataaaatgctatttctcatctctgtctctcttagattacagcaagatggaaataccaaatccccctacctccaaatgtatcacttactggaaaagaaaagtgaaatctgaatacatgcgacttcgacaacttaaacggcttcaggcaaatatgggtgcaaaggtaaaaaataattcccaagtgaaagtttatatatttcaatatactgacccagtgtaaaggggttggaatttttttttttttttgagacagagtctcactctgtcacccaggttggagtgcagtggcgtaatctcagcttactgcaagctccacctcgcaggttcacgccattctcctgcctcagcctcccgattagctgggactacaggcgcctgccaccacgcccggctaattttcttgtatttttagtagagatggggtttcaccatgttagccaggatggtctcgatctcctgacctcgtgatccgcccgcctcagcctcccaaagtgctgggattacaggtgtgagccaccgcgcctggcccaggggttggaatttctttttaacttttgttttgaaatcgtaacagggccaggtgcggtggctcacacctgtaatcccagcactttgggaggctaaggcaggtggatcacctgaggtcaggagttcgagaccagcctgtcctacctggtgaaacctcgtctctactaaaaatacaaaaattagccgggcgtggtgtcatatgcctgtaatcccggctacttgggaggctgaggcaggagaattgcttgaacccaggagatagaggttgcagtgagccgagatggcaccactgcactccagcctgggtgacagagcaagactccatctcaaaaaaaaaaaaaaaggccaggcacggtggctcatgcctgtaattccagcactttgggaggctgaggcaggcagatcacttgaggccaggagtttcaaaccagcctggccaacatagtgaaaccctgtctctaccaaaaatacaaaaattagccaggtgtggtggtctgtgcctgtaatcccagctacttgggaggccgaggtaggagaatcgcttgaacccgggaggcggaggttgtggtgagctgagatcgcgctactacactccagcctgggtgacaacagagcaagactccatctcaaaaaaataaattattaattaattaataaaataacaatatatcttaatcttttccatggctttgctaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaaggtacttttgggagtttaagctcagtcttcctctcttccttgggcttaaagctttttcctatatttgtgactttttagaaagtgaataagtaagacaaggtatggtggctcacacaagtattcccagctatttgggaggctgaggtgggaaaatcgcttgaggtgaggagtttgagaccagcctgggcaacatagactgtgtctctaaaaaattttttaaaaaagtagccagacatggtggtgtagtcctagctacttgtgaggctgaggtggaaggatttcttgagcccagaagttcaaggctgaaataaactatgatttcaccacaacactccagtctgggttgacagacaagaccttatgtccaaaaaagaaaaaggaaagaaaggaaataaataaataaggttaaggttaatagatacagctattttagtcaactttgaataattaagatagtaaatctgcagcttcaagaataattacgggggctggacgcagtggctcacacctgtaatctcagcacttcgggaggctgaggcagatggatcacttgaggccaggagtttgagaccagcctggccaacatagcgaaacactgtctctactaaaaatacaaaagttagctgcgtgtgatggtgcacacctataatcccagctacttgggaggctgaggcctgagaacctcttgaacctaggaggcagaagttgcagtgagccaagatcacaccactgcactccagcctgggtgaaagagtgagactgtgtctcaaaaaaaataataaataataaataaataaaagaattttctagttaagaaactttggctggacgcggtggctcacacctgtaatcccagcactttgggaggccgaggtgggtggatcacctgaggtcaagagtttgagaccaggctggccaacatggtgaaaccccatctctactaatagtacaaaaaaattagccaggcatggtggcacacttctgtaatcccagctactagggaggctgaggcaggagaattgcttgaacccgggaggtggaggttgcagtgatctgagatggcaccattgtacttcagcctgggcaacaagagcaaaacaccatctccaaaaaaaaagaaactttatgaaaataaattatcattattattatttagagacaagatctcactatgtcacccagactggagtgcagtgtcatgatcatagcttactgtaacctccaacacctgggaaatagataatatttttaaaatataaaaagtaaatattatctaggcatggtagtgtatgcctataatcccagctactcgggaggctgaggtgggagaatcacttgaacccaagagttcaaggctgcagtgagctatgatctccagcctgggcgacagcgagactccgtctcaaaaaaaaaaaaaaaaaagagactgtctcttaaaaaaaaaaaaaaaaagcagaagctgggtgcagtggctcatgcctgtaatcccagcacttttagaggctgtgacaggtggatcacctgaggtcaggagttcaagaccagcctggccaacatggtgaaaccctgtctctactaaaaatacaaaaattggccgagcgtggtggcgtgcacctataatcccagctactcaggaggctgaggcaggagaattgcttgaacctgggaggcggaggttgcaatgagccaagatcgtgcaactgcactccagcctgggcgacagagtgagaccctgtctcaaaacaaaaaacgaaaagcagatagtgtattgagagcaaatatctttcctgaagcagaatgttactataatttctataccactttgcttctccatgtactatccctatcacctatgcagctaagttgatgtccactgtcttaaagtttaggtcttcagaaaacttcctcatcttttaggactttcagaggctctttactgttgtgtataacccaggtagaccaacagtttgagctgaggtaaacatcagctgagtatgggaagtactgtgctgaactctatagaggacacaaaggtgaataagagtcccttcttttggctgggcatagtggctcacacatgtaatcccagcactttgggaggctaaggcaggatgattgcttgagtccaggagttggagaccagcgtgggcaatatagcgagaccctgtctctacaaaaaaaaaaaagaaaaattagctgtttaactggatgtagtagcacatgcctgtaatcccagcttctcgggaggctgaggttggaggatggctttagcctgggaggcagaggctgcagtgagctgtgattgcacaactgcactcagcctgggcaacagagtgagatcctgtctcaaaaaaaaaaaaagagtttctactttccacaagtttgcagtctagggattccttttaggagatgatgttacaaaactctgaatttattaagttgtttttaaaattttgtttttgttttttttgagacggagtatcgctatgtcgccaggctggagtgcagtggcgtgatcttggctcactgcaacctccacctcccaggttcaagcaattctcctgcctcagcctcccgagtagctgggactacaggcatgtgccaccacgcccagctaatttttgtatttttagtagggactgggtttcaccatgttggccaggatagtcttgatctcctgacttcatgatccacccgcctcggtctcccaaagtgctgggattacaggcgtgagccaccatgcctggtcaaattttttataattttaaatgccatctgaattttaaaaatttaatttattagcttgtaagaactagaggctactaagatcattttttttctcttttttttcttttttttcttgagacagagtctcgctctgtcacccaggctggagtgcagtggctcactcaacctctgcctcccaggttcaagtgattctcatacctcagtctcccaagtagctgggattacatgtgtgtaccaccatgctcagctaatttttgtattatgtttttgtagagatggggtttcaccatgttggcctggctggtctccaactgacttcaagtgatctgcctgtcttggcctcccaaagtgctgggattactggcatgagccactatgcccagccaattttggaaggaaattacatttctttcttgggttatatgcccgtctttccctctccatgtcattgcttatatttcagtgtaccatagagagcattttcccgggatttgcaagccaacatatgttaatgaggtcactgaacacagttgcattggttcccatcatgtattcctggtcccctctccaacagaactttatggtatgtattgaaagcactgtggtggttatttaaactgtatgattgtgttatgttgatatgccagagctcctcttagggtaaagattgtccagtaattaacacagctaggacatgcagggcagaacaaggttgtaatttacttactctaaacaatatatattgcaagttgttctaacttgtcagattttatgctctctgatgtgtgctttggaattgatgctggttcttttttaaatgaataatattgggcaagatttcaattttctcttagtaccttggcccaatattatgtacagttaaatgcagtctaaatcagactcttgaggcttgagcaggttgtctgctccctgttgatggagtaatcctttctgaattctctaaatgcaagatgctacaaaaacaactgagacaacagacgtgcacacagtcctttcatctgggcctttgtgctgactcctactaggattatttgtggttttgataatcattcctctctaaatactgccattgcttatcatctgcctggtgacagatagccgtactactggttggaatgaggtcgaggtttatagaagggaatcatctcttagaataaaacttcagaataattttacttgctacttggggattttagaatgactatattctctgctgagcaccccactcccccaaaattatttactattgtttattgccagaaaatatccatagcctaggctgcagttgactttaggttcccattgagtgtgactggcatgagttgtaatcataatttttttttattattggagaatcttagtccatcttatagaatacccatgtcttatgattgcccagtttattttgtagttaaattacagatcataatcttagaagccttcatttttatttatccatctgtctctctacttatgaaactttttttttttttgagacggagtctcactgtgtcgccaggctggagtacagtggcgcgatctcagcttactgcaacctctgcctcccaggttcaagcgattctcctccctcagcctccctagtagctgggactacaggcatgcgccaccacgcccagctaattttttgtattttagtagagatggggtttcaccatgttggccaggatggtctcgatctcctgacctcatgatccgcctgcctcggcctcccaaagtgctgggattgcaggcgtgagccaccacacttggccccatttgaggtttttttggccaaacaaaatggccagtgtttaaaatgcaggaaactctgggacaaaggcattttcaggagactcaagcaacaaacaaagctcagcaaagattccactaaataggaaagagcagatgcatgatggcttcatggaataaatcacatctggtttggtttcaggtagaagatgagacggttttgtgcaatattccctacatgggagatgaagtgaaagaagaagatgagacttttattgaggagctgatcaataactatgatgggaaagtccatggtgaagaaggtagtggtactgaactccttggagaaaattttgttagaatcaggcctcttctttggtacctcatcatcttgccatcttgcttttatcttctgccccatggggtacacactgcagaatatttcaatgtcatcacatggctgggagttaatttttttttttttttttttttgagacggagttttgccttagttgcccaggctggagtgcagtggtgtaatctaggctcactgcaatctctgcctcctgggttcaagtgattcttctgcctcagcctcccaagtagctgggactacaggtgtctgccaccatgcccagctaattcttgtatttttagtagagatggggtttcaccatgttggtcaggctggtctcgaattcctgacctcaggtgatccacctatctcggcctcctaaagtgctgggattataggcgtgagccaccatgcctagcccaatttttttttttattttttttttagagacagggactcactcagtcacccaggctggaatgcagtggcatgatcatagcttattgtagcctcagcctcctgggcttaagtgattttcctgctttagcctcctggggggctgggactacaggtgcactccaccacacctggcttttttttttttttttttttttgagacagagtctcgctgtgtcacccaggctggagcgcagtggcacaatctcggctcactgtaagctccgcctcccgggttcatgccattctcctgcctcagcctcccgaggtagctgggactacaggcgcctaccacacccggctacttttttgtatttttagtagggatggggtttcaccgtgtgagccaggatggtctcgatctcctgaccttgtgatcctcccacctcagcctcccaaagtgctgggattacaggcgtgagccaccgtgcccggccctggcttatttttaaaattttttgtagagatggagtctcaccacgttgcccaggctggtcttaaactcctggcctcaagcaatcctcccacgttggcctcccaaagctctgggattacaagagtgagccaacatgcctggcccaaaataccctagttatttctttttttctttctttcttttttttttttattaccctagttatttctgattcaagcagcagaaacagaaataaaaattatttaaagtatcctagttaaattttaaaaggagttgggacataaaaggattatgtagtaatcagtggctggagagaaagtttattgtacaaataagtttaatcttagggcttaggagttttccataaggacatccaagaccattttgttctttatttctctttctctgagaatggcaatgaggctctctgtcatacttctttgatccaggcatcccctgaatctcccagaagttggttttaataatctgaatttcctaaaagccaattgtttggatttagtcataattctagaaaagtctgtccgtgtgtaagaaatggaaagaggagaggctctccatcacttcataaaccaacagccccacctgctcttttgacaattgtgggcactgttgtgatgctgttgaactacattatttgtccacagtgcctcctagtgttcaaagacctcctaaattgtagtacatctccataaagtacaattttaggaaaaattgctgtcttttgatttagagacgtcattactgacccatcagcagcaaagccaagagaattttcattttattatttttctctgccctacttggagattgtttgaacactttcatgagattttgaaccagaaattcagagttgacttgtgactgaggaagtgaagttcttcagtaagaataaagcctatggctgggcacggtgggtcacacctgtaatcccagcattttggtaggccgaggcgggcggatcacctgaggtctggagttcacgaccagcctgacatggagaaacccagtctctactaaaatacaaaattagccagggtggtggcacatgcgtaatctcagctactcgggaggctgaggcaggagaatcacttgaacctgggaggtggaggttgcggtgagccaagatcgcgccattgcactccagcctgggcaataaggcgaaactccgtctaaaaaaaataataaaaataaataaagcctatagctgtattcctactctagccagctgcccactgcatgtgtaggagccaatcaaatgattgtaatttcctgatctcccatgtaaaaatgtacacatgtgacatatctgggcctctggagtgagtacaagaaaacctgcctaggaggactaatggaatgtgaagtgaccactgctcatctttcgaatcctcatgtttcagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggtacgtagcactggctcccttattccttttttaaagtgacagggatagggaagaaggaagaactggaaagatttgttgcctattaaaggctgttggtgcttcttgttggttcacttaaaaggagaacatgatcattaagtgatagcttcagatagctgtgacttgggtgaagaagaaagtagaagaactgatagaataatcattgctattcatttctaattatatgtctcatgtgaaattgggatcatgccaatttatatatatgtatatatcaaattttatatccctttttatttaatcttatgagtacttttccatgtcactaatgtttaatttaaaatttaatagtttaattatactatatgtccagggacatagtgtattctcttttattgtatcataattatagtatcagtgtagttcttcagcatccacttcatgataggattcttctatgttcaggcctctctatgaacactcttttcacctccaaattcttatttttatttttaaaatctattatttattatttttttgagacacagtcttgctctgttacccaaggtggagtgcagtggcacaatctcggctcactgcaacctccacctccctggttcaagtgattcttgtgtgtcagccttctaagtagctgggactataggcatgcaccaccatgcccagctaagttttgtatttttagtagagttggggttttaccatgttggccaggctggtctcaaactcctggcctcaagtgatccgctcccctcggcctctcaaagtactgactgggattacaggcgtgagccacctcacatccagattctaattgggactgtggattttgttgttaatatgtagactactctaacttccttatttactggtagcatatatcagataagtccagatagcactgatgtttatatatctccaaacaatcagtggttaggttaacaaagcagctgtaatcaaaatgctatgacaaaaggaaaaaagatcacacagatttgtttacgtgttctgataatcgcactcaggagctttttatcatttccaattcaggcaacaaaaagagttccaagaaacagttcccaaatgacatgatcttcagtgcaattgcctcaatgttccctgagaatggtgtcccagatgacatgaaggagaggtagggaaagctgtcccacttaggccatatacagagtgctcggacaaaacctttattccctcctaatttttggttagtaaaaagctttgtttatggtaagggcattatgatttgcccgcaatttgattatttcttgcttactcaattacctctaaatgccccccttactatattaagggtcatcgtatactggcttttgagtgagtctgggcagagaacatttactctgccatttttctggagagttaactccagcaccatcttaacaaatccttccctccccttactttccaacatttgcccaacccagcataattacaatggtggacccactctagttatctaccattctcttatcaaccagacctataaaaaacacccatcctcccttggcagaccgtaggtgagctactgtcagtacccaatctgtatttcctcagtggaggcagttcctcggaggaactcttatctctcttttcttaaataggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcaccgtgagtggggctactctgtttgaaatgctctcctctcttccatccccagccaccatttccttctctttgttctggtttctcgtatagagttcctggcttctgttctaacgttttacaaagggccagttctattttcccttgctcaattatagtgcaacatgctttgcatgatagggacagactaactagcaacttatctgtccctcagtacctcttagctttgaaagcattgtgttgatgtcagaaatgactgaattttgtgcaccctgatggtagccgtttatatcgaattctaactcctacaatagctctctaattcacttttgtttctccccatcttgtcaagtggatagaccactggcaacaagacagtttttgttttccagcttttcatgccacccctaatgtatataaacgcaagaataaagaaatcaagattgaaccagaaccatgtggcacagactgcttccttttgctggtatgttcttaagctgttctggcattattaacttcattctgggaacacaagccacgtgagccagtacacagcactctgggggtcatatagcacaaataaaacatggcttttgctcttaaggagctccccagttactgtgggaccgctcttaaggaactccccagacatggtagcactataaagttagtctgatggagtgcagattcgaagatcattaaaggcttgcctgctctaaatatcatctgcttagatttcagagcctaaaactgtattgttagaattggagcaaagtgtatgctgggggggtgggtacacactctagtttctttgctatcttgttataaatgcatataactatgagacgaatagcacgtgatgatgctgatgtcttgttgtgatcaaccagatggaccgttccctgatggacagaccttaagaagcagcataaatggtctggcatacctgtggggaagccatatattgagagctagaaggaaatagatcaactggacttgccaaagacacagttgggctttttacacaataggatgagcctacgcgatgaataaaataccttgataaaatttctgccacctattaaaattatattatacaaccagccaagtgcttttggaaccatctttagtgggataatagatggaaagatggtagagaatgctgttgggcacacatgtggaaaatgggccgtactgtaaaagcaaaagaatagacgttattgggtttattttttcctaatgtgtattgactccttcctatgtgccaagtatcatagtagacccttaacataccttgtcttattttcatcctataacagtgtcatgaggtagaggaaactggattacaaaagttatatattttgcctaaagtttgttgataagtcagcggtatggcagcgatgaaattcaagtcagggtctaactccacagatcatgcttttaaaattactccatgtttttcagccaggcgtcgtagtgcacacctataatcccagcactttgggaggctgagggaggtggatcacctgaggtcaggagtttgagaccagcctggtcaacatggaaaaaccctgtctctactgaaaatacaaaattaaccaggtgtggtggcgcacgcctgtaatcccagctactcaggaggctgagacaggagaattgcttgaacccaggaggtggaggctgcagtgagccgagatcacgccactgtactccagcctgggtgagatagtgagactccatctcaaaaaaaaaataataataaaatgaaattacttcatccttaaaaaaatatatatgccatgttatgtcaacataccagcatttatataagtcaaaaggtcattgcccttctcacaggagtcaccttgataccctgtacatgtattacgaagatgctgccaatgcctgaaatgtatgcatgtttaacttacagagataatgtatgcacaatttttcttttattgcgttttaggtttgagtgcatattaaatataatgctggactattttcccccaactgtttactaagaacattttcaatcatgcagagttgaaagataccttcttcctggatttgataacatttttttctgtatctcctttctccataaatttgcgtatgtatatcttttgctgaaccatttgacaataagttgcagacattgtgatgctcatttggtaaatgtttcagcataaagacattctcttacataaccacattattacacctaggacaattaataaaaattgtatagtatcctctattacccattctattaatatattcaatttttttttcagctgtaccaagaataggtatttttgtgttgtgttttgttttgttttgtttccaaaccaggatcatccagtcagacatcatatttggttattatgtctttttttttttttttttgagacagagtttcactcttgttgcccaggctggagtgcaatggtgcaatctcagctcaccacaatctccacctcccgggttcaaacgattctcctgcctcagcctcccaagtagctgggattacaggcatgcgccaccacgcccagctaatttttgtgtttttagtagagacagggtttctctgtgttggtcaggctggtcttgaactcccaacctcaggtgatcagactgcctggcctcccaaagtactgggattacaggtgtaataaggcgcccggccttgttatgtctttttactcgtttttaatctcaaataattctatcacttttaaaatctttttaaaagttccaggctggttgtcttgtaggatgacccacatcctggattcatctgttgttttttcacagtgtcatttctgtgttcttctgtctcctctttcttataacctagaaattaggtctggaaacttgattttatttatgttaaaatgtttggccattatattaaaatggtggctcacgcctgtaatcccagcaatttggggggctgaagcatgtggatagcttgagcctaggagttcgagaccagcctgggcaacatggcaaaaccccatgtctataaaaaatacaaaaattagctggactggacttgggaggctgaggtgggaggatcagttgagcctagaaggtcaaggctgcagtgagctgagatcatgctactgtactcacctgggtgacagggcaagacctcgtctcaaaaaaatatatatatatataaatacatataatctattatatattatattatatataaatacatataatctataatatatattatatataaatacatataatctatgatatatattatatataaatacatataatctataatatataatatataaatacatataatctattatatataatatataaatacatataatctataatatataaatacatgtaatatatagtatataaatacatatataatatataaattatatttacataaattatatatattttatatttatataaattatatataaatatatttatataaatttcatatatttatatattatataaatatatattttatatttatataaattatataattatataatatatttccatattatatattatatatataatatataaaaattatatgtaaatatatataaatgtttaaaatagtataattgatactgtatacttcatacacagcataggcacataatatcaggttcagttaattttgaaacttctcttttggaatttcctttaggccttactgtatattattccaaattccagatacccttaatgatagttaacctttatttttttttcatttttattactcaaaaaaacttcatttttaaattgagctttctgactctgcttgtgccttcaacactttcacaacaattttctgctgcttgctaaggaaagcacacttgctcctgcaccaatacattcagcacacacggatccaccataggccctgctgacatgcttttttgttttggacaatctcataggaactttaggtctcatagcacaaaccccccgaagtctgctgggcacacgccacatgcagatttcagtgctttcccaaccctcttggtataaaggtaatcaattctattaccaggggctcaggacagcctagttttgttaaaagctatattgtaggaaagcctacatgtatgtcaaatgctggaccattctgagtgcctctagacaatgtcactggaagataaacctttattttgtagaaatagatttagttttcagaaacagctaggaagtctttgaaaaccaagtctgatgagaaaatattgatgatctaggtgagtgataattatttcattttttaaaaaagggggtgatagctgtaaaataatgaaacaatattcttctgagtttcatacacagatttgggaggaagtttcaaaattaagtagtaagattgtacagattaagcattacacattttattaaggaaacagagaaagtgtggtagactggaaagaatagtggcctagggagacaaggagccctgattcctatacccctctggaactattagctgcatactctcaagctagtttcttcccctctctgaatctcatttcttcatccataggagaatgtgttctcaaattccaaacaagtaacacgcaagttaattttagatacaactcactggaaaattgaagacacagatgcatagattatatcttttttaagattataggacattagctgggcatggtgacatgtgcgtgtggtcctagctacttgggaggctgaggcaagggaatcacttgagcccaggaattcgaggctgcagtgagcaggcctctgcactccatcctgggcaagagagagagaccctgtctcaaaaaaacaaacaaacaaaaaaacattataggacaactcttttgtgaaaaagtacgtaagttttgttaagcagctctcattgttatatgatcatacttattatatggtacagagaaaaagaaaagacactattattgtagacagatgttgtaaagatgaaagtttgtgatgatgagatcaatatggtgatgggcctgttcctatttcctgtctgtaatgtgtccactgcaggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcaggtacgatgaacagaaaatgaagactttttctttccatgcaaggactctggtaaacccaggatcactgcctgacacttaactttactacctcttaaaaattataaattctttctacaagttttgtaaacagtaaagatggggaatattttctttttttttttttttttttttgaaacagtctctcgcttttttgcccaggctggagtgcagtggtgctatcttggctcactgcaacctccacctcccaggttcaagcgattctcctgcctcagcctcccaagtagctgggattacaggtgcctgccaccacgcccggctaatttttatatttttagtagagacggggtttcgccatgttggccaggctggtcttgaacttctgacctcaggtgatccgcctgcctcggcgtcctaaagtgctgggattacaggcgtgagccaccctgcctggctaatttttgtatttttagtagagacagggtttcgccatgttgcccaggctggtcttgaactcctgagctcaagcaatccacccacctcggcctcccaaaatgcagggattacaggcgtgagccaccatgcctggcctaaagatagggaatattttcattcctaactgttctaccttttaaagtagaatgaagtacttctgagtttgtgacaaactactgatgacaactgcattctaccttcttctgattctgttatttcttcccttctcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtaccatctggaagcagcagaacaaatgggcccctcctttcacgcattgctctgtccagccctttgccatcttaccaggctgtgtgtctgggtctggagagaagttgtcttaagttcagtccctgatgagcctgtgcttctgtgagtttcccaaacatggcccttctgcaagtgccaggcctaatgatgtttggggacccgcctcctccttgctgaatgctcatttctgtctggactctatttaatgcttctgggtcctacactctttcgcttcttttttttggctctggcctcctttctaaatgtgtacccctttcccagaagggactcccaggtctttctgtggctcttgttaatgagcacactgctgctgctgctgcagctgctgcagctgctgctccctccaccactccgccagcctcttcagtcattttattctccacattttctatcactagattatctttattttgtctttgagacagggtttcactgtgtcgcccaggctggagtgcagtggcatgatcatagctcactgcaacctccgcctcctgggctcaagcagtcctctcccctcagccaagcaagtagcaagggactacaggtgcaggccagtatgcccagctaatttttttttttttttgagacagaatctcgctctgttgcccaggctggagtggtgcagtggcataatcttggttcactgcaacctccgcctcccaagttcaagtgattcttctgcctcatcctcccaagcaactgggattacaggtgcccaccaccacacccagctaattttttttgttttgtttttttgagatggagtctcggtctgttgcccaggctggagtgcagtggcatgatctcagctcactgcagcctccgcctcccaggttcaagtgattcttctgccacagcctcccaagtagctgggattacaggtgtgcaccaccacgcccggctaattttgtatttgtaatagagacggggtttcaccatgttggccaggctggtctcaaactcctgacctcaggtgatccacccgcctcggcctcccaaagtgctgggattacaggcatgagccaatgtgcctggccatttttgtatttttttttagtagagatggggtttcaccatgttggccaggctggtctcaaactcctgacctcaagtgattggcccaggaaaagacaggaaaagaccacagtgagaagacagactgaagaacagggacaaggaggcagctgtcagggccagcatgtccaacaggaaaggaaccccaatgctttggcttcctaccttctggaggagactctgtggcctcttcttcatgcttcctgtactgagaacaattaatagaaccatggactgggcaaggtggctcacacctagaattccagtgctttgggaagccatggtgggaggatcgcttgaagccaggatttcaggaccagtgtgggcaacaaagtgagaccccatttctacaaaaaaaaaaaaaaaaaaaaagccacgtacctgtagtcctagtactcaggaggctgaggtgggaagatggcttgagcccaggagttctatactacattgagctatgatggcaccactgcactccagcctggccaagagtatgagaccctctctcttaaaaaaaaaaaaaaaaaacaaacaaaaacagaaccatgagctgaagtgccctttgctttcattttggagctcatacctatttccctgatcacaggttctcaacgtaaccatctatggatttgtatgcaagaatgttcttgtctgtattttcctgagaatagttacagttttcaaagatcccccacaaagggccaatagccccaacaaagaaaaggaaaaactaaaaaccagtgctttaagagaaaaaacacatcctattgaaatggctgaggctccggtatctttatactgacagagggagctaatatttagcccactgaaaccattcctgtcctgtcctgtcctgccttacactcagttacacaaggcacagcgttgcccttcctaaaaagaagaagatactgttggtcacagtcagcccactcttctacccgtggcttggtagaaagagtagtaggtgacagcttctgaccaggggcggtattactgtgctcagtatttctcctttcctgagtcaggataaataattaggaatgaacttcagagccagtaacccaatgttccagtggcactctgtctctccctgactgatgagaggcttggtcagctgcctgagtttctcagaaccctcccaaggccagcacccagctgggccacttacctgacccccttgctcgaggagtgacaggcccgttggatttctcttccaggtctttcagtttgcagtcaaagaatcacttatcctgaagctgccaacagatgagctcatgaacccctcacagaagaagaaaagaaagcacaggcaagaagggttggacaaagtgttttgttttacagccaggctgttccctgtgctctgacctccccttggagttcccatctgcctccctctttagcaaccgcacaggctgtgtgagcccatcagcttggcatcacatgactgagagccagcctcctgagtgctccctgagggtctgtgccttagatcagccctcttcttgtcccccagtgctgtggaccataactgtctgtttttctatttaagcttctggccaataggacatgagctggcctcatggctccaccctgaagccatttctccttgttggttttgttaccaccttacccatttctcaactctgatcagagtttatttatttgtttggtttgtgttgtttttctgagttacatgatagcctttacttaggttggaagtttttaaaaaaattctgcaccctggccctgttccctagtgactatcacctatcagaggaaggagctgacaccacttctagatacagaaggaaatccctgtggctcctccctttcagttctttcagagaagattcctgaaaggccttcccacctccccatcttgaaactcccccatatctccacctccacaaagacaaagggagagatttggagagaaacaatagctttataatagaccaataggcttgggctttcttttatttctgtgttgtgttcttttatgttatttgcttgtttgggaggggttgtgtttaagtttaactcttgtagcacaggccagctggatttaggatggactctagcttctgtgtaccaaagtcgtcctgttgaggggtttgggaagatactccccagtcatcaaacacagtccctcagagcaagtcacgttgtcatttacctgcatttgcagagctccctagggccgtgactgagacctgtccttcctgtctttttcagattgtgggctgcacactgcaggaagattcagctgaagaaaggtaagttctaccagggcattcttcagcagttcagctggaggcctcactctgtggtcatcaccctaccccacctccagctgcacttgttgaccctgtgccacttccgcagattgcagaattctctgcagcaactgagaacagctgagcctctcactgcaactgagaagacctcttaggaggtaacattaagggccttgtggtctgtgatttttcttttttttgagatggagcctcgctctgtcacccaggctggagtgcagtggcacaatcttggctcactgcaacctccgcctcccgggttcaagcaattctcctgcctcagcttcccaagtagctgggattacaggcatgtaccaccatgcctggctaatttttgtatttttagtagagacggggtttcaccatgttggccaggctggtctcgaactcctgacctcaaatgatccacctgcctcggcctcgcaaagtgctgggattacaggcgtgagccactgtgcctggccagtatgtgacttttctagtgtgccatttgctaggttccagacctcatttaatgtttagaatagcttccctgttgtcccagaccatctccacaccctccccacaaagcagatcaccccactgcagcttatgaacaacggtcatccctgtcttctcacttcaggtgctaaatgtgtgtccaaggagattgttaggaccagcctcctctgaatcagggcagctggacacttgggagggaagacagctggagagtatggtcacagcagcatcctcctctgttttctttcctagataactcttccacacaagtgtacaactaccaaccctgcgaccacccagaccgcccctgtgacagcacctgcccctgcatcatgactcagaatttctgtgagaagttctgccagtgcaacccagactgtaagtgtgctacgttttctgtatagtctaccaaaacagttggctccagtgtgccctaggcttgccccattcctgtgccctttactgcttatggccttctgatatcccctttgctgtgttttagggattctacaaatgaaataagtgcatgagatctgggagagtcgtttctggaaaacgtttaggttcatgattctaaaagcagcaattacacagaaatcagatactttcccaactttgtcttctaggggagaattaagaaatgtggggggcagcaggcgcagtcactcacgcctgtaatcccagcactttgggtaggcggatcacttgaggtcaggagttcaagaccagcgtggccaacttggcgaaacctcatctctactaaaaataaaaaaattaggccaggtgtggtggctcacgcctataatcccagcacttggaaggccaagtcgggcagatcacttaaggtcaggactcaagaccagcctggccaacatggtgaaccccgtctctactaagaatacaaaaattagccagacatggtggtacatgcttgtagtcccagctacttgggaggctgaggcacaagaactgcttgaacccagagggcagaggctgccagtgagccaagattgtgccactgcactccagcctgggcaacagagcaagactctgtctcaaaaagaaaagaaatgtgggactcttttttttttttttaagttacagccccagtttcccttttctgaatactgttttaaaaaattttttattcagatattttttgtttgtgattctgtgtatgtctattttcatttcatagctggagttttaatatcaggtagaagacaggggcctggatgtcagcagagacatccgggtacttatcttttacttcttatcccaccatgcccttcccaactcaaagctgagcagtttgatggcagtccccacagcttgcagaacttggtgcccaggcggttttgctggaggaaatacctcctaacccatagcagatagtgatcttagccgcagcagagaagtggttgcgctgggttgggcagtgggtggagaaggatggcatagaacggatgcattctgttctcaaaatgatacttgttttgatggtgacaatttaccagtgaaacacactgatttcatattctctggggtactctccacctcagtgggagggagaggattgttggggaatctctaggggacacttcttattagtatacctgctttttttttcattttttaaatttttttgagacaggatctcagctctgttgctcaggctggagagaagtggcacaattatggctcactgcagcctcaacctccctggctcaagccattcatccccctacatccatcaagcctgggactacaggcaggtgtcaccacacatggctatttttttttttaatttttttgtggagacaggatctccctatgttgcccagcctggttttgaactcctgggctcaggtgattctcctgccttggcctcccaaagtgctaggattacaggcatgagccaccatgcttgaccacacctgcttttttgactcgaaggcatgaatgttgggaagcactcagttttctatggacaaaacttgtgtatttgattattgggaagggagcttcctcttattttgccaaacatccttgaacacaaaaaatttacttctttgctgtcccttgagtcaaccacaagccccagtattagcttatttcccttctaagacttacctgtcttcccttcccaggtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaaggtgaggcctttcctcaggaccccacaccacataaaatggagggggaaggaaggaacggtcccaagcattctctttccactggttcttttgaggctttatatgtgaaagtgcttgataaatcctaaaagacacatatttactgaattaataaaggcttcagtcccagtagggcttagaaaaatggttcctggccaggtgtggtggctcatgcctgtaatcccagcagtttgggaggccgaggccagcggatcatgaggtcaagagttcgagaccagcctgggcaacatggtgaaaccctgtctctactaaaaatataaaaattagccaggcatggtggtgcatgcctgtaatcccagctactcagaaggctgaggtaggagaatcgcttgaacctgggaggtggaggttgcagcaagccgagatcgcaccactgcactccagcctgggacagagtgagattccatctccaaaaagagaaagaaaagtggttccttgaactggccagacaaaaaggagctgcgaggtgtatgcacctttggtgatgtctatgtttacctcacacattgcagtgaattcctatagactaaggcccaggagggctccatggataaaggaagagatatcctatttccgttcgtcaccacctcccattttcttttctctcccaagcagaaaagaatgggttagacctttttctgctttcagatcctcttaacagttgctggttctttccaccccacccccaccacacatgtgcacatccagcacacaccccctactcatgcacaccctgtagtctgagacttggccccctcttccccagcacctgctgctggccccctctgatgtggccggatggggcaccttcataaaggagtctgtgcagaagaacgaattcatttctgaatactgtggtgaggtgagtgctatagttttggcccacattcttactcgggggagactgatgagaaactctgattttctgtgggccaggcttctttgaattaatctctaaataactcagctgtgttctcacgtggcctcttggggagatcccacagaaccgtttgcagtactgaaaccactgttcaactctttggcaactccagacacaagagatgaggggggctcttttcagccttaaaactggttggcctgggtgggaattggaacagcataacttgaacttgctctcttgtgattctcatcatgatgctcagtaagcacccatgtgagataccacccagccctttctgggggcagggtaccatgccctgagcaggcagcctgatactcctatttgttatttgtctatctctctagctcatctctcaggatgaggctgatcgacgcggaaaggtctatgacaaatacatgtccagcttcctcttcaacctcaataatggtatgaagtcactttgtctcatcccaaggtggtcttttttttttttctttttttgagacggagtcttgctctgttgcccaggctagggtgcaatggtgcgatcttggctcactgtagcctctaccctctgcctcccgggttcaagtgattctcctgcctcagcctcccgagtagctgggactacaagcacctgccaccatgcccggctaatatttttgtatttttagtagagactgggtttcaccatgttggccaggctggtatcgaactcctggcctcaagtgatccacccgcctcggcctcccaaagtgctaggattacaggagtaagccaccgcacttggccccaaggtgatctttctaccagattgcccttgctgtagtccaagtttagatcagctccgaatcttccagcagatgcatagagcaagggggcaggatcacacttggggatcccacaggccacagtgcccttgctttggaagaacctccatttctgggttctgtttgtaataggagtgctgagcgtctttacctgagaaatctccctgcccagtagatgagaagatccataattcaaagagggacccaaagggagtgctcccacacaaggctgaattctgaggctgcatgctttcctctgctcctgttagcacactgggcttcaacattcccatcagactaaagtgtttctgttaccatttaactgattttaaattcaagctgagaagctgtggaattgcctgctgtgcttatggttttccttgatttactttatacagattttgtagtggatgctactcggaaaggaaacaaaattcgatttgcaaatcattcagtgaatcccaactgttatgccaaaggtgagtcccagtaacctgggaggtggggtgggggatggatgcctctttactgtgatttccattcgttgttgaacattttccttagctgagctattttttgtccaaagataatcatgattaatatctggtatcattttaggcccctctcaatcttagttttctaatctgcttttttcagcgaatacattataaacactttcccacaaacatgatttaaccagcctgagcaacatagtgagacccatctcacaaaataataataggctgggtgtggtggcttacgcctgtaatcccagcactttgggaggctgaggcaggtggatcacttgaggccaggagttcaagaccagcctagcaaacatggtgaaaccccatctctactaaaaatacaaaaatcagctggggggcgtggtggtgtgcacctgtagtcccagctactcaggtggctgaggcacaagaatcgcttgaaccctggaggcagaggttgcaatgagccaagatcatgccactgcactccagcctgggcaacagagcaagactctgtctcaaaaaacaaaacaaaacaaaacaaaaaaccccacttataataataataaagataatttttctgccataataacagatctaaaagcatagaggcaactaccatattgactactttctaattccatttgattcatgttttcactgggaatttggagaaaatcaacccagaagcctactggttattgacttggagttgggtaggaacctagcctcgggtttatcctgcttgcagtggtcatggtgaatggagaccatcggattgggatctttgccaagagggcaattcaagctggcgaagagctcttctttgattacaggtgaggtgccagtaatggtccttgggatgtggcccaggaattggaaagagtggctgttggaatagatttgggggctcagggagggtaatggagatggaggagagagtctcccggtgaataaggctgtgtcccttgttctgatatctggtgccttgcctcagaagtgggaccattgtaaacagcccttaaggagtgggaggggaagtgaaacgggaggggactccgccttttcaatcacaaaagtcatgagagtaacctggttcctcttccctgctctgggacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatcc

SEQ ID NO: 36375 - DNA, 54203 bp, Homo sapiens
ggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtactccacagcctcgccgtggccccgaccgggaccgctccctggggggcgggcggggtccgcatggggcagtggcgtcggggagagcgcggggctgcgctccctggggccaagggagtcccggaaggcccgtgaggaccctgcggtgtggggagtgcagggccgggcacgcctggacccagcctccttcactctctgccctcgggcgcaggtttgctggctgcagtgcgcggcctccgagccgtgccgggcggtcttcagggaggctgaagtgaccttggaggcgggaggcgcggagcaggagcccggccaggcgctggggaaaggtaagatcctcagggtggaaccgcagggtaggggccgcacgtgaccattttggtgtggaccgcgcgaggggtgttcgggccggggcaagggactcctggcgccacctcagttcccggggaggcgcagaacgcgcctcgggggctgggattgggggtggtggctgacggagaaggctgggcagcagagcgcctatgacatccagccccttgtccggtagccactgcttaccttgaccccctcctccgagatgccggatggctgagcccctcacccagtctcgacgtgggaagttctcccccgctggccccagcagaggaatgcgccggccacattcttcccccaacccgcgcgcaggtgtggggatgagccgtgccccgggcagcccccttcgcccctctcgggccccctttgtgaaccgtgctttgtgtctccgacagacagaccgggtctgtttcttttctccgagcttccctaccccgccccccttcttcctcggcagctggaatgcactcttaaccctgctcttcccggagggcctgcgcccttgtagcctgcctggaaactgggccctggcacacctgggctggggccatcacgtacgggaaccaccccgcccccagcgtctggggcctgggatgctaggtcactggggggagtttgagggggacagtgtcccaagctggcaggcctggggctatgggggcgatggacgggagatcaaagcacatttttgatccctcagttactcctaccccccccctccccgccccaagttcaaaaacctgagggggtgggcggtgcaacgttagtgaggagaaccagtgtgttatgagacccaggcggttggttgctggctagtggagggctttctccctctaggttaagaggacaatggatgggggctccagcaagggttgaaacctagttcttaaacgggtataaccctggatccttgggtcgggtttcagaggatccttacactgaaatttttgggaacttgagtattcatttttagggggaaggaaccgtggcttacctggccttcaaaacactgagaacccttgctacctagcattcttctaaagtctccatcaacttatccctcaccccaggcacaaactcccactgcttgaatgtggggctgtcaatgcctaggggacagagtggctctcttttatttctccaaaagaggattgaggaccttgagtctgtggaggccctttttaaaaaaattctttctgcaaataactgcagattgacaaaacaattaacacccaggctaggctaggctccttaaacccttggctgtagggagctgaggagaggcattaagaagccatgcctcataaactttaaattcttgcgcaggggtttattactggctggctaacaaactgcaactcagccaacctgtaaaaatgtgaattcgggcagggccccaaatccaattccggctccctgaggaagccttattgctaaccagacttctgccaaatctacgccccctccccccgccccattgtcaagttctctgactacagtctcccagaataggctatagccttgagtgttgtctgtaccttatctttcctactgaagcaagaaatatcagattagctgtcacttcactaggcttgaggttttggggggaagcagtgatcaggttttcgatttcatcgttgggttggcgagtgtttcccaatgacgtcaggcattttaaacctttagaggaaattcagctttctcggatgtctgctttacggttgtgaaaaacggtgggtttgcgccaggagcacacctgggttatacaacaaaggacgggttaatgcgctcggcgcaccttgaaactccctgccacacggctgggtcttagagtaggcttctggtggcatgggctgctgcttgcttttttaagtaaaagtgcatttcttggtccagttggtcccaataaattgggacttcccaacaaaacatattgctatttctccctttggtcttcagctggcactttgaccaccccacctgcaccctagttcctcatcctcaaaacatagatccccagcctggatccagccacgttgaaagggttatcctgcaggaacgtatagactctcaagtttagccaagcagacaagtttccatattgctaaggaacaatcacccctgttgttcgcccctgggttatgaatatcaagggtgtctatgaagttcagctcaaagaacttatctgatgtaattaatgccttgtttgtatgtgcatcttccccttcaaagcccttttgcaactctgagcttgctttatcctcctaacattcccttgaagcaggtgaggtaaatgttaaacaagctgagctcttaatctcagaattttgaacttcagaaaccccatagtctagccttgcctgaggttttgaaggtggagaaacagaggcacagcttaacggattggattcactaagccaaacagctcatgaacttctttgagggtgacagacacaacttttacctcctggtatatgcccagggcctggtaccttacaggatgcccagtcctgtatgaattatgaatgaatttgacaaccttgtgaagggcggcccattttatagatgaaacctacatgactgtggcttcaccaagtcatcactgcagtgatcagctgggatttgaatggaaattttggacccccaagttccctggcttttttttttttttgagatagggtatcgctctgtcacccagcccaggctagaatgcagtgatgcaatcacggttcactgcaacctctacctcctgggctctagtgatcctcctatcacagcctcccaagtagctgagaccacagacatgtgctaccatgcctggctaatttttaatgttttctagagacggggtctcactatgttgcccagactggtcacaaactctgggctcaagcaatcttcccacctcagcctcccaagcactgagatgacaggtacgatccactgtgcccagctccctggcattttttactaccagaaagcagggcctgagtggagagggtagaatgttggatccctgaatcccacagctattaataacaagctctcccggccccccaccccaagagtgcttagtcttttttttttttaattgtaggattttccagaaacattgatgtagaggaaactggtttggatttagtctctaagggcccaagtgaggggtcttgactagctcaagaggaaaggttaatctggagggaaggaaagccggcacattcccccatcccagtgccacagtctgggggccaccttccttcaagtgtggtctggaagccgacagtggagaggtgggaggagggaactttcatggtattagtgcagtgattaagtgagtgacctacagtggtctactcatccttaagggtgaacaactgagagaggcagcttaatggcagtcaaacagatgcagtccttcattatggccttcagcaggatcatctgacccacagtcagcctttgggtcagattaaaaactaaccatcagctttgggaggaagcttccaagttcaataatgcatctgactgagcacaaattaacatcaagatggttttgtctatttcagctctgggtgtaaaaactgccttttattgtggaagcccctactctggggtatgccctttatttccatttcattcttcctgtaagcatatatttcgcatctgcatagatcaggcactgttccacaacttcaactaaagcaatgaacaaaacgaagtccctgcccttggggagcttacagtctagtaatttttctttttttcttaaaaacagaggttttattccatttggtccacagtcggtgtttcacattatctcacggtgcagggcccctgggtaaggggggtccctgtgcagtacttggaggggcgtgtggccaggggagatgaagcagtatagctggtcaggcccagaaggggagatggagggctgggggctccttaaaacctactgaggggcgaggcgcggtggctcacggctgtaatcccagcactttgggaggctgaggcgggcagatcacatgaggccaggagttcaagaccagcctggccaacatggcgaaatcccgtatctactaaaaacacaaaaattagctgggtgtgatggtggtgtgcctgtaacccagttacttgggaggctgaggcaggagaatcgcttgagcccagtaagtggaggttgcagcaagccaagatcacgccactgtactccagcctgggcaacagagtgagactccgcctcaaagaaaaaaaaaaaacctgaggaccacagtagggggtagttagcatggagagggggtcaggtttagccccaacaactcagaattctgctcccttgtgcaggcctcagtttccccaccgggcccctgggcaggcctgagggtcctagagaaagccggccactcaggagcctgacatattttagcatcgtggtcaggtcccctctcctaggggactcatttcccagcaccctctccactgtccctgccccattccttggggaaaaaatatatatattttttctttttttgagacggagttttgctcttgttgcccaggctggagtgcaatggcgcagtctcggctcaccgcaacctccaccttctgggttcgagtgatttttctgcttcagcctcccaagtaactggtacaggcatgcgccacaacgcctggctaattttgtatttttagtagagacggggttttatcatgttggtcaggctggtgtcgaactcccgatctcaggtgatctgcccaccttggcctcccagagtgctgggattacaggtgtgagccaccacgcccggccatatttttattttaatatttcctgaaacttctgtgggtacagaaaccacaaactgatcggctgacaaaagggggaagaggcaaggcaactggaaaccttcggggaccagttccctccacgcccaggtctcttctccccagcacagctcagtccatagcctggacgtgccagcagggaccctcaccctacatgcttcgggatacagccttaaccccttcccccacagcctggtggcccagttctgtgaaggaaccaaggcaaggggggaatatccctgctgccacatcccatgacgccactcacagaccctcagttgattggcaacattgaacaggttaaaaaaaaaaaaaaaaagaagaggaaaacgtagaaaaacaccaaaacccagacagggagacgatgtggggagagagcgtgctgggagccttagtagctggcctcctcctggtagtaagggggatattcaggggccttccctgggcctgggcagtcgttggtgcccgagggagccctgttggccactgggccttgtgggcagtagttggaattgtatatctgccggcccaggccaaagacctggctgctctggttagcaccctgcaggtagcccatctgcagggacacggaggagttgtcatacttgttggtgcccagcttggtgtcatagatgtgcagctgggtccagggagccgtcatgcccatgtggctggcgcacttgtttgtacccatctggaggctgatggtcgagtggtccacgggggcaggatatggttcttggggctgtagagatgcctccttgtgccgtacatggtcatacccgactggcttgcacatttgttggtgcccatctgcagcccgatgacgcactggccggccttcatggtgttctagtcgaagttttgctcctgcttctttgagtacctgacactgatgtccaccccgctctgcagccccttagtcttggccttccccgccagggcaagaagagacacctgcacctgcatcatgttcccactctcaaacaggttactggcctcaaacaggtccatggggttcatgccatagctgactatggccttgatgaagttggagaggttttctagctggtgccagttctgcatggagtggttgatctaggggactgagcctggctgcagctcgttcatgagtgtgtgtaagataattctgtccttcaggccctgctggaagtcagggctgatggagaggctggtgagtccctcgatccagctgtggagctctgcctccttctgggggtcatatctggacaggagccggttcttgacctcggcggagagccagtatgaggggcccttgttgaattgcatggagaatacggctggcaggtgcggtggcaggacaggaccgactagaggtgaccaacgggccctaatttagtaattttctgtgcttatgggctgccctgcaaagcagttgttgataatttccacttagctgtaaaatgaggttgaggaagtcagtgagaggtcactggtgcaacaaacagaaggccaggaattaaaccctggtgttttgcctccacagcccagggagatatccataaatgtggctccgaggagtgaatgggaactggaccttcaagcctagcaggccgctttcctggcttagcagcagagtagggttaacttgctgaaaactctgtcctgcatcaccagtagcttgtgcctggggagcaggtctcaaacctctagtctcccttcccatttcctcatatgccactgtgttcctaggttacccagtgcagggtgctctcacctccctgctgcacaaggaaggcattgcttatgacaagcaaagagtttctagggccagaaactatacctctgcaaagcatttggaggatgatggaagaggagggaggaagggcctccccagctcccatcagttgaggctttggtcctgaggctgaacagtctccattcagagactcgatgttattgaagaataacaaatgtagacaaaagtgccgaaatgatgagtgtgcagcccgatgaacatcgcaaacttaaaacccctgtgtttctggcgcacagatcaagaaacagcattaccagagccttggatgccccctccctcctaatttcaaccttctctcaagataaccactcttctgacttctgagtaccacaggtgaatttgcctgcatttgaactttctgtaagaggatcatacaattatcttagctctggctgctttcatggcaccattgagagattcttgcgtaattctggatgtagttctagttgattctcattgtatagtatttcattatgtgactatccacaattctgctgttgatgggcatttcagtagtttccattttgtgcaaatcttctagtgacctgtgcacccctatttgttagttatacacctggggcacaattgctgggttaactgattacctgaggattccagtactgtgatcctggactgagatatcagctcctctctgttctgaagtagtgaggtgtcttctgcattctcccaccccaacagtctccctgccagaccccaccccctttccggagtcttgattttcatctggccctatgctaagagacagcaagtttttattttttaatttttcaattattttattttattttattttatttttgagacagagttttgctcttgcccaggctggagtgcaatggcgtgatcttggctcaccgcaacctccacctcccaggttcaagcgattctcctgcctcagccttcccaagtagctgggattacaggcatgcgccaccaagtccggctaattttatatttttagtagagatggggtttctccatgtgggtcaggctggtctcaaactcccgacctcaggtgatccgcctacctcggcctcccaaagtgctgggattacaggcttgagccatcgcgcccggccggcagcaagtttttattatgtgcttggcctcatcctttgtcttgggggagaaaagcttccctttctttgtccttatcctgatgcttgcttctttcctcaaaagtagaaagggaatctggaaagggccctgaatttcttttcttttcttttctttcttttttttttttttttgagacggagtctcgctctgtcgcctaggctggagtgcagtggcctgatctcggctcactgcaagctccgcctcccaggttcatgccattctcctgcctcatcctcccaagtagctgggactacaggcgcccgcaaccacgcccggctaattttttgtatttttaatagagacgggcaatttttgtatttttagtagagacgaggtttcgccatgttagccaggatggtctcgatctcctgacctcatgatccacccacctcggcctcccaaagtgcagggattacaggcgtgagtcactgctcccggccaaatgtcttgagaactttctgggtagagatttatttgttcttaatttttttttttttttttgagatggagtctcactctgttgcccaggctagggtgcagtggcacaatctcggctcattgtaaactccgcctcccggattcaagcgattctcctgcctcagcctcctgaatagctgggactacaggcatgtgccaccatgcccagctaattttttgtatttttagtagagacagggtttcaccgtgttagccaggatgatctcgatcttctgaccttgtgatctacccgccttggcctcccaaagtgctgggattacaggtgtgagccaccgcacctggcctttttcttaatttttaaattaattttttttttttttttttttttttttttttttttttttgcggctgggtgcgttggctcacgcctgtaatcccagcactttgggaggccgaggcaggcggatcacctgaggtcaagagttcgagaccagcctggccaacatggtgaaaccctgtctctactaaaaatacaaaaattagctgggcgtggtggcaggtgcctgtaatcccagctacttgggagggtgaggcaggagaatctcttaaatctgagaggtggaggttgcagtgagcggagatcgtgtcactgcactccaggctgggtgaccgagcaagactctgtctcaaaaaaaaaaaatatatatatatatatatatatttatttttaaattagaggcggccggcatgatggctcacacctgtaatcccagcactttgggaggccaaggtgggcggatcacctgaggtcaggagttcaagaccagcctggccaacatggtgaaaccctgtctctactaaaaatacaaaaattagcctggcgtggtggtgtgcgcctgtaatcctagctactcaggaggctgaggtaggagaattgcttgagcctgggaggcggaggttgcagtgagccgagattgcaccactgcattccagcctgggcaacagagcaagactccatctccaaaaataaataaatacgtaaaatagagaaggggtctgactatgttgcctgggctggccttgaacccctagcctcaagcaatcgtcttgcctcaccctcccaaagtgctaggattacaggtgtgagccactgtgcatggccctgggtggagatttttatcctgaccagtgtgtgggtgggcagcagctccttatttggccaacatgttcaaatccagctcctctcttatagaaacagtgaagtgtctgagatccaaagccaatttgaaatggtcattcagccaacaaatgtctgagtacctactaggtactagatactcagagggtaagtaaggccacagctcctaaccctcagtgaactcctgattagagttcaggtactgtttactgtcaggtactgttctaggtgctgggaattcactagtgaacaaaatgtgcaaaaatcctggcctcaaagggccacttatctgctagtatagagggacagacaaataagtacaatatatgcatatatgagattgaggaggggctgggcatggtggctcacacctgtaatcctagcactttgggaagccgaggcaggcggatcacttgaggtcaggagttcgaaaccagcctggccaacatagtgaaaccccgtctctgctaacaacaacaacaaacaaacaaacaaaataattagcctggcatggtggcaagcacctgtaatcccagcttactcaggaggctgaggcaggagaatggcttgaacccaggaggcagaggttgcagtgagctgagattaagccactccactccagcctgggcgacagagcgagacgccgtctcaaaaaaagaaaaagagattgagggggaggtgggaaaggagtgatatagagtcacataggagaggctgctgacatgttcttggagaaacctcgaggaactgatgtccaagctggcagccaaggaagaagaattaggcaagggagttgggcatgagaggtggcatagagtgttctggcagaggaacaacaccagggttccagggacttggatacattgaatctggctggatcatggagtgtgaggtggggagagccagtgaggcataggcagggtccagccccgcttgaaatttgtctcaccccataacagaggcagcaaagtgtttggggaaatcccagttgtaccagtatggagacaatggctgaagtcccagttgtaccagtatggaggccagggtctctgaagtcttccctggaaccaggatattggcccccactcccagcaacccttctcaactcccctcccgattctcagactggaggaccatgtctgcctcagttgcctttttctcatttcatttagtcacctggcattgccaacccaggcagcagggctggcaaggaagggctgtgaaaactcaccaccaccacccagataccacctaatagcttactgaattccagaatcacactatgtactttatgtaataagcccctttaatcctcctaaaagccccatgaggtgggtggaattggccccatttaactggataggaaacctcggcttgtcactttgtaactatctaaggtcacccagctaataaattgtggtgtcacattttgaacacaggtgtgaccccctaagtatgaggcactgaccatttggcaatcagggtgggaaagggaaagatatttggagtcttctggccccagccaaattagaggaagattggaaatagttaacttctgacccaagggctttgaattcctattctctccacaggcccctgctaatcgccaggagggttggggttggcaggcacttctgcccaggacctctggcctcccttttaagatatgggggaacagggagggttcagataccaggtctgagagcactcaaactgacagccctctgcagagaactgtcaccccacccccacctgcctccagcagcaaagacctcccacctcttgctctgggtagaagagcttgacagacccttcctcactcgctcctcctcccccagccaaatctgggcatcctcagggctctgggttacctagagcatcagaggtctgcaaattcctccagctgacagaattccctccaggctgcagctgcctctgtctgctggacttaagagtgttggggacctgctgcttgggcagtgaaccagaatgcctcacctggggaaagaaagccaaacgggctcggtgtgatggctggcacctgtaatcccagcactttgggaggcctaggcgggtggatcacctgagctcgggagttcgagaccagcctggccaacatggtgaaaccctgtctctactaaaaatataaaaattagccgggcatggtggcgtgtgcctgtaatcccagctactcgggaggctgaggtagaagaattgcttgaacctgggaggcagaggttgcagtgagccgagatcgcaccactgcactccagcctgggcgacagagcaagactctgtctcaaaaagccaaacgtcttcctttctccctcgaccccatctttgaactcaggactctggctctgtggctgtctaacatctgaggagagggctcagagccaaggccacagagctaggaggtgggagggctggtgggctgcctcccttcgtgagagcctctccaggtgctactgaaccccaagaggaaagatctgtttttccctaggactctgaggcatcttagggctaaatggggagatggggaatggggaggtataatcccaggccctcttcttctccttcaatctcagtagccccccttttgttgaagaccactttaaagttggaagttacctattagcaagagaccttgacaacctgtgttgtacgctaggaggagtagaaggtatttttgcttgagttcttactctagggtctcacattcgctttaggaagtcgttgatccccaggaattaaccgtgcctaagagtgcatgcgcatctttctaagaagtctcctccttcaaatttggggaccacaggtattccccatatctcccagtctttttctttcttttttttttttttttttttagagacagggtctcactatgttgcccaggctggtcttgaactcctggcctcaagtgatccacccgcctcagcaccccaaagttgggatttcctgtgtgagccatcattcctggcccccagtcattttatagagaagctagaactactgtttagagaaatgatttgcacttgggtccatttggaaattcttcagactctcgttaaacccagcagtgggaagagacctaatggtatatatcccagcacaggcaagggaaaaatggattctaagctgtttctcatcccaaatgatgtggcctgaggcgagttactgagtccaagctcctcagccttgaggccctaacttccctgtgcgtgcatgggaaatggccctggagctatgagagggcggctggctggactgctcactggccagtgagagggcccaggtggagggttcggctgctctcctgggtgtcttgctgaaggctgactgccttctgagcggcctttgcacagcgtgccccatcttgttgtaacttcaggcaggggagaaacagcaacttgtgagctctccccacacaagccaggacaggacgccaggcccacacactgccttctccctgtagagtcgcttcatccaggcttcccaccgtacttcgaaacctgctcttctcttgtcttttatggtctttttccgcttccagaagtctcctgcattcctcagctgggacttagccccacttcaactggtttatccctgcttttggcctctgagtcagtagtttgcaagcttggctggtgatcaaattgcctggggagctttttatttttttatcgtctcctccccaatgtataccattttatattgtttacatagggacggttggttggttgggatttcaaattaatacatgaaaatatgttcactgtaaagacacacttttttcaataaaaatatgtggcacttactatgtgacagataaagttcttagtactttatatgcatcagctcatttaatcctcaaacatcccttgagggaggtactattgttgtccccgttttacaggtgaggaaactgaggccagagaagttaagtaacttgcccaagatcacacagctaagtaagtagtagagctcagattcaaacctaagcagactgagcttacaccactgaactctactgcctgtcaatagaagcaagtcagaaataaacacatgaaggctggggtatggtggctcacaactgtaattctagcactgtgggaggttgaggtgggaggattgcttgaacccaggagttcgagaccagcctgggcaacatggtgagaccccggtttctacaaaaaatacaaaaattagccaggcatggtggtgcatgcctgtagtcccatctactctactcaggtggctggggcaggagaatcgcttgaacctgggagatggaggttgcagtgagccaagatcatacgactgcactgcactccagcctgggcaacagagtgagatgctgtctcaaaaaaaaaaaaaaggatcttttgagcccgggaggcagaggttgcagtgagccaagatcacaccactgtactgtagcctgggtaacagagcaagaccctgtcttcaaaaaaaaccaaaaaataaataaagagaaaaagaaataaacacgtgaaatttcttccccagttctactctcttaagggcaagcacacagttactgattttataagaatccttgtagaccctttttttttttttttgcacaaaaaacttatgtatgcatacaggaattttaaaaacaagaattggactatatcatgcatacaaatgttactctgcagctcgctttttaacttagaatcacaggcatctttccagactgttaaatacacatctatcttgtttttaatagcgccgtagtcttttacatggtgaatgtaccatgatttatttagccagtcttctacttttatcttttacagatgtggtgtagggaagagttaacatcaaaattgtgaagtgtttggatttttagcaatctaactatcagtaattgccttattaggaaagactgctgtagaaagatgatcgagtgaactgttcatcttaacatcatccagataaattgagctttcatgtttaaacaatacctttaatacagactctgctgtaaacttaaggttactataccatttaaaaatagttttcatactaacttttgttttatgactatctaaataatagtcaatagtttcaaaagcatatgaattcaccaaaaatcaaaaacttttaaattgcatgactcagaagtaaactaccacattcattcacactagcattattttccctgggtgttgagagattgagaatgtgtcatcagtcaattcaaagtgcatttttttctcaagtttttctttagatttcaaaatctagttagcaagcattttgctgaataaaagttgatttccagtcttaaagcagacactcatttctgttcttattttccccccaagaggagcttatgagtttttttcttaaactcaaatattgctgcactaaagcctaggacagggtggttgcatttatataaaggatgcattcttgaaaaccacaaataggctgggcgctggggctcatgcctgtaatcccagcactctgggaggccgaggccggcagatcacgaggtcaggagatcgagactatcctggctaacacagtgaaaccccgtctctactaaaaaacacaaaaaattagccgggcgtagtggcaggcgcctgtagtcccagctatttgggaggctgaggcaggagaatggcgtgaacccgggaggcagagcttgcagtgagccgagatcccgccactgcaccccagcactccagcctgggcaacagagcaagactccgtctcaaaaaaaaaaaaaaaagaagaaaattacaaataattcataattcccatgattcaagacttatattctcatatgaatacatgtgaagtgtatgtatggggtggaggggccaaggggatgcttacaattcactactctccagctttgaaattatgtaacttaaaacttttaatttgggggatttgcatttcttcacactttacataaaaagcaaaactaatatttatggcaccatttcaaatttctgcagttgaagtttgcatgaaatatatctgtattataatgtatagagtgcctgaattggggtcccagagccactgtgtctgggttgaatctgtccacttactacttgtggaaccttggggcaagttacttaacctctgtgcctcagttttctcatctgtaaaatgaatataataatggggatctcatatggttatggtgaagattaaatgagtttgtgtatgaaacggcatgtagtgagtacatcaatgttaagtgccagtggcaggaggaatagcagtattgttatagctggaatagtttgtatacatatttctttagactagatttctgcaagtgaaattgttgggtcatgtgactttcatagttcattcaacaattatcaaacacctactttgtactgggcacagtgctaaatgctgggagacagtgagaagcaaattctagtgggggagataggcaattaaataatcactagtaactttttttgtttattttggagatggcgtcttactctgtatcctaggctggaattcaatggcgcgatctcagctcgctgcaacctccgcctcccgggttcaagctattctcctgcctcagcctcccaagtagctggaattataggcacctgccagcacacctggctaatttttttgtgtttttagtagagatggggtttcgccatgttggccaggctggtagtgaactcctgacctcaggtgatctgcccgtctcagcctcccaaagtgctgggattacaggcgtgagccacggcgcccagccaatcactactaaacatataatcacaagttgtaataaattctatggaggaaagttattcaaagccagaagggtttttcactggggaatctgatctagtttgggagggttgagggaaatttccctgaaaaagtaactgttgaattgggatctgaaagatgtcaggagttaactgtgtaaaatcgggatgggaatgcaaggagacactgttccagacagagggagtagtgtgtgcaaaggccctgtggtagggggttatgctgtatttaagaagaggctcaatgtggctagagagagagattggcacattaaagagtttgttttttaggacatggtgacatgcacctttagtcccaccacttggggaggcagaggcaggaggatcacttgagcctaggaggtctaggctgtagtgcatgatgactgcatttgtaaacagtcactgctctccagcctggaccatatagtaagaccttgtccctttaaaaaagatatttttggctgggtgcagtggctcacgtctgtaatcccagcactttgggaggctgaagccagccttttttttttttttttttttggagatggagtcttgctctgtcgcccaggctagagtgcggtggcacgatctcactgcaagaagctccacctccgggttcacaccattctcctgcctcagcctcccgagtagctggaactacaggcacccgccaccacgcccggctaattttttttgtatttttagtagagacggagtttcaccgcattagccaggatggtctcgatctcctgacctcgtgatccacctgcctcagcctcccaaagtgctgggattacaggtgtgagccaccgttcccggaggctggtggattttttaaagttttttttttttttttttttttttgagacagtcttgctctgtcacccaggctggagtgcagtggcgtgatcttggctcactgcacactccgcctcctgggttcaagctattctcctgctttagcctcccttatagctgggactacaggtgcctgccaccacacccagctaatttttgtattagtacagacggagtttcaccatgttgaccaggctggtctcaaactcctgacctcatggtgatccacctgcctcggcctcccaaagtgctaggattacaggcatgagccactgtccccagccagattgttttttatcccaggaacaaaggcatatcactgagtttcaaataggaaagtgactttttttttttttttctgagacggagtcttgctcagtcacccaggctggagtgcagtggcacgatctcagctcactgcaacctccgtctctgcctcccgggttcacgccattctcctgcctcagcctcccaagtagctgggactacagatgcccgccatgatgcccggctaactttttttttgtatttttagtagagacggtgtttcaccacgttagccaggatggtctcgatctcctgaccccgagatccacccgcctcggcctcccaaagtgctgggattacaggcgtgagccaccacgcctggccgaaagtgaccttatttcatttttttcaaatgtactatgctgttgcatttttaagagattcatctttttaaatggagatttttgcacccatttatactaaagatgatgttgtatgcactaaggtggtgggggtagagatggaaggggcctaagtcttggtgggtgatagtctgggaagggaagctctaagggagaaatggtcaaggaagaagcagctgctagctaaaccatatgccaggcattatgctaagtattttttttaatcagatattttattttttattttattttattttattatactttaagttttagggtacatgtgcacaatgtgcaggttagttacatatgtatacatgtgccatgctggtgtgctgcacccattaactcgtcatttagctttaggtatatctcctaaagctatccctcccccctcccccactatgctaagtattaactcattcaactgaggtagatattagcattattcccatttcatagctgaggaaacaggcccagagaggttagccaacttgcccaaagtcagtgtgggcctggtaattgagcccaggcactctggctccagactctgggctgcttctgatgcccggattctgttctcaagctgagtacatgatatgctattccctgggggagaatgctggaaaaagaccatatttgggttaagtaaagatcgtgaatttaagttttgacatactgatttcaggatatcttgaaagcatccaaaagagatactgaatagacagatataacttttggtcagaggaaggatctggatatttaaatttttgatatgtggtctgaagtgccatcaaaagccataccaatttaccttctcatgagaaataaatgagagaatcaagaactttaaaaaaaagcaacaaactgctttccccagatgcacttccagaagctgactcagtagaagtgataggtgggcggtcggcagggaatctggattttttaaattgtttgccagatgattctatcagctatgtttgggaatcactgctctgtgacaacattaagccctctttgaagagctaaatgtatagaaaggaacaaactggtgagatgtgaatgaaagaagcatagcattttattgatattattattattattttgagacagggtctctctctgttgcccaggctggagtgcatggtgtgatcacgactcactgcagccttgatctcccaggctcaggtgatcctcccacctcagcctctcaagtagctgggaccacaggcatgcactatcactcccagctaattttggtagagatggggtttcgccatgttgcccaggctggtctcaaactcctggacttaagtgacccacccgccttggcctcccaaagtgctagaattacaggcatgagccactgtgcctagctgcatggcatttgggatttaatttcctatgcttgcctctatggcagttgatcctatttttaaactttctgcttatcttaggattctgaatggccttcaccttcctgtccttctgtgttgctttttaaatcactgcccctggtttttaatactttattgtgctttttaaagcacaacacagctgggcacagtggctcatgcctgtaatcccagcactttgggaggctgaggcgggcagatcatgaggtcaggagattgagaccagcctggctaacatggtgaaacctcacgtctacaaaagatacaaaaaattagccgggtgtggtggcatgtgcctgtagtcccagctactcgggaggctgaggcaggagaatcacttgaaactgggaggttcaagtgagccgagatcatgccactgcactgcagcctgggtgacagcgttagcctctgtctcaaaaaataataaataaataaatataaagcacaacacatcatatttgaccctaacaagcacctgggggtgtgtgtgtgtgtgtattcccattttagagactggaaattaagcagcaataaatggcttacatttattgagtacttactgttaaacagtttagagattaagtgattgacgcaaggctgcagagccagtacacagcacttttacctaccagacccttaattgttaccacagctgtctcaggttgatcactgggatctttgttctggcatggtccttgaggatggtagccagtgagccagacagcacacctcatgctgagtcagccgcgttccaaactctcagagtgcctagtttgggtttcactctgggagggaagactcacctcctaagggttatgaggaacttgatgaacacagcagagctttcgtcagccaaaactcccctggaactgctttctccaccctcaacgacatggggttgccatataatttttctagtcgggggaaaaactcacatcaaattctgattgaaaatcaaatacatgtttactgtggaaaaactggaaggcaaaatgggggcctaccacccatacgggacctttgtcttttcaaaggaatatttgaaatcaatcatccatttcccaatctttccacctgagtctttgttgagggtatctgatctgaggcagagggcccgagtctgaatgatttcaccactcactctccaggcttgcctccccagtatcccagcttcctcttctgcttggctgggtcagagaagggctgcaagctgaggccctcacacaccccgtcagccctatctgtgagaagatccaggtccagggggcctgtgtatagatgggtgccatccgccaggtgtaactgcactccacctgggttctgttgccctccaagagctgctctgcttacagctctggggaaaaaggcctggacacccaataggtgcacccagggctctggcaggcccttgcagagctgccccaagcttgctaggcaagggcaatgggcctcccagcatgcccaggggtgggtcccaagtgaatccaggagccccaaggcctcttgggatcccagcatgtgcagcctcttccccccaccccactttgctgccctatgacctctcccgtgggtctcctcaaaacgggtctggctcactggccaccatcttggttttcttgtgcgtggaaaatacttggtgacggagagaggcagaccacagccttggcaccagggctcagcccctctctctctcttctttttggtacaagaataaaactataaatattttatataataattgtcagccttatgctataaatggctttatgacctgcttttttcccccctctgcaaaatactttttcctgggtaggttttcttttatagtatttaaggctgtagattaggcatttgggtgactgtggcacagcataattaactgttctgttgagagttaggttgttgagacctttttttgctttttttccctattaagcaagtcacgaacatcctggcaggtatggttttgtcacatctgggatggtatcttggcacaattcctgggtcaatgggcttgtttaaggcattttaatttgccagaaaggttgtgccagttaatattcccccacccctagcaatatatagcagcacccggttcccaactgtgacacagcacttgcccttttaatttgtatttcttagttggtgaacttttttctatatgtagttttacttaggaaaaatgccagaatctttcttcaagtcacttccacctacttttccccggtgccctcttatcccaatcccttaacagaaggtagtgatagctataaggacaaatttgtttgttttgtgagctaggtatgtccctaaagcaagctagaatagaaatttcctaggcaatctcttcccccaactccccaggctgccttttggccacaatatgtttaagatgatgttttccttttcctctagtcaaaatacccagagatcagtagggaaattggtggagagtgatcacttgatggacattttgtctacggaaagatgggtggttttattttgccagaacatccagtaatgttggacatcaggaccagatagcacctccaggaagagacaagctcctgaccttcaagggtattcccttgggagtatggaggtgtctaggcaaattccaacctaaaagcaggcctggaacataagaggaatgagttcttagcccagcatccatcaattcttataagtctatttaaaaagctttcttttcccaatagctctagtaccccagggaccaaactcttcttgcccaagttttattagtggcgccagttcaggacccgaggccaggcttggcaggatgatctttagagaggagctttgaacataggccagagactcctggtttccattggatgtcttctatcgagtgcagatacatagagctctggcttttttgttgttaatttctctttttatttatttttacctataatgtgtcctatgatattaattgttaatttctctagaagcagcctcaggttactgattccctttttcccttccccgacagtattttagggaatgtacatttaggctcagtgctaaaagctgtccatttatattggtagagcaggcacctcttcatcaggttcattgaccttgtaattcagaatccttgtgggagaaactgaggctaatgcggtcaaatgactgtctgaagccctggatgggtgtggaagaaagagctatgtttaggctttcattttccagccttaaattctgaactattgccccatgtgctcatcatcaagttgccccagaaagagtttgatgcaagcccattcatgcccccgtgatttggccaagatgtgtggccttgtggaaccatgctgcagttaggaacaggagtcagtttacttcgctgactattaaaagatggggtaaaggagggatgagtgatgatgagacctggtttcgtatcagtttcattatgaaactagtgatacaagccagtggtgccaggaagcatctgggaggaaattgtaatgatctgccccagggcttaccatttactatgtcttgactcatagcttgcagagaagactactcatgttcctacatgtgcctagcaagtttccctagaaaggccagctttttcatgaaatctccgtcttctgcttcctctggtaaaccacagaggacccctacaaaacagccctctccaaatgcagactgagccagttccctattgtgccctctggtcccatgtgtcaccatctttgatcagcttcatccgttgagtaaagcatacagctgtagctaacttcttcccactttgagagagaatttttcgatggtatacatagaaagaggccaggatgtggatgtcagaagcctaggttaattgtaagtagtctaaggtacctttttattgagagcttaccttacttactctgggccaggcacagtattcagtgctgtttgaacactatcccatttaatcttcctaataacctgatgaggtaggtattgtttcattttccagatgaggaaactgagcttctatataatcatacaatttgcccaatcatgtgatagataagtgacattatagggattggaatccaagtcttctggactccaaatttcgtattcttcattatttccctgccttcaggatttgaaacctgatcttgctgcttcctggggcagttcaacccctggcagcctcttgtttcctgagttgtcagattgggagaagtaataccacattgcaggttattttgtgaggatttgggtaggaaaacacttagctgggtatcctgagcagagtgggtgtttgaagcttattcctatcagtctggaccattgccccttggttgtgctctgtacccaactcaaagcagtttagagctgatggggccagctcctcagatgtatctggaatatgcaccctgagtgggaggcacatacacctataatacatgaccgttggcttccccttgattattgacactgtcccttctacaaatagatgcacagcccagatactgtgctacaaatatgtggaaccatgtaacagtggaaatatgccagaagacagggtagtagagtgagttgtacactctagtgggaagcagattttgtagacagcgggaagaggatttctagctcctggtggggtggcggggggggtgggcggtagcagctctcagagttttggggattaagtcttctgagtagtaggggagtcaatccattagcctccttctgggttacctggtgggagaggattggagtcattgagtctctccttaaaggaaataattgacagaattgtctggttagccctttactggctaaagatcttcccttaggaagagggctgttttaggattgagaaaagtggccaggcacagtggctcatgcctgtaatcccagcaccctgggaggccaaggtgggagggtcacttgtgcccaggagttctagaccagcctgggaaacagcaagaccctgtatctaccaaaaaaataaaagtgacctttagtcactcactttgggaggccaaggtgggtggatcacttgagtttgagaccagcctgaccaacatagtgaaaccctgtctctactaaaaatacaaaaaattagccgggcctggtggcgggcgcctgtagtcccagctactcgggaggctgaggcaggagaatgacgtgaacctagaaggcggagcttgcagtgagccgagattgcgccactgcactccagcctgggcaacagagcaagactctgtctcaaaaaaaaaaaaaaaaaaaaagaacatcattagtacttaagtagttcttgaatgaatgctgcattgacgaacctggctttagaacctgaccaccctgggttctcattctaattccaagctgttcgacctttggctagtcatctcaccgccaccacccctcacccccagccctagtttcctcatgtggtaaatggtgggtaatggtctgtaaggttctgggggtctacacattcccggttggggtttatttttcttgaaatggttttgctctgtctccagctggggtgcagtggcaagagcatggatccctgtaacctcgacctcctgggctcaaggtatcttcccacctcagttacctaagcagctgggactacatcatggtttggagtttcaacttgtacgttactcatgatggttctgtgaagtgtaatatccatcttccaaatgagaaagcataaatacctaataagttaattcaagttctacatcagcagtgatatttccaattaatggattcttgagggactttcacagggtcttcagcccagctttaaataatactgaatcagcctggcacagtggctcatgcctgtaatcccagcactttgggaggccaaagcgggtggatcgcttgaggccaggagttcgagaccaccctggccaacatggtgaaaccctgtctctactaagaatacaaaaattagctgggcgtggtggtgcactcctgtagtcccagctactcaagaggctgaggcaagagaatcgcttgagcccgggaggtggaggttgcagtaagctgagattacaccactgcactccagcctgagtaacagagcgagactgtgtctcaaaaaaacaaaaacaaaaaagtagtacataaatattatctattaatagtaatttagaaggggagggattttagattgatgtactttttttttttttttttaagagacagggtctagctatattggccaggctggactcaaactcctgggctcaagcaatctgcccacctcagcctcccaagtagctggtactacaggtgcctgccaccatgcccagctgagatttgatgcccacttgctaggtttgccataacaaagtgccaggtactggggtggcttaaataacagaaatttattttcttatagttctggcttgtagatggacaacttctccctgtggcttcacatagtcttccctctgtaactacctgtgtccaaaccaaacttcttcctcttctaaagataccagtcatgctggattagggcctagcctaatgagttcattttacctttttttttttttttttttgagatggatcttgctctgttgtccaggctggagtgaggtggtgcgatctcggcttactgcaacctctgtctcctgggttcaagcgattctcctgcctcagcctcccgggtagctgggactacaggcgcaggccaccatgcccagctaatttctgtatttttagtagagacgggattttactatgttggccaggctgatctcaaactcctgacctcaggtgatccgcccatcttgccctccgaaagtcctgggattacaggcgtgagataccatgcctggctgacttcattttaccttaattacctctttaaggtccctgtcttcacatttaatggccattttaggtaccagtggttaggacttcaacataagaattttggagggacacaactcgtgttaagggaaaacttggacctgcagaaaaattgagaaaataagttgccaacaggtagtcatggccaaatggttattgcagtgaacttgaaaataagtttctgtaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaataaataaataaaaaataaaaaaaaaagaaaataagtttctgatgaccttcatcattgggaaaggtcatttcagtcatttttctgtgcatagttacatgtattatatagtagttctgcattcttattttgttttactatcatagtataagaacttccctatataaagtgttatattgcatagctggataaataacctatggagtaagtgcccccatagattatttgacttttgccctatattgaagatgatttaacctttgccacattatcgttcctggtccttctagcactaaggcaaagcactcatcttctgaggacagaagatgagtctacaaagctgtgtgctggcaataaagggcagggccacctggggatcgtgtggcccctgggaccctctggaactgaatcaggcccagatctcctttccccttcctcccactggccaagcacgtcacagcccagcactcctcggcggggatgtcgtcaaggaggcagggctggttcctaagcgatcttctctttcttgtgatcacattccagccttcccacagaggatccttctgtgtgtggtaagcttttgggctctgaggcagctctttagggtccccaagcccctctgtcctctcccattcactgagtccactgcctaaaagatggccagtgtcttaacttcctttgcctggatgagttttgcctggttttgaacttcctgttagtggaatcttgcatatgtcctctcatatctggcttctactactcaaccttatgtttgttaaatttcccatgtagttgcctgtccttgtgcttcattcacttcattatgtgaatatacccagtgtttctacccattctccctcattgtttgggccgattctggcttagctattatgaatagtgctgttatgaacattataatacataggttttggcaaatgtatttttgttgggtctgtacatcacagtggactttctgggtcttagggaattaatatatcaatatgtactgccaaattgttttccaaagtgattgtcttcccatatcagacttttgtttgtgtgtgtgttaaaataggcataacataaaatgtaccatttcaaccatttttaagtaaataattcagtagcactaagtacatccacagtttgtgcaacatcgccattatctatctcccgaactttttcatcatccccaacagaaactctgtactcattaggcattaggtagtagttcccctcccctctctctctctctagcccctggtcaattccttttttttttttcttagagaaaagggtcttgctggagtacagtggcgcagtcatggctcactgcagcttcaaactcatgggctcaaatgatcctcccacttcagcctcccaagttgctggaacaggtgcataccaccatgcccagatgattttcaaaaaattcgtatagaggccgggtgcagtggctcactcctgtaatcccagcactttgggaggccaggcgggtggattgcttgaggccaggagttcgagaccagcctggccaacatggtgaaaccccatctctactaaaaatactaaaattagctgggcatggtggtgcacacctgtaggcccagctactcgggaggctgaggcatgagaatcgcttgaacctaggaggtggaggttgcggtgagccactgtaccatagcctgggcaagagagtgagactccatctcagaaaaaaaaaaagattcatctcttgatggacacttgggttgtttctaccttttgactattatgaataacactgctgtaaaaatgaatgcataagtatctgtttgaatccttttggttctttcaggtatatacctaggcattgaattgctaggtcatgtggtaattctacatttaacacgttgaggaactgccaaactgttttccacagtggctgcatcatttcacattcccaccagcagtgtacgacaattccaatttccctctatccttgccaacacttgttgttttcttttttttcttttatagccatcctagtgcatgtgaagtggtatctcattgtgattttgatttgcatttccctattaactaatgatattgagcatcttttcatgtgcttattggccattgtgtatcttctctggagaaaggttttttcaagtcctttgcctgttttttaaaattgggttttgttgttgttgagttttatgaattctttacatattctggatattaatcgtttaggattcttctttttcggccaggcatggtggctcgtatctgtaatcccagtgctttgggaagccaaggcaagagaagtgcttgagcccaggagttcgagaccagctggggcaacaaagtgaggccccatctctacaaaaaattaaggaaaattagccgggtatggtggcatgcgtctgtggtcccagccacacaggaggctgaggcaggagaaccccttgagcctgggaggttgaggctgtagtgagttatgattgcactgctgcattccagcctaagtgacagagtgataccctgtctcaaaaaaaagaattctacttttttatattgtgctcttatatactatgtgaatactttgtcatgtccatattactttcattattttaaaaacctcatctgggccggatgcagtggctcacgcctgtaatcccagcattctgggaggccgaggcggtcagatcacaaggtcaggagttcgagaccagcctggtcaatatggtgaaaccccatctctactaaaaatacaaaaattagctaggcatggtggtgcgtgcctatagtctcagctagtcgggaggctgaggcagaagaatcacttgaacctgggaggtggaggttgcagtgagccgagatcatgccactgcactccagcctgggtgacagagtgagactctgtttccaaaaaataaaaaaagtaaaaattgaaagaaaaaaaaaaccctcatctgttatcctttcttattttaaggaaaggtatttttaaaccaaaataataataatctgaaactaaaagacaggctttctgaaaggacagtttgtgccctcgcctgacatacctatggacaggcgtggggccgtccttgtggtctttgttatgttgcagcctagcaaaaatgggagcactgggcagagcatggtgctgacaggacccagggtatagcccctggcagattccctgatttcttgcgttggccataaggaagagtaggtaacaacgttggttgtgaatattctctagtgtgtgtcttggagtcgggtagacctggcttctgaacctcagttttctaatctttggaaaggcggctgggcgcggtggctcatgcctgtaatcccagcactttgggagaccgaggcgggtggatcacaaggtcaggagttcaagaccagcctggccaacatggggaaacccaatctctactaaaaaacaaaaattagctgggcatggtggcgcacgcctgtaaccccagctactcaggaggttgaggcgggagaatcacttgaacccaggaggtggaggttgctttgagctgagattgtgccactacactccagcctggtgacagagcaagactctgcctcgaaaaaaaaaaaaaagaaaagaaaaaaaagtgggggataatacctaccttggtatcatagttatagggatgaaattcacctccagctggtgaatggtggttactaactcggagtgcttgtttaaagagtagccaagcattggggattcagaaggagcgaaatgaactgaaacaaccaaaggttgtccaggtgatcctgtgggcatatatattgtgtgtaaatagactctcacagccttcagaaaatcttctgcctctagctatgaccttagtcaaccccatgtcacatgaggccacctggggctaatgtccatgaatgtctatgatcttggtcctctgggaccaagaacaaagaagagtttgacccacaaactgaccaccaggcgatcttccctctcgaaaccaaacttggaagcctcctctgaaacttgtattagtcacactcctggtcagagaaagtaagccaagtctcccttctgcagccacttagcagtcctggatccagtcagaggactcttgtcagtcttgttttcctggggcaacttccagaatactcctgccttcctaatgctctctcttccccttccccacagtattcatgggctgccctgggcaagagccagctctgtttagcactgataatgatgacttcactgtgcggaatggcgagacagtccaggtaaaataccatgtccacctgcaggacaaaagaaagatgttctctgtgcatgcccaaattgctggccaggagcccttggttgctgtggccattgtgagccaagtcagcccttcagaggaggtagtgttagtcctcagctgtccacagcttgggtgtgagcactgatctaaggggggtagtgcttgcagctacccaacagtggtgcctgaggtcaggccagtggagccaagagctgccttgtgagtaatcacccactgtactgagtccctcggattccctctcccaccttcctttacttccttcccttatcatccatgttaaccccaactgaaagcagctctaaatgcaggcctgccaatcccatgagcctccaggaagatacatctggggtgcttggccacacttcgttttaatttttgaatagctaatatagccacatggttcaaaaataaaaaataataataagctatacaataaataatctccccttgtttgcctccatttgcccaaagcccccttcaccccttcacgcagttaaccactgttcccagtttctttccttccagagtttatatatagtctatacttacatgtgttacatatttatttatattgtacatgtttttacatgttacctatttcgtatatatacatatataaaaacagattcttttccttatgcaaaagctaagatgctgttcacatgtctgcacctttctttttctacttaacagtgtatcagcacagcacaatgtctaccctctttccacagatagccactattagtttttttctgtattctccctgacttcatccatgtacaagaaaatatgactatatggtcttatttcctacccttttacacaaaaggtggaacagtacctggcacatattaagcacaatgtgtttgttaaataaaatgctaaactctattaagctgccctataccttaatctttccatttgacagcataaatcaaaaatcaggccgaatgcggtggctcacgcgtgtaatcccagcactttgggaggccgaggcgggtggcttgcttgaggtcaggagttcgagaccagcctggccaatatggtgaaactctgtctctactaaaaatacaaaaattagctgggcgtggtggcagatgcctgtaatcccagctactcaggaggctgaggcaggagaatcacttgaacctgggaggcagaggttgcagtgagctgagatcgtgccactgcactccagcctgggtggcagagcgagactccgtctcaaaaaaaggaaaagaaagaaaaaaagatctttcccttttggcacatagagagcatactcattcttatttttagagctgcatagtattccactagatggatgtgctgtagtatatttcactggtcctcctgtataagtaaacaccgagtttcccttgcaataggctcatctaggtctcctcacccttaacttttttttttttttaatttaacttagggtctcgctatcttgcccaggctgctctggaactcctgggctcaagtgaccctcccaaagtactgggattataggcgtgagctaccatgcccagccacccttttaactcttataggtgagaggatgttgagcatgtcccagctatttgcacatctgggttaaggagtttctctccttgcaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcaggtacgactgtgccttctcctgggaagcattggtggctccagggacccccatccaaaggcctgcatgagatttcttgctactgaatgtgggggctgagacagaaaaacctctcctgttcagtgagcagattctcctatggcagtgcccctcttcacagaggactctttgtcacagtcatgggatatttgttactttgtcagctgccattttcttttccctccagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgaggcaagtagcctttagtgtctactgtaaatgtcccctcagaagtgggatcctaggcctggtgaggtgggtggcaccgggctgaccccagagctgtgtaccccacagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtaagaggactgggaaggggactgctacggggctgggcccacacccttaaatgctaaaagatcccaccatacctgatttccttggctgtgtatcagattacttgggatcttcttaaaaatccagatttccccccttccatcccaaggttcctgaataagaatgatcctagagcagagctctggaatctgtatatttgaaattttccctaaagcttcagatgatcagccaagcttgggaaccactagctttggagcttcaaagacctagatttgaatcttggctttgccctctttaccggctgtgatcctgggcatattcttgacctctgagcctcacttctcacatctaaaaatgggaataatatcaactttgaagagtggtgaagattagaaataccatgtgcagactgttaggtaatacagagcgcctaatgcgaagctcttgagagcatggcagccacagggaatgcagcaaagactggagtgttagaacatggctgatggaggctgggcgcggtggcccacgcctggaaccctagaacttcaggagcctaggcaggcacatcacttgagatcaggagtttaagaccagctgggccaacatggtgaaatcctatctctactaaaaatattaaaaaattagccgggcgtggtggcgggcacttgtaatcccagccactcaggaggctgaggcaggagaatcacttgaacccaggaggcagaggttgcagtgagtcgagatcacaccattgcactccagcctgggtgatagagtgagacttcatctcaaaaaaaaaaaaaaaaaaaaaaaagaaaagaaaaaaagagttccagaagtagacagggctggagttggaactgggaggaaaagatactcatcccttctctccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaagtgagtggcccttagggaaagtactgcctacccagacttgcccaggctgggaactgactctgagagcagaagctcctatccctgcccacaaagcccaaggcagaacagtgaggacccacgtcagctgggatggccactgctgggttcacatgccatgcccctggttccttgggcctgtggcccgctgccagccaatctcgttaaatctcctccagggctgggaggcagctgtaaaatgcctacttttggtattttctgtaggttttctcatttcctctcagagtggctcacttagtgtgcacattacccaaattggtcccttatgtgccacaaagtagaattagctccatggatactggatttgctgcctgtttcctaattgatacctttatccaaatcctcactcaaaactctttttctgaggccaggcacagtggctcacgcatgtaatctcagcactttgggaggccaaggcgggaggatcacttgaggtcaagagttcaagaccagcctggccaacatggtgaaaccctgtctctactaaaaatacaaaaattagctgggcgtggtggcaggcacctgtaatcccagctacttgggaggctgaggcaggagaatcacttgaacctgggaggtggagtttgcagtgagccaagatcacgccactacactgcaacctgggcgacagggcaagatcctgtctcaaaaacaaaagcaagactcattctggagcagttaagggtcagggggcgatgccaaggcttccctaggacaggcccaggagaactatttggatcactcgttccctctccaacagcatcctctgcttctgttctcctggcagtgggtgaggggtggtcaaggagtcagcgttatgatagggagagatcctcctctccatccacacacccatgagccagtgcttcctggaggtcaggggagggacccttcagattaaactcacaatgggcttcccctctcctttctccccagaaagtccctgagtacacactgaccatccaggccacagacatggatggggacggctccaccaccacggcagtggcagtagtggagatccttgatgccaatgacaatgctcccatgtttgacccccagaaggtaatgccccttcctcactcagtccctcatcagataatgaaggaccaaagtttgcctttctcaggaaactggaaccagtctatattgcttcaaatgccagtctcagcactatggctgtgtgaccttaggaaaactacctaacctctctgtgccccatttcctaatctgtgaaaaggagataatgataatacctgctgcattgttctgagtttcaaatgaaataatctatgtacgtttcctaacacgatgccctaaaagaagtgcttgatatgaaaatctttgttgatttgaaaacatattttccttgtacctacacctgcccatcttttcccagtgaatgcttgtgtacctccaaggcagaggactcagtgccaatcaaggtgccaattacatcctcccccttccatctttagacaactctgaacgttaattaggtctgaataaaaatttgtaatgacgccaggggcggtggctcacacctgtaatcccagcactttgggaggccaaggcgggcagaacacttttgaggccaggagttcaagacgaacctggccaatatggcgaaaccccgtctctactaaaaatacaaaaattaaccaggtgcagtggcatacacctgtagtcccagctacttgggaagctgagacatgaggatcgcttgagcttgggaggtggaggttgcagtgagccgagatcacaccactgcactccagcctgagcggcagactgagactgtctaaaaaaataaaataaaaataaataaataaattttttgttccgagcaactgattttccagtctttgtcacatgtcccagaacctccaaaaaatttctgttcagtgccccagcccattcaggcacctagcccttcttgccaccttccttattcctttctgatctcagctggatagatagctacacgtggcaggggcttgggcatgcaaacccgtgagatttctggaacatcaggcccctgcgtgtagggaaagcaggcacaggattggtgtggtctgtgccagcagctgtgaggctgctgctggggacatcctgccgctgtgtataccctgaaaccccgcaaagtgggtgggtggtccaggaaagggtaaaggcatggggatcccctgaggttggatggaggcttctcagcctctggagtaggacagtcattctctgctctgatagtgctgtgcttctcacactgacagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaaggtgagtcagttcgggcctcagacaatggctatacctggggcagtcaggtctgcagccttcaggatgaggagccactgtctaccgtgggctagtccaggaatcgtaccagcccagtggctcccaacactgttctaccactcttgtgttgggaagtccctttgttcaaactaaatcttacccaggagcccacttcataaataggtaagagtcactgattaattgaagcacatcagtggagcctcctcccagaccacagtgtccaatggctgccccgaatcagtctcacatagagagtccatcttattgaaatccatgttgactttgcatttactctaaaactcatgtctaggtgtttagataataaaatgttttgaatcactgaggcacactcttgcctctcaaaaagtctcttttttgtgtgtatgtatttttgtttttattggggtataggacgtgggttgggtcaaaaagtctgaataaggctgggcgcagtggctcacacttattcccagcactttaggaggctgaggtgggaggatcacttgaggccaggagtttcagatgagcctggtgaacatagcaagatcccatcagcactaaaaaagaaaaaaatgaagatgggcctaatcttgcatcagtttcttttacttcctggtttactatgaagaatggtgtggtttgagaagcagggtataaaatattgtatgaaataatatattttaaagactggggtttgctgtcctgttttctgcaacaaatactttgtaatgccacttcgacattgttaaatgatgtgaaatgaagttcatttataatataactaacctaactcattatttctaaaaatagagaatgtcctaactaaaataaagaaaaaatccagaccgggtgctgtggctcacgcctgtaatcccagcactttgggaggccgaggtgggtggatcacgaggtcaggagaccgagaccatcctggctaacatggtgaaaccccgtctctactaaaaatacaaaaaaattagctgggcgtggtggcaggcgcctgtagtcccagctacttgggaggctgaggcaggagaatggcgtgaacccgggaggtggagcttgcagtgagccgagatcgcaccactggactccagcctgggtgacagagcaagactctgtctcaaaaaaaaaaaaaaaaaaaaaaaaaaaaagaaaatccagcctggacaacatggagaaaaaaaaaaaaaaagaaaatccagcctggacaacatggagaaatcccgtctacgctaaaagtataaaaaattcgctggggccgggcacgattgctcatgcctgtaatcctagcactttgggaggccgaggcagacagatcacctgaggttgggagttcgagaccagcctggccatcgtggtgaaacccgtctctactaaaaatacaaaaattagctgggcgtggtggcacatgcctgtagtcccagctactcgagaggctgaggcaggagaatcgcttgatctcgggaggcggaggttgcagtgagctgagttcgcatcactgcactccagcctggatgacagagcgagactccgtctccaaaaaaaaaaaaaaaaagctgggtgcggtggcacacacctgtagtcccagctacccaggaggctgaagtgggaagatagcttgagcccaagaaggtcgaggctgcagtgagccataatgaagccactgcacttgagcctgggtgacagagcaagatcctgtctcaaataatggtctcaagcaatccagcagccttggccttccaaagtgctgggattacaggcatgagccacaatgccaggccccccagttttctcaaacatcaccaccactccactgggaaccattgatctagggcttattaatacagttacttttaggatggtctgagaggccccattagatgtgcactcaggaaacacgggagtgtttatgttacagagaaagggcagcactgttgctagtgagggcctcaagcccctcagtattggtgttttccttctcacatctcaactgtcctgcacaggacctcctctcaaaatggtggtccaggtccttcttcctcttctctcctagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcaggtactcaggagctgggctcagtaagcagcacgtactggtacagttggtgggtgggtgatcatggccaacgtttgttctgattaccatagagattgttaaataggaatatccctcctgcataggttctcttcttcctaccctctttgaggctgaagactgaataggggtttgggggcaggtatttctcactctgtcatgtatccctcctgggactcctgcacctgctgctttaggtccccgtttatgggcgaggtgcattttccatatgatcctgcttaggagcccagaggccatctgccagttggtatgaggaggccctgaatgatgacatcagaattctaaatattctggatgtactcgtctcaacttttcctctccagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggtgagagcatcctcccagccctcccacaagggccacttttggttctcaggtcacatgacacagcacagcatgtttcctccacaggtgggaacatgtgtcgaggagggctatttgcaaaccaatccagacggtcaaaggggtctttcagaggagtcttttaaagactggtcctaggccggatgcagtggctcatgcctgtaatcccagcactttgggaggccaaggcaggtagatcacctgaggtcgggggttcgagaccagcctggccaacatggtgaaaccccgtctctactaaatatacaaaaaattagccgggtgtggtggtgtgcacctgtagtcccagctactccggacgcagaggcagaagaatcacttgaacctgggaggtggaggctacagtgagccaagatcgtgccactgcactccaccctgggtgacagagcgagactatctcaaaaagcaacaacaacaaaagactgatcctagggactggccatgattccaatttccctaaaacccaagagttgggagggagccaggtgtggtgactcaggcctgtaatgctagcactttgagaggcctaggcaggaggatcacttgagcccaggagttcaaggctggcctgagaaacatacagagaccctgtctctacaaaaaatgaaaaattaaaaaataagagttagggccgggcatggtgactcaagcctataatcccagcactgtgggaggctgaggcaggtggatcacctgaggtcaggagttctagaccagcctggccaacatggcaaaacactgtctctactaaaaacataaaaaattagctgagtgtgccgcctcccagttcccgcatcagtggcctgcacagggcccttggggcgaattgcagcacgcctcggggcgagcggcaagggctggggtgagtgcacctgcacccaggcggtcttttcacgtgtcgccagggtcagaccgcatgtctctccttgcggcgctacacaagagcagagtacgagtctgaggtggagggagtcatggcaggacaagcatttagaaagtttcttccactctttgaccgagtattggttgaaaggagcgccgctgaaactgtaaccaaaggaggcattatgggtccagaaaaatctcaaggaaaagtattgcagcaacagtagttgctgttggatcggattctaaaggaaagggtggagggattcaaccagttagcgtgaaagttggagataaagttcttcttccagaatatggaggcaccaaagtagttctagatgacaaggattatctcctatttagggatggtgacattcttggaaagtacgtagactgaaataagtcactattggaatggcatcaacgtgaagctgcccattccactgaagttctgaaacctttcatcatgtaaataatttccatatttctctcttataataaactaatgataactaatgaccaaaaaaaataagctgggtgtggtggcacacgcctgtagtcccagctactcaggaggctgaggcacgagaatcaccttaacccaggaggtggtggttgcagtgagccgaaattgtgccactgcactccagcctgggcaacagagtaagactctcaaataagtaaataaaacatcagcattaggaaagtcccttcagccttagtttttggttcactgggtcctgaattggcctgtcagttttcccttgtgattgattgataggggctgactggaaagtgccatgacagattagtgatgccacaccataacagatgggaggttatgacgtagttgtcacctctggttgacatgtaatgaaccaggacctgcaggcaggtgagaggttgcagcagggctgtgaagggaagcttccctgaagctgatcgacaaacactggagtaaccctgaagtagccggtaggtttcgccttgtggttatagtggctgtctggatgaagtggctgcaactgtgtcatgatagttagtaatgtctgctgtggacagaaatgagaatgatggctcaactggcatgtatgtgccatgtattggaagcaagggcatggaaggtcttgagaggtgagagctgggcggtaaacaggaggagcccccctgaggctgactgggtgggtcacagggagctcatcatatgtgtcattacaaacaggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtacctgagtgagtggtggtagcgggtggggtgccagccccactggtgggcatctgccccacaccaggattctgcacacgttcctatcctagcatcttgtgggccatggggacaatgatctcctctagaacctcaatcagatgctatttattaacctggtggaggtctttgaaattccacaggacccctaaaagaccattctagcccaaccgccttcctgtgtagatggaaaaactgaggcctcgaggaatcgaacctatgtagagcatgtgaagtggacctggcacagagcatgctcagtgagtgttggctacgatcactgtgctgggtcctgactctcgctatgtgacatgggccaagtcactccctccctctcgaggcctcagtttttccatctacacaggaaggcggttgggctagaatggtcttttaggggtcctgtggaattccaaagacctccaccaggttaataaatagcatctgattgaggttctagaggagaccgttgcccccgtggcccacaagatgcccaccacacccggctgcgttatggctttaaaaataatgtcatggccacacgcagtggcttacacctgtaatcccagcactttgggagcctgaggcgggcgggtcaccaggtcaggagttcgagaccagcctggccaatatggtgaaaccccgtctctactaaaaatacaaaaattagccaggcatggtggcatgtgcccgtagtcccagttactcaggaggctgagacagaagaatcgcttgaagccgggaggcggaagttgcagtgagccgtgattgtgccactgtactccagcctggacaacagagtgagactgtctcaaataaaataaaattaaaatgtcactagggttttttgtttttgtttttgtttttgttttgagacggagtctcactctgtctcccagactggagtgcagtggcacaatctcagctcactgcaacctccgcttcccgggttcaagcaattatccctgcctgagtagctgagattacagatacctgtcaccatgcccatctaatttttgtattttttagtaaaggcatggttttgccatgttggccaggctggtcttgaactcctgacttcaggtgatcctctcgccttggccttccaaagtgctgagattacaagcatgagccaccacacctggcctatcaggattttaatctaggcagtctcactcaccatggtgtggaaaataaaaagcataagcattatggccaaaacccagtgttattaatacctgtaacagtattgatcagtattgataacctggttcttggctttaatttcatttttctgtttgcccttgttctgttgtcagggaaattaatctagactctactccatgtgacctcaggctagttacctaactccctaagcctcaatttctgcatttgtaaaatgaggataacagcagttcccacctcttaaagcaatggtgaggatcagggtagggcctggcacttagtaagtgcccatttagccgggcaaggtggctcatgcctgtaatcccagcactttaggaggctgaggtgggcggatcacgaggtcaagaggtcaagactgtcctggccaacatggtgaaaccctgtctctactaaaaatataaaaaataattagccaggcgtggtagcacatgcctgtaatcccagctactcaggaggctgaggcaggagaatcacttgaacctgggaggtggaagttgcagtgagccaagatcgcgccactgcactccagcctgggtgacagagcgagactctgtctcagaaaaattaaaaaaaaaaaagaaagaaagaaaaagtgcccatttagtcaccactgccatcgtcatcaacaactgagaaatcagccttataggatggcagagatgttttagtgacatataccccatgttggccactccacatggtcgactagttgttcagactggagagctgtctctgcctcctggcactaaatggggacagagtggattctgccttctggccctttgactaagaggagcccagcgagagtgcagagcattttaacttgaaatctgtgctgagataggctgacaacccggggagggggtgggggtagaaacgtgggggttgtttttgattgccccagtgattgggggcactacgggcatttagtggtagaaacccgcaatgctgtggcaaatcctgcatgatgaaaaaacttccacacaggctaacagctcccttcttgagaaagttgagtctaaaccaaaggcctttctttaaagaggccactgatattatgttcgtcacccacacacatagccccttctccactctgggattgccacgcagtctcccccgagtggtgcccagtgtgcaggctgggctgggcctggcttctgctctgtggttagcctgccaccccctgggccttggaaggccagttagcccaatacctgctgcagcctcatttctgacattcctgcatttgtgtgatcactaatgctgtgataacacaggttagcatctgatcggatctgctcaacattagcacttacataaccaagtcatgtgcgtttagttttattaataattgaatgcggcctggcattgtggctcaggcctgtaatcccagcactttgggaggccgaggtggggcagatcacctgaggtcaggagcttgagaccagcctgacacaaaatccacctctgctaaaaatacaaaaactagctgggtgtagtggcgcaaacctgtagtcccagctactccagaggccaaggcaggagaatcgcttgagcccatgaggcagaggttgcagtgagctgagatcgcgccactgtactccagcctgagtgatagagcaagactctgtctaaaaaaaaaattgaaggccgggcaccgtggctcacgcctgtaatcccagcactctgggaggccgaggaaggtggatcacgaggtcaggagtttgagaccagcctggtcaagatggtgaaagcctgtctctactaaaaatacaaaaattagccaggcatggtggcgggtgcctgtaatctcagctactcaggaggctgaggcaggagaatagcttgaacgtgggaggcggaggttgcagtgagctgagatcacgccactgctctctagtctgggtgacagagcaagacttagtctcaaaaaaattgaatgctcagttggaaatatgggtgtttcatataagattgggctagctatcagctgctctgtctatggagtagccattctttattcctttactttctttttttttttttttgagacagtcctgctctgtcgccaggctggagtgcagtggcatgatctcagttcactgcaacctccacctcccaggttcaagtgattctcctgcctcagcctcccaagtagctgggactacaggcacgtgccatcacgcctggctaatttttgtatttttagtagagacgggttttcaccatgttggccaggatggtctcgatctcttgacctcgtgatctgcccacttcggcctctcaaagtgccgggattgcaggcataagccactgcgcccagccctcctttactttcttaataaagttgcttttactttaaaaaaaaaatgggttagctatcttttaggaagaatattctttttgaagcaaaaaaacagtgtagcagccaatgatgcaaagaagttattggtcctgcatgacatggcttttaaaacttcatgttataaaaatactgtgattattgatttttttaaaagtaaaatgacaaattaatttttctatcccaataatccttttcattatggtgaattttgctttagccaaagatcagcttttactgctattttccaaagtgtgcttgtggagtatttctctgcattgcccacatgtggaagccgtattctcaaactttcttcatggtgtactcagatccccgcactgatggttcccacagctaatcaatgatctgttcactccaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgtgtgagtaccaggcccccaccccctccctgaggatgggggagttgaaagactggattctaccttgagctttaactcctggaactaagaggccaccaacattgcccgtccactccttaaacattttttttaagacagggtctcactctgtcacccaggctggaatgcagtggcatgatctcggctcattgcaacttctgcctcccaggctcaaatgatcttcccagctcagcctcccaagttcctgggactacaggtgtgggccaccacgcccagctcatttttgtattttttgtaaaaatggggcctcactatgttgcccaggctggtcttgaattcctgggctcaagcagtccacctgccttggcctcccaaaatgctgggattacaggtgtgagccactgcgcccggtccactccttaaactcctaattctaggagcatcagtcaatcagtaggtctttctggggcttgtggaatgtaccaggctttggggatacagtggtgagcaaacagactcggccctgccatcaggtcatctggaggggcccgcacagtggttctgaaagggtggtttccaacagcattagcatcaccaggaatttgctattattagaaaggcaatttctcaggccctgctccagacttactgattcagaaatttaggaatagaacccagtaatctgcatgttaacaagctcccaaggcattctgatacatgctagagtctgcaaattactggtctagtgggaggaaatgtttagttaaaaacaaatttcttggctctaaagatagaacctatcacagttgttttttccacattttgacttggtcttaatatagacaacacacatcgtcagtcagagatcaatcatatgaatacaacaagaacatgctctttgctgggcgcagtggctcacacttgtaatcccaacactttgggaggccaaggtgggtggatcacttgaggtcaggagtttgagaccaccctggccaatgtggtgaaatcctgtctctactgaaaatacaaaattagccaggcatgatggcacatgcctgtaatcccagttacttgggaggctgaggcaggagaatcacttgaacccaggagatggaggttgcagtcagccgagatcacaccattgcactccagcctgggcaacagggcgagactctgtctttagaaaaacaaaacaaaaaagaaagtaggaaattaggtcagagcagtgacaggcacagggtaccatcatgtcaggcctcataggttattgtgaagactctgggtagaactgaaagttatcagaaggttttgagcagaggggtgatgtgatttgacttaagttttgcaagattcctgctgagcagactatatgggggcgaaggtggaggcagggagaccatctaggaggctgtagccataatccaggggtaaaaaggtgatgggaggctcaggctaggatggcagcattgaggtggtcagaggtggtcatgtttcaaggtagagtcccttcagattgatgtgtggaattagggtaagacccatggatgatcgcaaggctttcggcttaaggagaaacatggcatttccatttgccgttttgggaaggaccatgggaagagacttgccaggccagtccaagtggaggtgtcagtaggcagctagacctgggttcagagaagtccatttggcgtcttgccttcccccagactcgggagaggagaggttactgtctagcccacatgtgcatgcatcttcagaacccgtggactcccaaggaaggttgggtctgttttgtctggccaaggacagacagcagttccatcagcaggcaaaaaagtaatgatcctgagcagtggtgtatgctcttaaatcgaactgccatagagagatggctagagggtcccctcttaatacagggttaactgtgtgtaggcatgagagagaaggcagccaggatccccagttggccagttccccccatgtccaaatagcctgccagcctttcagaccacatcactgaagccaggcccttttaaaattccaacactggggctgggcacagtggcttatgcctgtaatcccagcactttgggagctgaggcaggcagatcacctgaggtcaggagttagagaccagcttggccaacatggtgaaaccccgtctctactaaaaatacaaaaatttgagatcacgccactgcattccagcctgggtgacagagcgagactctgtttcaaaaataaataaataaataaatgggcccctgtaatctcagctactcaggaggctgaggtgggagaatcacttgaacctgggaggcagaggttgcagtgagccaagatcctgacactgcactccagtctgggcaacagagcgagactccctctcaaaaaaaaaaaaaaaaaaaaaaattccggccaggcgcaatggctcacacctgtaatcccagcacttcgggaggccaaggcagttggatcacttgagggtgggggttcaagaccagcctggccaacatggtgaaaccctgtctctactgaaaatacaaaaattagccaggcttggtggcaggcacctgtaatcccagctactggggaggctgaggcaggagaatggcttgaacctgggaggcggaggttgcagtgagccgagattgcaccagtgcactctagcctgggcgacaagagtgagactctgtctcaaaaaaaaaaaaaaaaaattccaacactgcattccacgtaagtttagattactgtaccctatgaaagttgcattatcttgttcttgaagtctgtggctaattaggggacatctggtgactaaaagagagtctcattgaaagacaacatctgctgggaggttcccatcccgacatcccgacgaaaggttttcttaaggatcagtaccaccaatctggttagactgacagcattatgggtgaggagaaggaagtcagaatcttctaggaggaggtgttataagctgagagctgacatgtgggagccatgtgtatgcatagagtctgccaggtgaggaaggagcctgtatgaaggttcttaaggggaagttgctgggggtattcaaggaacacagaggaggccaatgtgcctagaccttagtgggtagggggacttggaggcataggctgggaccaaatcttgccagccttgataaagagttgaagttttcctaggtgcaagtaaagccattgtagcatgttaagctctggctactgagtgaggacatctgcagttagaggggctctgagggcctgggggtcttggcccactgtgtggttacagagggagcactcacactccccaacccttgcagtcctcctgctggtgctgcttttgttggtgagaaagaagcggaagatcaaggagcccctcctactcccagaagatgacacccgtgacaacgtcttctactatggcgaagaggggggtggcgaagaggaccaggtggggcactgggggctctgggattgggaggtggatgcccctaaggccactggcagggctgttgggtcaaccaactgaccaagttagctgtgttgaccaggccctggcatgaagcatgcgtcttccttttctaacatcctccagcacttctctggtccattgctgtagtctctttggccctagccaagttaacctcaagcctatgtttaatttgctaggacaagggaggatggaaacgagggttttccaaaatctgtgacatcatctgtcttgtaagacctccccatgagccagagtatccaaagggtagggggtgtggggtgagatgtaagtggcaggggagtgggggacaggagtcctcagtcacctgctctcctgcatttccccacaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggtgaggcgtggcaggccagtcgagggccaccctttattcaagcccagcaccagccacacaggagaacaagcatgggcctggagtcttgggtctgggttcaaattctgactccaccaccaaccagcttttgacctctggcttatttgagtaacttctggggtttgtttcttcctccatagaactcacttgcagagtggttaaaaatgattaggaggggctgggcacggtgcctcacgcctgtaatctgagcactttgggaggctgagacgggtgaatcatgaggtcaggagttcaagaccagcctggccaacatggcgaaaccccatctctactaaaaatacaaaaattagccaggcatggtggcgggcacctgtagtcccagctactcgggaggctgagcacaagaatcgcttgaaccaaggaggcagaggttgcagtgagccgacatcacgccactgcactccagcctgggtgacagagcaagactccatctcaacaacaacaacaaaaatgattaggaggctgggcacagtgcctcacgcctgtaatctcagaactttcagaggccaaggtgggcagatcacttgacgtcaggagtttgagatcagcctggccaacatggtgggaggtggaggttgcagtgagccaagatcgcacctgggtgcaacttatggctgtagtgaatgccgagaatgaagtactcagacaattctagctgagcggggcggggagcagttcctttgagagagcgtcactctaagatctgtctgccaggtatttattgagagagcttgtttaaactacaatttagacaaacaagagacatccaccaggtggctcttggcggtcgggtatgaggcacatatggccttgtaaaaaacactcaaaccacatttttaggaggctgtgttcagcgctccttatcacacatactactccctgtcctgttttcaaggtccaggagatctagtcttgtgtacaaacaacatgcacacagcgcctcaatatttttccatgcctcgacctcacatgcctcttacataggcttgaatgtcttgtcgtgcgccccccacacctgggcaacaaagggagactccatctcaaaaaaaaaaaaaaggccgggcacagtggctcatgcctgtaatcccaccagcactttgggaggctgaggcgggcagatcacaaggtcaagagattgagactatcctggccaacatggtaaaaccctgtctctactaaaaatacaaaaaattagctgggcgtcctggtgggcgcctgtagtcccagctactcaggaggctgaggcaggagaatcgcttgaacccaggaggtggaggttgcagtgagccgagatcacatcattgcactccagcctgggcaacaaagggagattccatctttaaaaaaaaaaaaattaggaatgatttattcatttattcaacacatatagcagttgaatactctggagccagactacctgggtttggattatagatcccaggtgattgcacctggggggcaaagtttggagcctctgctgtagaagacttcaaggattgaacgagcaggcagctaggacagtgccagcacagtggttcccgaccctgcctgcgtgttggaatcacctgggcaccttcagaaaccactgatgcctcagctcacctccaaagattgtgatataattgaactgggtgtggcctgggcttcagaatttataaaagattctccagataatttaagtttcggaactactgacctagcatgtagcgcttattagataatgatagctattgttgcgaggtgctattctaataactgctttacaggtatttactcatttactcattcatctgttcctttaaaactatacggaggcacatgtcctcagtacctcccgaggctgtgtcacaggcatgcatcctttaaaaaaggaagaaaaaaactattgtcattttacagacaaggaaacaggcatagagtggttaagggactcgcccaaggccacaaagctagtgtgtggtgtgagttctggcccgggctgtctgatttcagtccttgcccttaccccctggcctgtgttgcactgagcacttgctgtctgctggtccctgagtgaatgaattctgcatgaataacgcattctttcatttctacctccaaaacctttaggggaggggagagaggggctcacagagaggaaatggaggcttgcagctggcaagaggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccag

SEQ ID NO: 36376 - DNA, 120146 bp, Homo sapiens
gaagagggatagggccagcaaggcagggatcgaacgagtgtctggcagccgggagcccagcgaagagagcgagcaagcttaggaaaacgagcgaagtaaagggagtaggggagactgagactgaccggtagccaggcaggcggacggacgcacgcccggacagactgagcaggcgccggagaaccactcacaggttccccccgcctttccctttgaaagctaggattttgcctttcccgtggcgcccgagagagaatgctggactctgccgacttcagcgcaagctaagatttctcagctagggacaaacgatcagcccaatcctgagaaggggggaaccaagcaccccgtccccatccccctcccctcccccgactaaactcgggcgccaaacccagcccttctctaaccaccctacttcctcctctcctttctagcatggtggctgtatggacagtctgacagaacagagactgacatctcccaatctgccggccccccacctggaacactacagtgttctgcattgcaccatgaccctggatgtgcaaactgtagtcgtttttgccgtgattgtagtcctcctgcttgtcaatgtcatactcatgtttttcctgggaacgcgctgaatggagtccagccacctgagctgtcgcgaactctcgctttgatttcatcccgagagccaccgagaaaaaaaaaaaatcacagacagagacagggaaagagagagaaagaacaagctttcttactcaggggggaaaacgttttgagcttcaacatggcctcgctgtgatatgtatgacgttggtatattatctctccctaaatcttttgtcgtgtcttgtcttttaagaatgcctgcgcgtatagttgcctattgcttgagtgaaattgttgatgaagaaatgctttctatttaagtgtgcatgcgtgtgtgcatttttaatctatgtggcgttcatggagcaagctctgcgtccttaaacagtggctttgctgtctgtggtgtcttaactcatttccttgaagactacctttaaactccatcagggaattttagtcaaaatttctctcttgccatcaggagtgcatttgggtttgtttgaggggaaaagggtttgtggaagagcatgatgaatatttgacatcataggaaagacagtctttgcagtggatatttagagggaaaataatcgatgcaaggaatggatttagggaaaatgcttctttagtgtctaaggagaagcaagaatttgggaagtgacacgggtgtgttgtgctggcagttggtgactgtgtcctttgaatctcaatttgctctccagggttcacaattttcaattttgaaagaagccacatttaaaacacttcttgaaccttaaagctttaagatatttaaaatgtcaatttccttggaatcatgaaatagtatgtgaaagcattctctgattttttgaactggcaagagaggactttgacaggagctatttgggctccctttcccaaagattgtacccctggatttgagtttggggattttgtttgtctcatcaaaaaaaaaaaaaaaccccacaagaaagaaaaaacagctctttatccaccttgggaataatagtatttggatatggctcctttgggataatctcgtttgcaatgatgttcttgaactacattttaaatgtaacttgataaggctgatgagaaagtggtgatgctattgtttgctcccgtttgttactttaagatcagaggtctctgtaattgaaacattcccataacaaactgaaagtctgtaatgtgctaaattaagagttatcaaattttggtgctaaatttgaccaccaaaacccaaaaacgtctagaaggaaagggatgagagcatggaaaacatgagctggaagcaacattccagtttgagatatgactgcttgtctgtatcagatggtggtggtggtttctgttgttattgctattgctattatttttatatttctgtttcctctgagaaagctcttggcagagccaggaaaaaaaatgtctcatgccagtctgtataatacttgtttttttgcgttttgattttctttctcccctgttaatgtaggcaggctttccccattccattgcttacctggcttgaaataatgccatttatggctcatgtattatagcagtgaatcaggacacatacacatctacacacatgctccccctccacccatgtgggtggctgttcatgtctgatgtgcaaatctgctggcattatgctgtcaagttccatgtccggttgttcagtctctttggaaatgattatgaaaggagaggggctgtgaagggggcctttgaaattgtcttggccacaggacccagagagtattatttaatggcgtcagagggtgttttgggcctcaaagcatgctatccttgacttggtgtgggtgagaagctgaggtttttgtgagattagtaccatggtgtaaacatgatctgggaggtttgctggcattggttcttattaattactctttggtccgtttgtggagaccccctggatggaactgagaacctatttctttgcaaagataatttagtgagtttttttccccccttagcttcattgtattatttaaagtaagcttatatcttttctgggcactttgttttgatacagtgttggagagtggggaatggctctatgctgggcagctgcagacctgtttttttgttttgttttgttttgttttttgttttttccattcagcagctgtttgaccttggacaatttttttcctcctcggtgggtttgggattcccagtaacattggcattttttgatggctccactaggtgacttccaagttcttgcattttatgattttatgacccctagacacttgaagttgtggggggtgggggggatgagctggaaagacaagtgaaaaggaaaagaaaatgttaatcaaagggtgatgggaggaggggaaggatatctggtactacagcctggataacaagtttaagcgaaggggttttttttgcctagttatttgggaaggaaactgggacagcaataagggaatgctttttgactttttttcccccaaggggagaaggggtctctgagactagtctttgatctaggtttatgacttaaatagtgtcacgaaatgccttctcctctgtgagcctgacagacctttggcagaaagcctctgggaatgtatgtgtgtgtgtagggtgtgtggcagtatgttcatgggggtgtgtgggggggagcacactcctgagtgtggatgcggggtgtggtggtaggaatgaagaaagacagtattgagttccacagttctgaatagcctccttgtgctaggacctataaggatttcacaaatgctgggatggatgggtatcacccatgccattcctcttttcaccacctaaaacccctcaggctaaggaggtgtcttgaatgagcccttccattagtaatttagctgttgaaatgggttagcgcttttaaaattgtctccaggcaaataaagggatgttgctagccagatggcaggccaccatctagcaaccagaagggaatttgagagtagagaacaaaaggtagcagtgtgactttttacttgtgtgaatcctaaaggtttggcatttctgcttcagacttgtgaggatatttttctctagcaaaaagagaaaagagtgggagaaaatgagaaatgcagcccagagaagcggaaccctatgcattttgacttgtcttcttttttccttcctcctctgccttctctcttaatctttctccttcttcctttcttcccacccctgacaccacctcctcctcccacctccccactgtaaatgggtgagaagtaaaaaagagaagaggacttttcctctctgatttgtcccaacttttcccaataaagctcctccattcccttccctcctctctggcccctttgagtagaggataagcttttgccatgtaggaggggcaaaatcccagcttagggattttcgctcctggatccccatcaaagaattaaagaaaatgccctctactggtatcctagcaacccctgtatcactgagcacccactgagctccagagcccaccctttaaaggcccaggcaccaataactctagaaaaaggggactagagcctagtgggacttggagagatgcttttggggagggaacaaagaaagaacagaatcccaatttcctgcaaatgcctcggaaacatgtccacagcagacatgtagagcctagcctcgtccagctatgagattatttattagaaaactcctggtttcaaattcctttctagtcagtcccatctccttaagattaactgtgccattttactgcctagctttagtgccagaagctctgccggtcctgaaaaaacaatttttttcaccctaacttttggctgcatcagggagggggtgaagtgatatcttggtgggaacaaactgaacagcattcttcttccattgagacagcctccatctgtcagaacctgcagtgtgcttgtgcagtgtgccccaattttgtctgtggcttggggaatcctgatcagcctagctttatagaatttgggaatttttctttctgtggttttggtgtagtagtttctgacgggggaggctggacaagttgaaagagcaagtttgataatggagctggtaaacagggcttggaccctggctcagagactctcacccaccggtgtgtgtgtgattcagctactagggagctgaaagatcccaaaaaggctgtaggtgaggtgctcttctgcccttgaggtaaggcccagattgagagcaaccagagggcacagtctggtggtttgaaggatggtaacaaagcatgtcttcctctttagcctttgtctgccatctcagtttctggtcccttgacctgcagagtgcttgctctgggcagggatataagaattgagccttttctcccaaaataactgcctcctcagaagacctcctacaaggcatctggatcttgctccagtggctttgccccaagaaatgggatggaggaggggaatcttggactctctagctcttatttccagctctgcaacttgttctaggccaactgagtctctggctttccaagaatccttgatgaaggtttagcttctccagtatctgctcagagtgtctccttctgtcttaggtggatctagctccatagagtatttagtttattgtactttgctctagcacgaaagtacaaagaggaaaaactagaaggggaagaacatagaggggagagaaggctcaggaagcagtccagtaatgacaatactaataactccttatcagtgcacgggcctatagcgtttatgaaggaatttcacatcctttctaacttgagcatcacatcagccttgtgaagtgggtagagatgattgtaattcccagtgttacagatgaggaaagtaaaggtcagcaagattgttgggatgggagtgggtctgcctttcaaatagagaggagagtcagagttggtcattcctaactagtgtgatgttgaatgtagggagggagggcctgacgtggtggctcacgcctgtaatcccagcactttgggaggctgaggccggtggatcacctgaggtcaggatttcgagaccagcctggccaacatggtgaaaccctgtctctactaaaaatacaaaaattagccgggcgtggtggcacacgcctgtagtccagctacttgggaggctgaggcaggagagtcacttgaacccaggaggcggaggatgcagtgagccgagatcatgccactgcactccagcctgggtgacagagcgagagtccgtcccaaaaaaaaagaaagaaaaggaaacaaaagaaagaaaggagatttgggagtcatccctgaagtcatactagcttcctcagctactcacatttttaataactttcatttgtatagcacttttgctcagaattttcattctataaaatgcctttttgtcttgaatatgcatcaaagagttctgtttagttttatgaaaactcactatttgggatcttcaaggtgagaggccagtgtgaattgctgaagcctaaaatacagaatgttttcaaggaactgtagttttaatacaattgttcttctctttgaagcacacttatttttctatatttctttaaaaatctgctgcctagaactgttcatgctactctaggtgccacctgactgagatcaagtgcaaaagaactttgttttgtctgtgaaatgtctaataatgcagccttctactgattctcaaccctcactgaacattcagatcacttgggaagcttttttttaaatacccatgccaggtcccctatctgaaagattctgatttaattttcatgggctagatcccagggagctttatttatttatttttttaatttaaagttccctaaggtgattcaaatgtgcagccagggttaagagttagccttttgagcatgtaggtccaaaccatttactgtctagtccagtcctctactctcttgtgaagttggccacttcagggttttttgaaccaaacttgctacattttatcttgacatgttggtccattattctagctttctgtggattttaaaattttttcttcatgctgtgctacaaattagcagtcccttctagcactgcatcagttaaattctatttgtttggttggactattgttctagcctttgggaggtttttattttttttcttcatgtcacacaacaggttagcagcctcttctagtgttgcattatttgaacaccaaataaatggcattcgagtcgttgattcaaagaaatgtttactatgatatgattaatgctagctcttctgtcacctcaccagagcccctcttggagttgggacttgttaatttttgtatgtatctggtcaaccagtgcagactgcacctggttgtgccagcatttatcctaccagggtgttaatgtgaataacatagcacgatagatttgttgtatgctttgtgggcatcaagatatgctaggttcatagcaagcatctgccaaactgatagccccatcagaaaaagcagtataagttacttggcctcttactcatggtaaatctggttgcaggctccagagcttcttgttttctttctgtgcctacaatgcaaatgtttctaaactgggttcagaacttggctgagggtcagtactacaactgtagtttctgtgtattactttctcctctttgaaaaagcaggacataatggatttagctttaaaacagaatatattttgtgctcaaagagttccggaaattctttgtgtatgtttctcttgttgttttgcttaattgtttccattaacccagtggttctcagcactggctgcacatcggaatcacctggaatattaagagtaacaacaattcctagaatctttgggagagatctgattgagttgatcatagtggtttcctggcatcaatatttttctaagagttccctgaggtgatgggaatgttcagccaggggtgagaatgactgctatggaatgcttcataggaaatgttagctcagcctgtctgacttatcacacatgtgactaggcaagcttcacagatggtgaaattttattctaggactgtgggagcctcgataagtcccaggggcttgtgctcactctaaaaaggaggaatcaaccctagggaatgagtagtctggagacctaattgtatttaaaataatcagctgtgagatggtttgaacacttcaggaataaaaaaaaagtcagttcctacacatttgctgtaatgatggggaagattctgctcatttgctagtgacctcaggcaaattacttctctcctctgaaatttggttttcttcatcagcaaaataaggataggtggatttgatgacttcaaagatttcttctagctccaacaatatgtgcttattttgtgattaatattaatgatcaacacgagtacagatattatttaaatctagcaggtaatccagagatccattttagcaggtttagaatacacagagtggttttaaggatagcagttttgccttcttaattatacttggcttaggtttcttttagaacaagtgaacttaggttgtattctttgagcacacactggccgccaagcaggaaaggagactgtatgaacacgcattggctgccaaacagggaaggaagtggtacagtgaattgagtagctagggtatgccagtttgggattctgtttattaaagagatatgtcatggataattgagaattgcctctcatagatataataccagtctcataggtctgaaaaagatggattgctttgacagctcagagccccttcctgcagtattttaagtagccattcacttggttaataatactacttctattaataagaatttcaacaaataaggtttcctatgtatttcatgggcttcttcctcaaacctaaaagtagttaagaaagtgaggctcataaagattaagcagcttactcagtgtcaaacaggtagtggtagtgactagtggtagtggtagttctagtggcctagaacctaggcgtcttgataccacatcctgcagtgcttctggtatagcctgcatagtggactctgtggtcaggatgcagtcatgactctgagaattaaaggggttttactgacatagagcagtattcaggaggaagctttgaagaaaggagcaaaaggggcaatgtggaggaagaaaaaaggtttagagagggatgtgttcaggccagtttttctcttgcccttatcactcttatgtgctagttccaggcccctgatgggaattggccattgatctttgagcaccaaggttgagtgttggtagcagagaagaaggaaagttgtacatgcatggcagaaggatagcatagggaaggcagacttgcagtaggagaaaaaacaagaaaaggccttaggagccctaggattaagccctggctctgtacctaccttgctgccagatcttgatcaaggcccttcccacctaggcgtcagcttccacgtcactaaaatgagagtggtttcagtagaagaactatgttctcaaatggaatgttagccagaagcttctatataaaacaggaaaaagcacagatggtctggttgaaatgggcatgggacaggtatggaggacagagtctaaagttccagggaaccatcttgcgtatgcagattttggtcattaggggaactggaattagaagagtggagatggctctgccaagcccagccatagtgcttggggagatagagcatccttggatagagttgtgtgatgggggtgggtatttcatttaagtggccaggatttacagagaatcacttaggggcagatattaaagtgcctagtacaacacactgcccccattcctttttttacaagtgagaaaactaaggcacaggaggggaaagggatgggtccaaggttgcagtgatagttctggaattctgattctttagatagggctcttgcctgctgtaacttgctacctcccctataggtttctggctctatgctcccttggctggatcagagacctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgcacatccatagccagctctgggaatggctttggcagctgatttctccgcctgcctgccttcattagagaaaggaaagccatgtacctccgtgcccagctggctgcaggaaggatgtactaagagcccaccccccaccccctcagagtgtggtgcctaaaggcagtagctacttttagctgaacctcccacagcctctcctccacccactctctccctcctccctctgtgaattgtgcaggatggcaagaaggctggggagtaggtgccttggcattgggatagaggcagaggaggagctaggcatctctaggaggggctctgataagccctgcatggcaggagggcttagaacaaaagcaaaatgatgagattgctttgtgcttaggacccaaagggagttgagggatttattaatttcctttggagcatgcaaccagctgaagttcatgtcttgtaaatttagactgaactgcatgggaagacttacactctacttggattaagaggaaagcaactggggctagtgggtactcacttgattcttaactactcctcttgaacagtcttacacttttcagtggattttgtacatcgtctcacttgattttctctgtggccctgtgaagtgggtagggcagagattatctccatttcacaggtgagaaaaagaatgttcaaagacttattgtcacatagctgcttctagcctggccttctgggcttcagctctggaagttacagtgccacttaaagtcactgcagacagctatattttctagaaaaataggtgctggagctgtcctgattctaatctcctcattgtggaagctggggaactaggtccagagaagaaaaggacttgccccaggaaatgtagtacatctgtagtagtgctggaattagaacattgccatgcaaggatgtgaattcctggacctgcaagatgtgcaagccactgtggtctttcaagggttgtttgggaaacctgtgtggtgtgatggaaagcaaagtgtcacagaactaggagtttgttatttttcagttcaggcagaactgtgggtgactgccccagtggaggcctgacactcagtaagccctctataaagatttggttgaatggaagatgtacacatgagtaaaaaggaggtgcaaatgtgaagtcagttgctgtgtgaccttgaacaaatcccattgtctctgtccctcatttctgtctgtcatttttggaggactctttttacttctctcccttggaagaagaaaggccctgtgacccggcccatgtcttgggtgcttggtggaaagctgttttgttttctgatttttgttgttgttgttgtttttaaataagctttcttttatttatcccaagctccatttcccatgcagtcacacactcgctgctatgaagagcagactaactttgtctctcctcatctcctgcaaagttaaaagaggaacttggaagaaagccaaaattaattgtgtttttatttagcaccttcttaagtccatcaagccataaaccacttaggcacatggcaattaaaaaacaattcttggcccctagatccttggctaggatttgtgatggattactgggttttcatgatatgatcaaaaactgttttagaaattgcaggttcttgcccaatgagctgtgtagaacaaatcaacactcttcacttatactcgcattattttgtttggaaacatctcactgatctgggggcaggacaagaagataaagactactgtatagccttctgctcctgacacatgttcttttctccattacactattaggtggccaaagccaagattattttcccaattttatggctaaggaaattgaagctcagagaattgctttgattgactcaggtcagtactgcatcttaaagtcagtggtgagctaggaagaacatagtatatagcgttaggtattatcaactcaccagtaccaagtgtctctaggcaagccatttaagattccctctgtagtttgcttctgtctaagtattttgttgttgttgtttgtttattttttgagatggagtcttgctctgtctcccaggctggagtgcagtggtacaatctcagctcactgcaacctccgcctcccaggttcaagcaattctcctgcacgccaccatgcccagctaatttttgtatttctagtagagacggggttttgccatggtggccaggctagtcttgaattcctgacctcaagtgatccacccacctcagcctcccaaaatgctgggattacaggagtgagccaccacacctggctctaagcatttttacaaaagttaatcaagatagaagaaagaagtaggcatatgctactggataattggataggttggcattgaaccattaattggtattttggtgcatctactggatctacaataaattcatctggatatcacattgtccagggatacatgagaggcctttcaaaatgaagaaaagtggccccagattctgtagtctttggtgacctacttagtttggacgctttctctctgtgggtttatctggccatgttcttaaagactgggccttgatcctaaaagcaggctctttaccattaccagtttctatggtcatcccaaaggatggggaagaatgatttggataaactacatgtcattttgcctgggctttggtggagattgtatgccattccttttactccagttggttcaggccactgggaaaatgagtgtggaatgacaagaatagggagacaaccaatagcttgctgagggttagagggggcctagctgggatgagacatctgcaggtgctaatccacgtgcacatatctacacactgattctttgtggtgttggggggagcaagcagagtttgtccatagtacttcagctgagaagtgactgggtaacagtgagaggaacccaagcattgagctcgttccttcagtgtacttctggggaaactgaggtctaaggagaggcaggaacttgcccagagtctcagaatttgtccgtgatctttgcctattctctctagtcagccaatggctaatttaccttacatttgtgaggctctttagatgaatgaggggtggctaagcctcttgggaaaagcacctgtgattaccacattcaggaagtgacagagatgaaatctgaacccaggtcttttgtcctgcttaagagcagattgacccagacttgaaggaaggctgttagaaacaaattgatggggaagaaaattggttcagctttgctgtctatccatgctctatgcccgtaccttcacatacacatacatgatagatcatatgtgatgcacacttacacatactcagacacatgggatgtatttgggacacacatgggacacacagctggaacatattttcacattaacacacttggaacacacattcagttaaacatgggaggaatattcacacttgcacattctcagcacaggcaggatacacacacaggaacacacatgagggatacttgtacgcatctgcatgtgtgaatgcacatggatgcatataaggcacaattgtgcacccacatacatatggggcatgctgagatgcactctcagatatactgttacccaggacatgcactcctatacctgagatacacactcctaaagactacttgggcaaacaacactccacacttgagtgttgagtcacacttgaacacacctatgggacatatccacatgctccacacagccatgtgggacatattttgatgcagaacacgtccttcccttagggccagccagctgtcactttttcctaagtgggcatgacagggaactggtcccagctggtgggcctccataagtttgctctggctctcctttaaccttgaaattagacttgagagggcagtatgctcagtaataaaatggatgttcaagatggcatgttttgtagcaggctctgtaaggtaaacagggttcagagcagagccctcagatgtgagttaacaggcagatgcagaagaatggaaaacacaaattgggattgatcaatgcagaaagcttgagcctgctccttcatcccccagttcacttacaaaccattgtggagtgatatggttatgaagcaatgtcaaagaaggcctaaagtcactggatattaaagtttatctttcttgggaatgaaataacagtctggactagagcaaagatatctaaattgtgggtgttagggtgtgaggggaagtggtaggatgcataagcgggagatccctttgggcagtggcccatcctctcctgggttagtggtggtctgagaccagcctcatccttaatgaccacaacctagcccctaggcacagcagcttgggtcatctggccccactaatgaatacctgctatttttagagttcctcaagctggaaaccaggtcatggtgtcctggggaagcctttgtggtccttggtacctaaggctgaagctggaaagacagggccctagattgggtctgagtgaagggtgggaagcagggggacacgtagctggggaataccaggctttcctgggagcagcatcctcagagcctcagttgggttactattaactataacagcctcatgcccatttctcagctttggctttgaggtcaagaaacatgagtttcagttgctactctgcctcttacagtgtgtctcagtcacgttcccctctgctgtctgagtcttacttgctttatttataaaacatccagtattgcccttagatgatggaaaggctcagctaggctaagagttgagaaaatgttttgaagatacacttttctccatgcataaagctgcatcatcattgtccctaagctggattcaattcctgccaacaattggacctgactcctattggagtagctgtagacagcaaaggccaaaaaaaaggagccaagagaagacaccctcatggagtcaggttggtcaaagtcatgctgagattacccccacatatacagatgcttttcaatgccaggtcagtcattctgggaaagaaaacagatttgcagcatttaggtggtcatgtagctttggctcctcaggaatctcctaggtaatgagagaaggggaggcatcaggagcagggatttcttcctaaactaggaaatgcaagaccaggtcacctgtacctgccacctgccagaggaggcagcctagagtgccagctctggctctaagagaatcctctttgtgtttgtgctcatggccattttatctggtttgctgagagggagaaggtcagaaactagactatgtagttcaagtttccccctgctgcagacattgtgggcaaagttctcctgaccctcagttttctggtctgtggaatgggcttaactgtagtctctcataagagttttaagtgcaagacttcattgtgacataggatgtgaaaagtgtcttgtaaaatgttgaacatgtgttcctgctgtttggattgttaagatttcatccaggttgtaattacacatagtttggaggtaattgagaaacttcactttatttctctacccctttcccataccgttcttttaaggcattattatatccattttacaaatggggatactgaggctcagagaaaagagaaacaagtctgaggtggcaggattaggtggtggtagattcaggactagaagccatgctttcagattcccaacccaatgtactctggccctgggctgccaccaatgaattccagtgctaaaggaatctgccagaggttacttaagtaaatatatataaagagttagatttttctctgacaagcagtacagggggttctctggggcacagctttacccagcactctccctgcttgcccaagagagacacgctgattgtcccttcatccctcctacagcagctcatgtcctgctgtctcctgcatgttggaagcagtgaagaattggagatgttaggctgttgtgagaagcaatccttctgccggtttaagccacttcaagacaataggaggattcttggaggcacaaaatccaccttggtcacccgcacctcctcacagttttttgggtacccctgacctgcctaaggggttggctgaaagggatctaaggaaatatatttgagggccttgatctctggaggattgtgctaatagttgagggataagattatggaaataatccaagaaccaaaactgggagtgtctctggagaccatttgggctgaatttcacctggcctcaatgaggacattaaaacccagctgggcttaccttttctcccttagtgtggttttcctttgtacaccacagattctcgtgttcagtcagatttcctggagtctttctagcttgcttgtttttgctattctgagcccagaagagggaaggggtgacacattgagtggagtggtgagaggaaagagatggaggaatctgatgagctcaggccttgaggggcaggcattggaggaaaagggcttttgtgtctctcttcatttgtattgctgctgatgcattattttcctatcttccactgattggctgtgggagcctaatccaatctgttgttatcttcacttttgctgctcaaacctccaaaatgactacagtattcattttgagggatgtcttctgtgggattggataagcagtggggcagggaagtggggtggggggaatgcggtgcttcaggaaaaatggggagaggaactttcttttcttcaaatttgagagcccagagaagtgaataggaaaaggttagctggcacagccctgccaagaagtagccatgcagtttcctaatctcttttgaccatagataccttatttttaaaattttatttttggataggaaatatattcacatgtttcaaaattcaaaaggtccaagagagtgcacagtgaaaagtctcccttccactccctgccctctgcagaggccaccaatgagtccttccagaaaaatgttatgtggatgtataaacaaatatgaatatattcctctttctcttttttatggtaatatacaacacatattgttctgtaccttgctatgctttggagattctttgatacttcattgaatttcaccttttggggatgtgaagatgtgctgtggaaagtagaggttaagagcactgattctagagggaaactgtctgggttcaggtttggattctggctctatgaacttcaacagttacttcattgtttttctgaactttggtttccttatctttaaactagggatcaaatgagttattatatgtaaaaacttagatttgtctctgacacatagtaaacattcaataaatgttagccattttttattattaggaaaaaaaccccactggaccagcgccagtagatctaggttttctcctggcctctgtgctcctgggatagctgggtaacttcctttgttcacaaattagtttccttacctttaaaatggaacaactcatccccactctgcttatccccaggatttctgggtgggtccagtgagctcatgaatatgaaggcaacttagcaattgtgatgttctgagcagatggaagaagtgcaacttaatattttcatagacactactttgggtggcttgaacccagtggtctgaactgggtggaaaaggcagtgtttttccttctgccagtggaacccaaaagccatccctgtactggtgttgtattttgagtgggagatagcccatggcaaaattttgaaatactcaggttttgtcttctgaccttttttattccaccccatccctctcctgacttccttgtttcattttttttggggggccaccccacccctgtcaaaacctgcttttagaagcaaagcagcagcatatgtcaaagatgacctcaactttccatttgaaataatttaatacagctggctcagagaggcgctggatctgcccaagttcatacagcaagtccagaatcaagctacacctagagctcattcttcccatcccagtttttattactgacatttgcattttagtgtgaatttgaatttgagattccttagcaaaaatcatctggtcgtgggggagattctggaagtatctttactaatccttcatactgaagtgttcttatcttttaatcttcagggtcagacctgtttgggaccctgagcagggagggaaagtcaggttctggttttagtactgaagggatgatgtctatagagcagtgggagagaagagcaccagaaaatgttgaaagcggtaacctccaaggtgagacttagggagaaaatattagttctttatatattaaattgttaatctcattgttatttaatttctattttgtggagtttttttttataaaacacatactacattaatatttaaatattgggataggtgtttcttgttttgttttttgtaaaataaattttattgtgtatatttgaggtttacaacatgatattgtaatatagatagatagtaaaatggttactgtagtgaagcatatctgtcatttcacagaattacttttttgtgacaagaatagctaaatgtttgtatttttgtttttaacattagaggtacatgatccaaaaactattggctaccattcttctaagactataggcttggtttctaatcttggcagctctgctgctaactaacttgatgccttaggaagcttttctcattggagcctcatttttcttacctgtaagaaagggaggactgagctaggtgtgctaactagttacttggaaatctccaatcctgaccacctctgagtataagaatccactgcctttggggctcttgagctgagacagttaaaaggagttcaagccctgacaccttactagatgctttatccctctatcagctgccttggtttccttcccttctctacccccaccactttcacctagcccagactggtagatgcttccttacataagtttagcgaacctacttgacattgttttgttacaagcacaaccacttttcctgtagacacagacctggtgccatcccttctgagctttgagggtgtgtctgattttgcttctattttgtcctctctggcagcctaggtttagtcgttgtatccctctggctaagtctttggtttcaaggtctgaggggaagccagctcagccagtttgagtcccttggggcctgacccaatggctgctcactgaatccctctgccacttcctcatccaggactgggctagacttttttaggagaacatagtccattcctgagcataaaaggcttctgacatggactagaggcattgctaggtgccttggccttggctggatgtcttttctctcacagtgagccaataggtagagggaaatcattgcaccactggaaactatcttccactttttgatgggctgtttaaatgcagatgtcctctctgggctgtaaaaactccctgggagatacttacattctctttggaaacgtatgccaaggtctagagtttttgcaagcctgtgtccttgctgggcatgctcagtagacgtaaaggtggtttcagttaattgaaatatattcatttttcctgcttcatctctagatataggagcaggtcacagtgctcctaactaaatgttgtttctgttcttgtcactgtaaaccagatggtcacatttaacgacgttaggacccttagttccaacctatctcctcccctgctcctcccgctaccttcagctctcctttctctacaagattttaacacgacatctgacaaatggataaaaaatgaatttccctttttctctctgccttgcccacccaccctctgcctgtggtgttgagtatagaaccatgcatgtgggagtcatggaggacagattcttcttgtagttctagccccctcctcctaccttctggaaacaaaggaaccccacccctgcccagaaaactccaaggcctggcttcaagtcgtagtccaggaaaagttaaagctcccaggactggtcctaaggcgactacatgaagaaattcaggaacccagatgcagaccttaagatgagtttaggtcgcctaagggatctgtggctcttagagcatccctgcatattccctaggtttgtcctggtcagctcccatatctcagggtagtaaggcaacaaaagtctccagtgggtagctggagctcggcattcacaccaagtccaagaagacgagcatggctcccagggcagggacattttgggtataagacccacgctggctcaacagatgggtgaaggtcagggtaacctcaagcttgagatggcatgttctgactcaggaactcatggagagggcattgctgagtccattattattatttttactaaccatctgtctcttagaatattggaggttgccttggggagatttaatacagctctaggaaatttcttccagattatagcatagagagatgctgctaggacttgctgttagaactagtggtagcttcagtgcctgaaggttgggacgggaatgagggtggaacagagcagaagcaaatagtctctcaaggcaggctgggagaaatcctctccgacaggccaccgtaattcctcagcctttctggaatctgacacaagaaggataagcctagagttggagttccagagattctggtttcttttgagtggcccagtgcagtaagaggaaattcctgcaatataaactctctggtcccagaaagattaagacagttggtttcagtgtggcacgtgattcagaatcactctggttgcttgttattaataaatatggtacggtggttctgagcaggggtctgtggacctcacattaagaaacagtgttgtaatgcgtcagaagtgccaaaatatcccagaataacttgacaattactcctgtttccaagatattttgtagatacaagctaatgtttatcagattgggagctgttgtagtatataggaccttctctagccaacatcatctaggttggccattcagaaacatgtcttctctctgatctgtgcaatccttggcccatttggctgcattttctttaaaggggatcattctctaaacaagaccaagttcttaacattgtgaactttgaggcagcagctgggtctcacttcagaaactcctgggcccatttggctgagctactggcttgggtttcttaccatctattgctaaggtccagacaagcaagcaacaacccttttctcatctgttgggtcaccattagagcagagatcaccttttaacttcctttggaagaagtgcaggaagaagctgttctttgttattagcctcagtgagaaaatattctggatggcatcatgccctaaggggcttctctgggttttccaagctaaaatgtcctaaaaggtcctggaaagtgtgaatcggcttatgaccactgttcatattgggctctagatcaggtggtctgtcttgctcaaggctgaccccatctaggcctaccttttgtgtctgccaggtgtggctgaacagtagatctttcattttattaaagtgaaaactggatagtataatgggatattgaaggaaactgatgtgtaatgactcacaaatcacacacccaaattaggaaaaagatgattttgtgtcatgaaaaaatatatgtacatacttccattcagcatatttagagtcattatcacttgagtgcattaattattctgccaagaaatgaaattatttacttgtgggcaatagcaacacccacattgaaactggaaacaatcaagtgcaaaatgttaaaacctgaggaaaagaaaaagcaactcttgggatgtttttgatattcacagtgggatttttcttacctagcatctatctctgcctctttccctggtgatcactgggcaccagtgcagatctttagcaaaaactggcctgccatagaagccacctagcaataaatcctggcaacaatggactggcatatagggcagctgggtacatattatgtaaacaatttccttggccccataaattgttctgccacctgacagagatgcttactctattgctgtgttctgcctcagagtttgcttgcttttagaactcaagtcagaactttaagtggagtatacacattgttcattatggattaagcttatgttttagacctatcattcagaagtatatactctggttatttgaagaataacactctggtcagcaacttgaatagctcttccaaatttttgttttctgcttatcctaggtagataaggttactgaaagaggcagagagagagagaggatgcagcctggagtcatcagagaagggattacggagtaggtcggccacaatcacacagctaggaagaagcagcctggccccagtgtcgctacgtgtaaccattggctaaggatatggccaaatcagaggcacagaagtaggattgatcattattttattggaggcagtagcaggccatccagtgaaatgttgagcaggcagtaggaaatgtgggactggaggtgagtgacagctgatgtcatgagaaggatgcaagagactcattttgacaagagtggtggaaagcccctgccttgttagaggtaaaggttggatccagagatgaggctagattaaggagagctttgagatagtggggagttactgaagcttcttgagcttgaggagtgatactagcaaaaatgctttaagattcgcatcattaaggcatagcttgaggaagggacagacctgtaagggccaaggaagccggttgggagacagtttgagctgatgaggaccaggataagacagtgggaatgaagagaatgcgttgtatctgagagggagagacatgaagaagaaagaaatagcagggccagaagattttccttaaatgggaaaaattgagaaggagggagaatgggggaatatgatgaattttgcattttattggaggtggtagcaggccatccagtgaaatgtggagcaggcagtaggaaatatgggactggaggtgagcgagaactgatgtcatgagaaggatgattcatctgaagaactaagtggagagaacaaaaagcaaaggtccctattgacttttgaatgcggcagtcaagggtttaagtgggaagcccacttctcaattttcccaggtagtctgactgtgttgccagcaatgcttgagtgagttatcttcaggaaaaagttctcatttttttgagcagaaagcagtaaaagcatcctatcaagcacaaagaagggtgaggagaattaagctgcaataatgacatccccgtcctttgcagagtaagtgttagcctcagtagaataccagagctggaagggacttgagaggtcatctgtatggttccagtctgtcacttgacatgtaaaaaaactgagacgggctgggtgcggtggctcacgcctgtagtcccagcactttgggaggccaaggcaggcggatcacctgaggtcaggagttcaagaccagcctggccaacatggtgaaaccctgtctctacgaaaaatacaaaaaattagccaggtgtggtggaagatgcctgtaatcccagctgctttagaggctgaggcaggagaatcacttgaacccgggaggtggaggttgcagtgaaccgagattgcaccactgcgctccagcctgggcaacagagcaagactctatctaaaaaaaaaaaaaaaaaaaaaaaaaactgagacagggaaagggacctgtccaagatcatttggtgagttactggcagattttcttccaatagccaatctgagtctttactgtacaccatggtacctcatagctattgttggggcagcctggttcacaccttcccaaaaatagggaggatgattatccttcaacactttgggcaagatagccagagcgttttcaaggctgtattaaaaggaatctagctttttcaggagagagcataaaatctcagcttgttttagatatgcttaagggagcaagggaaaataatttgctcttgcccaagtttagctgttcaggagaagggggccttctgagaggatacgggcagacaccaacctgagaaaacctcataggcaaacccctgtcatgtccctccttttcctcctacggagcttcttggaaggcaggtccagctcatctaccttcatggcaattggcatatttgctattccatacatgtgaggttcacattttttaacccattctcccttctgctgcttcttattaaaacactaatatttctgacagccaccaaggctaattaaatgtctattttgggggtggtgctgttgaactagaggggaagaacaagaagttgtagataagtggcatggctctaaaagactgggtgacagccataatcccaagttttttcctgtgttaacacagcctgacattgggcatgctgcttacatgaccccaaatacccttttgcagacatttaccaacaactgaggaaggccttgtagataggaagggagtgctggaggcagggagcacaacatatggtgtggcatggggaaatctgtgaagaatgaggcatcagaagaggcaagggtagggcctacactaggacagtccattagggcagtggttctccagatgtgattcccagaccagcagcatcagtatcacctggggatctatttgaaatgcaggttctcaagctgcacttcagacctacctaatcaatactcaaggcctatgtggcccagcaacctgtgttttaacaagacctctgaggaactgagaatcactgctgtaggtcattcacagggtgagctggtccccctccctgccatttgactggttccatgggggactggcaaatagcaaagctgtagagtaaggccaactggagatttaaatctgctccaccacctactaactgggtaactgtgggttacttgttttatctcacaagtcatcttcagtaaaaatggagatgttaatgcttacattggagaattatagaggttgaaatcacaaaagaaagccctttatccagtttgcagcatatgttttctacaagtataagcttctcttgcttcgtccttccctttataactcttttactttccttctgtctttcccatttcttcttctgttcccactgaaagggtccactggccaccccaagctcactgcaaacacacatgccttttttggtcacagagaccagccttagatctcagactcccagtgcctccagggtatagcaatcatatttctaggttaaaaatcaaggcacatgacagctgataaacagatatatctactttggggagcaattagatagaatatttgatattaggattgtcttcggaaatctggatacaaagaaataatatcctattctgtctttaagcataatgcaggactcttaaccctccccatcctcttattcatgtccaaaagttttgttgatgtgggagtgggaaacactatgtgtcccactcacttgtaagtctgagcaagagcttccctatatttagtgcttcctctgaaatgtcctggggattgggaattattttgttagaagccacagtagtgctgtcctaaggctcagagctctttgagtaccttgctagaatgatgctgctccatcttctggctttatgataggcttgcaagatgaaggatggtaacagttggattttggcagggagggaatataaaccagtttgggaatagagaatataatctctgctatagctactcccaaatggccttttcttggttttcttttttatagctctgtaccatttgataatgttgatgagctcttgctgcttgaaactcttgtctttgacttttgagagatcatgctcctttgtatcctaatgatgtgctaacagcttcttttagttttatttatgtagctctttttctgttccttacctcacattccatctttaagcataaatcttgatttcccaaggcttctggccttagcacttttttccagggcaaactctgattttcacaatttcttctgggccattgattcccaaccctgtatatataccctaatctctcttgagcttcccacccacctgcatgtcctgctggccccccatatttaacaccttaaagagaaaatttgtcatcacttcttttgcaaagccaagccaatatttcctcctaatttgtcctatgctttaattgacgtttgcacccaaaaattaactttgacctttttcttttcctcagactagattcaaggtccttcaaacatgacttcactcacctttttagccatcactccctccactcccctttcccaaccctaacctctccaaactccactacttgttcaccatcacatttcccagtcttcttctctgagacttggcttaatctcatttctctgcttcaaatgcccctccctttcctcctgtatctggtaccatcctacccatcctttaagggctatcttcattgccacacaaaacctttctatagcccaatacccatgtgtaatcaacctcctttctctgaagtcttgtactaggccagcacatgccaggcactgtatatccaccatctgagttcaccctctctataaccctgcctgtgaggcaaacattattacccccattttgcagatgaaaaaactgagacccaaggttgtatagttagaaactctttggcttttgtgaaattatactcctagatgtcataattacatgctgacaattacatttaagtttgtgtttctgactcctcttctattcctcacctcctattgtcattgctactttctaaagtagtaaagcccagaatcgaaggtaggtatgcgtgcccataaaaccacctttgcgtcctgctggaaagatatgcattgttggtacctggaaaccctttgttcttcaggtaaggactgcagctgagtcacagtgagcagatccctgcacacagtaggagctcaatgaatgaatgttggatggaagatggatgagcagagcaaagtgcattttaacaaaaattgtagcaagttaaaagttaattctgtacacaaatggaagatttggaaccaatttccaggttaagtttagtttacattttcaaaacaactcagaagatgagggaggaacatccctttgctccggcttgtgtttgtgaggagagaacacagaagccccacacagctgttaacgccttctggattagcgttcctctcacctccatgcacatacctgtcagctctcagttcagtgttttataccctacaaagcagatggtagagtagaattatccccattttataggtgaagaaactgggacccagaggcagaatagtttataagttaagagcagagtctctagagccagactgtgcctctactggaataatggcttcagtagttattggctgtgtgaactgcaaattatttaacttctttgagcttcagctacctcatctgtaagatatgaatagtaatagtttttccttaaagggctgctgtgaggcttgaatgaattaatgtatataacgtgtttagaatagtgcctgacataatagcgctctttattagctaacatcatcataattatcattacacctttagctagtagtataacaaggtcttaaattcagattattttttctacctgtattccctctctgtggtgttatgttagaaaaaacactagtccagaaggctgaccatttgatgactgtaggcaagttacttttgttaaacctcatctataaaatgagggcatgaaggtgatgatctttaaaattctgtccaattctgacagtcattgattctaagtaggccctgacaacaggcttgcaagttggttagttgtttttgtgaccactaggtcctagattggctttgtccagggtatagctgagccttgtgacctgagggcccaggtatatcagctggactaaatgggggacaaaagtcagcgatctgcttctgggaaaagccaggcatggagttcctgaaaagaagactgcaaagtaaaaaagtatagacagtggaatcagccagatctgggcctgggagacctcaaagagcaccacagatagtgtcctgagcagaaggttggtaattgatactgagatactctttgacccttgataaaaagctatggatatagctttaaactacaggtcttaatggtgctctgggttggggctgtatgtgcttactgagttctaacaatgcccacttgggacccatcttttccaggagaggggagacttctctataaaaatttactttagtaagccagtgaccagcttttctttttcttcactgaggccaaaacaaggagaaattgacttttagtacaattggaagaaagcaagttcaacataaaaatgaatgtcctcagcatcaggggcacctatgattaaaggtggctgtgtacatctcctgtagggttctttaagaataggagccaactggcttatgatatcatagatggagttcagtatagataatgagtagacattggtagtacagtttgataattgtaagagcacacaaagttagaagacccagcttcataatgtattacttgtgttattggctgaaggactaggtcacctttctgagcctcagtttcctcatctttaaaatataggtaaatggccaggtgcagttgctcacacctgtaatcctagcactttgggaggctgaggtgggcagatcacttgaggtcaggagtttgagaccaccctggccaacatggaaaaacccccatctctactaaaaatacaaaaattagctgggcatggtggcgtgcgcctgtagtcccagctacttgggaggccgagacaccagaatcgcttgaacccaggaggtggaggttgcagtgagccaagactgcgccactgcactccaacctgggcaacagagagagattccgtcccaaaaaataaaaatgaatgaatgaatgaatgaatggtaatagtgaggcccagttgattccgtaaggatcaagtgatgtagtagatgtgaaaacacttagcaaagcgtaaagcatgaggtatttgaaaggtggtgttgtgaaaggtcctgctggaaatttattttttatctatcctgaagagctcaccctatgccttaccttctgtggaaggcacaaagatgaatcctgagccatgacagatgcatctggcaggacctgaacaaaacatgttaacttaagtcaaagatcagcatgtgtgtatgtgtgtgtgtgttcatatatatgtgttcgtatgtgttgtgcatttattttgagaacctagggttattctgtggctagcatgttggagggtagatatatgagacaggatgtatattctatagactatttctattgtcttaaagttgttttagttttggtcttatggagccattattgccttgagcaaagtaggctgatggaaaagctgacttctagaggacttgttcagaaattcaatgcttgggagagagtgcttgagtctctttgcctgataggccatgtgttctctattctggaatctgttaccccaaatgctgagaagactgatggcccatacaagctggaacagttgagggaaaaagaacaaataacacagtgagcaggatggtaaagagaggcagactacctccccacccccaccccatccctatcaccgtgcttagatgagtttcatgaatgtctgtttgctggtatggcagtggaatagatgtctgcctgctcttgtgtggagcccagtcctgctagccgtgaagtctagtgagcagggttagcgtgcattccatgcacaggtcctgccttgccagctgatctccagctcatcacttgcttgttcagttttgccatccatcaaatgcagaattcaacccagacctctccccctactgtatctcacaggatggttgtacaaatcactgagagaatgtgtgctaaagttgagtttcttgggtacaaggcatcacagaaagccatattctttcctacccatgacctctctggatggcatcatgtgtgagtgagaggaggaggctgcaggactggggtccattatgcgtgaggaatgttatggtctgttaccccaggaggagggtcacggtggggttaaataatgtaccaccaactctcaattggtcagttccaaggaggaggaggaaagggggaggagcacagggaattgaaagcaaataagcttgagtctcattttagccattgctgtcagcctctccacccattcctgacctagagctgccttgaagcaccaaggagagatggactggagctttctttgttctgcacaggagaagttcatgattagggataaaaagcatgaggcatatgtagtacatattcatattctgggtcattccatgcactggctaacagagagttgacagtattgtttgtcttgcggtctaatggaacttttgttccagtgccatccccctcacccctatctctcaccacttgagtatatgagtttctctgtaagtagtagagctctgtgggtgggggaaggggcaagcaaggtagctgtgtggactgaacacattctcattttgtctcctaagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgagggtgagtgtcagtcttcactctcctctcctatttccttggctgcctgtacctggcttccccttcaccagcctctgttctcctgtttatttctctcctggtggcttttctcatatttttttcctttttttaaaattgtctcatacagagaacctgggcttcctttaatctgtgcccttttaatttttagacttttcatttgtctcttgtttaacacccccgccccaccacctcccacctttgtacaaatcacttaccttgtctgggtcttggtttcctcttttggggttggccttggtggtttttgaataagactttttaaccctatattgctgtgaacttttgtctttcttatctctcttttttctgctttctatttctcatcttttttttattctttcttctcgtagtttcttcccatctcctcctcttgctcctctgctcttctctccttcctgtctacttctttgcctctcacacccctgtgtgttgtcactgtgtattcagatgttaatataagagtgtgagctccctgccccccaggcgctagagcttactgatatcaaattttacttttttcaagagaatcaagtggctgggatctaaatgtgctgggggtgggaagcaagtggcatgtaaggtcttgcaagccttctgcctctttgacattgtaccatgaagaacctggcccttaacagagaggctcttgggaggaatttctcagcagtttttgctttttctgggtcactgtaaaggaagtgatcccaatgtgcttatgacctcagggtgctatgggagaataacattggttaggtgtctcagctcttattttttcttggaattgtgagctggaatcagctatttgactattttgagctctgattttcctcatctgcacaatggtcttgacagttctttaatgccagggcatgtcacagtgaatgagataaaacatgcgaaaactgctttgtggcaagacaagtactgaagctacatgagggtgtcttataactatccttacgacagcctatcacgttttgttagtttctcctgtaaaattaggctgaagtcttctagaccccaaacaaaaggtcagaagggctagctagggctcctagaggttgaagggccccaatattagaattatggcaatgtgatataaagaaaggaacagggcatttggagttagaaaactctagatacagttttactaccttctagctctatagcttttggtaagatttttaacttccctgagccctgatttcctcatctgaaaaatagggataacagactttttataaggaattagatcatacatgccaataaggtgtctagcacagtgctagacagatattaggaacttagcaaatggtaacttattttatgattatcatcataattataatcatcaccactacctttttagctccaagaaggtccatgtatcaaggcttcccttgaggttgatagaggcctccttcctcaaggtaaaaaatccagaaagtattgttacctggttgggacagtttaggtgagggcactgcctagaagcagaggaatggacaaaattacctctcattcccttctatcatgagaatcttctaatgaaatatccaatcttttcttctcttcagtcagagtctgcaaatgccatctgtgtcccatctcatctttgctggttaaagaatcagtcccagggatagtcagaaaaagcgtatcaataaccacagaccttcaggactaatgtgaggccctgtacgcatacagctggtatgtcttgtgcttacagacctccctctttaaaagaaggattaaactgtaccaaatgatgatgtcacccaaatccaaatgcatttcattttcaaggaaatgttacttttataataaatagtaaatccaaggatggggggaaatgattgagcaagccaggatggctcagggaagcaaatgacagagccagacttcagaatatcagtgggcagccattaatgcccctaagtccaaggccgggaggagtgttcctacaggaacaaagccccagcagccagagtctagctcaagtggttctcaaccctggctatacaacagaatcacttcagtagcacaaaaaaaaaaaaaaaacaaaaaacaacaagaagaacccaaacaaacaaaaacactaacacccagcctccaggctagtaaaataagatcatttgactaaattggtaactgacatggtgaggtatcttcattccctacctggaagtctcattgctgacatttgaaccctaggatggataatcaagggtggttagtgtggttctgttcaagttagccctacctgttgttacacattaaaacccaacctgcagtctgggaaacccagatgcttgcctcagttctattattagaaatgcaacttgagcagcttcctatgcatcttcaaatatcagttttcttccttgtaaaatggggacaattcagtcttgtaaaaatgctttgttacctgtgatatgctggatacttgtaaagaggaattataataccatttagccactgtacaggaacttaccaggtatatgtgtcttgacctattcacacctgtctcctctgttgttcagaatttcatacttgtatgtgcttatgtgtgtgtatatgtgtgtgtgtgtgttctcaggttctttcctttctgtactggggatatggcttcacaagagcaatgtaggagctgatataccttcccagtagttggtaaggttaaatgaattaaacttgctgaacatcagtcctcatatctagttgtcgacatcgtcagctgttttcctgggctggtttccctgctaggagctaagggtagactgctaggatatgattgtgtctctaagtagcaaatcccacctctgtggtgggcctccttttgtctaatagaccctaacttcaagtcattcaggctcttttcctttgtcactgtgcacaaaatgaaccttttttttctgactttgggccatggcctgaggagagcttgctgcctaattaagggtaggttgtggacaggacacatgacaacctgttactgatgggaggtgaggctcgtgtgacaaggcatgggtttggtcagaaagtaaagagcttgctgaggtgtcatcaggagctggatatatacttttcttgttctttcaaattctttatttctctggtttctggcctgcttggaagtatggagatgaaaggatcacctaagccaatcattaccatcatttcttggctttctacagaccagatgtcatggaaacccaacttttccttttcaaaggaaagcccattgttccagagtgtgacctggcttttatttatgtattatctctttttggctgcaaaaagagatacttgggaaaagcttttcacctctatgaaaccctagattcactgtagatttagaactgaaaataaccatcttagccaagagtggccaacttagatgcttacaggggccaattaagtgagtgaaacaaattgagacaaggggtaagtgggcacctgtgtccaactgggagatccatgccccatctaaagacagcaaaagtgacttggatggttcccatcattagagtgggatatagtggagaggaaagcccagaggggccagatcttctagtatttcaagaaaagccgggaattggatttttatgtaaaactctttatatttaaaaaaatgttaatgaggaattcatatttttaaagaagcacagtgagagtcaaacaaaacacatctgtaggataaattatctcccaaggacccagcttgttgccattggtcaccctacctccacgttgtataaatactgaggcaacatgggcccagaaaatggaaatgacttgctttctcatgtagggaattagtggcaaagccaggacttgaacccaggcctcctgaatcttaagacaattttactagacagtctttgtctaataagtttaatgtcttggcttcctttggtatgttttctgccaaattatttttttcctgtgaataggtcacatgttcctgttttcttgtaggccttgcaattttttgttgaaaacttggcattttcaatattataatgtggtaactctagaaatcagattttcttctctccccagggttttctactgttgattgttgagggctgtggttgtccatttgtttagtgactttttccaactatttttgcaagaccgtattcttgttatatatggtcactgaagtctctgttcttttatctcattggtcagccaataacctgacatttctttaaacatctggatccaagaagaaacaaacaatactactttcctggtttttgtagcttgactctgagctggagtacccacttgagactgtgccaggtcatcaactcttctgtctcagccttctcctcctgtttgtatgtagatcacacatcctccagaaatataagcctatggtcctctgaggtttttttctgagcatgcatctggtcctgggcatgcgtgttatagtgtgacttccctggtatgcatggtggcccttatgaatccttattccccaaagaaacttcctttttagcttcctccttcctgtgctattgcatgtgtttgctatttgtcctgtccacaatcccttgtcccaagtgggcatgagcagtgtatgtctttaaatctttcaacaaaggcagccacagcctggaaagcctctccagccagaggtcaacctctgtgctagtccctcagtgccaaaaaggtcaaaatgcacagctacaatattgtaaagaacaaggtcattatctcctggcaccagcaagccacaccaggaatgtgggccactgtcacctcagccactggggaatggggaatggtaagaggataagcaaaagtgcttcaatgctctcttaccaaatttttgctgcccttttctgcattacacagtcccctgtaagttgctgcaagttttggattagattctagagttccaaaacaatgtgttctgtcattcattgccagtttaaggttgtttcagtggaagaactgattctttgtgtgccctgctccaccacttttagtgatgttgtccccttctgaatcttaatcctgtgctttctggcctatagcataatcaagaaagggcaggcttgggctgctaacaagactgttaacacttgaggacttaccttccattccagactaaaggcaatagtgtttttgcgttcttgagaggagtttcactataccaacccttgtttatccattcaagcttcaaagtgttcataagtctctagtcttaaacatttatatcatttatgtagaaggtcttgcttgtggccctagaggtaacacattataggttgtgagtttaggctgacattaacagggagagtctttctccctggattatggctatttctctcccctgtactagaatttcaaatgacattattataactcatttgcattcacataatccatcttaatggcttctcactatgcacattttttggattacatcatctagtacatcatttggctaattggaggttttttatttttttcttttaatatggagacctcttcagctcagagagaatcttaaatgtagctgttacatcacccagatgattcctccaaattaggtagcacaggtcaccctcatagaaatcccaagttgaaagcaaccttgagagtcatatagcctatccctcagcctccaggcaggaccagagctaaaattaccctgggcttttgagaacctggccagcatctgtaaaccaagcttgaactactctgttatttccagctactagcccttatgctgtagtctgagccaatttcttgaaacatgttgcttttttcaataggaagatggtatttaagagttgacaccagtaggagacattctgaatggttttcttggctctggggctttccaaggccctattgttgacccatagcatggatttgtaacctggttggctgcctgagttgaggctatgatcttgggcctggcacctgtttttctctgtgtaatcaacccccgggtttatttggggattagcttagaccttcctagcatcgtgtatatactgccttggtggtgtgatgacttgaggagaggaggaccatgactgagtacctggagatgaggtctgtttctgtggctctttgtaaagtacaacatttttggaaaatcatcatacttgtatatatatattttcttttttcatcagtatatttatcattatgagtaagagtgaaaccacttatctttacatggctctagtgctattaatatcttctcaccagtatttactaagtcctgaacaaaagtgactgtctagcacttagcaacagccacctcctggagtggtctagacaagtactaagggtatctggcatcttgagaggtctgttgtcctctatattagagggtcactagagaaacaatactcagaagtgggttggtctctttttttagttttcagaagtgaaaactgacagctccatacctcttcaggccaccagttatacctcaggacagatctgaaatagtttgtccttaagttgaactagaatctgtctttctggagcttctactcatgggaagggtgtaaatgtccaagagaactggctctggagataatctttctggattagaatcagagcctttccatttattagcaaagtggccattgtatgcttcagtgatctcatcattaaattgaggatataacaacacctatctcattaagttgtcaggagaactaaacaaaatacaggaagagcactgacaatgggatctgacacataggaaacactcaataataatactggtaatacttgcagcaaactcttaatgtaaatggtagaaataatgtcctcatttttccctgctcctctctcaaaccctcttggaatatactgactctccactctgtctatagcccatcagagatctgaaacctcagaccaggtcagccaagcctctcctgtcctccaggcttctgagctttcaccttttagccattatttggatgaatcagtttcttgttgctgctatgtgtgagtggctagactgaggccatccgggcatgcaaggcccactccattcagccacttgtatgagaacatgggctacatggaggcctggacatgctgacactgccaggctttcaagactaataggaatgatattacaactaatgaccctgctgaacatgtaattggacaatgttctttcttggctgttctgacctctaccaagaggcataataatgttactggggccatacatcagcagttagcttccatttaggaacaaataaatggtggaacattgtgttatatgtaggaacccaagaatggattgaaaaacttctttttaaaatatactggggaaaaaagccataataatagacctgaacattctgcccattggtccaactctttgttttgataagcttattaaggtagtacagttattgacattgctgctcagtagagcttggccctgaatgccatgtgccatgtgtgcgatggactcattcccatatttatataaagtaagcatagcttactgttaagcgtacatttaataaagatgctatatacgggacagggccagcagtagccctgaaaaacagtgcagccagatgaacttgaatttggggcaggtcctagaggttcactttcccttgtgggttgggataggctgagagtgtgtgcgcagtgggtaaggtccctcccaactgaaaatattgggagaaagtccagcccagtaggtagagtgtagcatcagtaggcagcagacagagggtggtttgttgtcatgacaagtgactggtattattggtccaacgtcaggttgtttagtgtgcttcaataagcaggtaaagcatggtgaccaggtatccagaggcagggagtatgcagtgaaaatggtttcttaatttgtagaatgaaggacttaataaaaattcattcacccaacagatgatcatcaaatggctactgagaagatacagaggtactctagaacttcagcccatcctctaagagtctgatagtagatgtgaaaacttatgcataagggaggtgatttgccaaagctctgtcactttagtcaagttctttacctttgccaaatctcacttttctcccctgaaagatggaggggttggaacagatatactccaagaacttttctagcccattctccataatttcttcttctttttttttttttctttgagacaggatcttatgcttttgccctggctggaagtgtagtggtgtgatcatggctcgctgtagccccaaactcttgggcccaggcagtcctgccacctcagcctcctgagtagctgggactacaggcacctgccaccacacccagctaattttttgtattttttgtagatgcaggatttcaccatgttgcccagactggtcttgaactcctagactcaagcaatccacctgcttcagcctcccaaagtgctgggattataggtgtgagccaccaccctggctaatcttgttttagttgaggtaaaataaacataacatcaccttccccatttcaatcattttaaagtatacaattcaatgcatttgcaatgttgtacaaccatcaccactatctcattccagaacttttttatcaccacaaaaagaactccatacccattcacactcattcctcactcctctctcctctcagtctgtagatggtataatgttttgtacaaatgttagcaggtagaaaatacaggatagttagggaagggattaaattcataggaactgaggtcaggaagaggcatatgacttcagtagctataggagactacatcagcctggatacaggctaaaaggagtaaaaaacataagacagatgttgcgggaaaagcctcaatagggaacaggtgtcatctaaggcattggtactatcctggaggatcagaaagtaaatgagaccctgccagacttgcctttaacttgttagtaaatggcatagcccaaacaagatcacattccaactccaaagccagtgtttgccacatcaccatcctgaagtgttttttttttttcttttctaaatgtctgtcaaataattgcaagctttctgtgagatgggtaactcaggtcagcttgatttcagcattctgcttagcgtggctttcatcatgaaatcggtacttccatatctgaatagcttaaatggaagtcttctcttcattttagctcaaatagaaagaaaatcaaaggaaatacagaataaatgaacttctaaaggtcctggcagagcactccttttttggctacttaactaattaacctaaattctatcaacgtctaagcaggataattccatgaaaaccaatgaaaggagaagacttaggggtagagtggagtgtagttcttattagaggcatctagttttcttgactgggaaggaagctatgttatctgtgaagggtttccctacactccaatccacccccattctagcttgagttctcactttaagaagccttgtcatgggcagaaatcatcaatacctccagcctcgactaagtaagtctccattcgttgggaagggtttttgagtctggttgtcaaggaggtggcatttggggtataagaaatttgggacaattgcaaagcaattacaaaagtacttcctaaaactcttccctgactagagaggacaatgtttctcatatgttgcttcattgttctaggggcagatgatgccaacctaggggataataacaagaacagctaatatttgactctgtgctagaaactgttttacatgcacagtttaataaggattaaataaactaccttatttaatcctcacaacagccccatgagatagatagatattatttctatttcagaggtaaggaaactgaggatcagaaaacttaaagttgcttactctgtgttactcagaggtagttgtagagccaggatttgaaatcaggatcccgagtcttcaccctttaccactgtcacagactgtctctcctaattttggcctaagagtccagagactttgcttcaatcctgactgccactttgatgcatccccctgtctggccttggatttctcatctgggaaatggaaataaaaaggtttgcttgcctgccttgcagggctgttttgaagtccaagtaagagagttcgtgggaagacactgttcttgaactaggttttcagagaagccagggacaaaagaagaatgatagaaaagagtagggaaggccttcctgaagaaggagtagggggcaggctttagaaggatacaaggtacagaggtgtgaataaacagaatgtgttggaatgaatgggaagggtagcttgcctgaggtcacacgtctgtgttgaagagcagtgaaactcggtgggtcggtcccattttaatgtgctgatgggaagccatgaatgcaaaaacagtatattcacacaggtcttttctttttctctttttgtctgttatataacaaaaattttcattgctctggttgaagctccttatttctcattgtgttggtgctggagagggagaacaatttgttagcagccttcttattatgatacttcatataattagtgagagttattaaatcttcccttgaggggtagaggagtagtttctgtgtctgactgtacataccgtgctgattgtctttgtgccaggcaggaatgctaagtgcttcctggcatgcacattcaggaatccctaagcacttctgatcctcctgaaagctgagactggggctccaaaactgggtgtgtgtgtgtgtgtgtgtgtgtgtgtgtgtatgtgaagtgggagctctgcttgcaactaaccaggttcctctcagtccctcacattcacctttgtatccacacttcaccattgcttcactgtggtggcagagaaaaggccttttggtgacctttgttattgaagagttcacgttccctccaatctctcctttatctgtgttttgcccttttgtagtgtttgctgagatttttggctggcaactttattcagacagagacagagctcatgattagaatgattagaattatctgaaaaaggaaagggctgccttgggagacagtaatctcatcattcgttgtgttcaagcagataggctgtgcaattgctggcagggtatgttgtcaagggagtttatgtattgattggggagcaaggggtggcatggactagtccaccttccatttcctttataaactgattctatagctctgagagtctattgttcaataagactggcaataacccctcaccttctcaaaggatgtcttgctttttactcctctctggttgattagatttggcctttgaaaatatcaaggtgagatttagacaataccgcttacccattctcttctcagaaatattacactgctggagacaggggccggctggctttctaagacactccttgagcctttattgactttatgaaggaattactggctggatattatggtagttttcttttagaactactgatccatttgcagggaggggctactaaagatgttgaagaggttgtaccaagggctgggtaatcatcactttatcatatggaacaatggtgagtctattggaatatgcatataggtatataaatgcaaggagagaggttgacaaggatttcacacaaaatccataaccatggtttcctcaggagaggtagaatatggttaggatgaggaacaatcaggggaaatttcaccttatctagacagttttagctttttatgtatttattttaatagagatataatttccataccataaaatttaccattttaaagtatacagtttagtgggttttagtatattcacaaagttgtataaccatcaccattgtctaattctggaacatatttttaaaatcatttttaatagataaaactgtatatatttgggggatgtaatgttttgatatatatatatgtatacacatattgtggaatgattaacatatcatcatctcgcatacttatcattttttgtagtgagaacatttaaaactgtactttcttagcaattttccaataataatagtattctattacataactatgccatattttggtttatccattcatcaattaatgaacatttgggttgtttctacttttggttgttatgtataatgctactatgaacatttgtgtacaagaatttgtgtgagcatgtgtttttatttctcttgagtacgcacctacgagtggaattgttgaatcatatggtaactatatgcttaactttttgaggaactgccaaaatattttccacagcagctctaccattttacattcctgccagcagtgcgtgggagttccaatttcttcacatgctcgtcaatacttgttattgaccttttaaattattacagccattctaggacgtgtgaagtggtatctttttatggttttggtttgcatttctcagatggctaatgatattgagcatcttttcatgtatttattggccatttatatgtcttctttggagaaatgtctattcagatattttgcccatttttaagcgagttgttactttattgttaagttacatatattctgaatactacatctttatcagatatatgatatgcagatatttttcccattactgggttgccttttcactttattgatggtatcatttgtagcacaaagtttttaattttgttgaagtccactttatttttgcttggttgcttgtgttctaggtgtcatatctaagaaactattgtctaatgttacagattttcctctatgttttctttaatgacttttataatctgattccattcagatatttcatccattttgatttaatttttgtgtatagtgtaaagtaggagccaaagttcattctcctgcatgtggatatccagttgtaccagcaccatttgttgaaaaaactatattttcccccttgaataatcctggcacctttgacaaatatcaattcagcatgaatgtaggatatatttctggactcctggttttatttcattgatctttatatctattcttgtgccagtcccccattctcttgattactgtaggtttgtagtaagttttgaaatcagaaagtgtgagtcctccaactttattctcctttttcaaaattgttttggttatcctaggtcccttgaaattccatacgagttttagtaccagtttttcaattttctgcagacaccaggtgagattttgataggtattgcgttgaatctgaattaatctgaggagtattgctatattagcaccattaaatcttccaatccatgaataggagaggtttttctatatagttcttctttactttctttcaataatgctttgcagttttcattgtataagactgcacttcttttgttaaatttattcctatgtattctttcttttcctatttaaatgtgatcattttcttaatttaactctcagattgttcattgctagtatatagaaacataattgatttttatatcctgcaacattgctgaacttatttattcattataaaaggtttttttttggtggattccttatgatttcctgtatatcacgttatatgatctgtgactagagatagttttacttctttctgatgcaatgtcttttatttctttttttgtccaattgctctggctagaaccttcagtataaggttgaataaaagtgatgaaagtgaatatccttgtcttgttcttgattgtaggatgaaagccttcagtctttcaccattaaatatgatattaactatggattttttataaatgttcattattatttggagaaaagttcccttctatttctagtttgtttagtattttttttttaatcatgaaagggtgttggattttgcaaatgccttttctgtgcctgttgagatgatcatgtgggattttgtaaccttatttcactcatatggtgtaatttacatggactgattttcatatgtgaagcaaccttccattcctggaatcgcatctggtaaggtgggcaatttgtttttaatatgttgctggatttggtttgctagtattttattgaggatttctatatttttgttatttggaagggtttgtgaaagattgatgttagttattttttaaatgtttggtagaattcaccagtgaagccatctagtcctgaggttttttttttttttttttttttttctcccatgtgggaagttttcaagattgaatgaaattatttattaaatctttttcttgttataggtcttctcagattttctacttcttcttgagtcagtttctgtaggttgtgtctttctaggactttatccatttcatcaggttatgtaatttattggcatacaattggtcataatattccctttaattcttatttctgtaagactggtagtaatatttcttctttcatccatgattttaataattttaatctattttttctattttaactttttgcaaggcaaatgtgttcttgtataatgtataattttaaaaatagaaaaaaaaatggaaggcacaaaataaaaatgcacattaaagatatgggtatattgctaactccctggctgtctctgtgggtatcagtttctttattacgaaattgagaggatggattactgttgctgaagtttttgaaagcctttggactatagtatttctatgtttgagcatgggattaaaggacatagatgagaatatttgtggacggaaaatagaccagtctgggaggaacccaatattcctaaaggaagtagtaggaagtaagagtggaaatacagattggagtcagattatggtaatattttaatgtcagggtgagggatttggacttgctttataatcagtggagagctattaaggattttgggtttatgggattagccagtcaatgtgatagtcaaggaaattggtctaatagtggtatgtgggaagggtaaaagctagaggatcacccagggacttgttcaggtataaaagtatgagagcaatgacagtgaaaatagaaaagggagtaataaagaccagagattgtctccaatttggaaagcactccgtggtttagaaggaggagggaggagtgagttgtcttgctcatcctcatgtccttcacagttagtggttaggcacagaataggtccaaagtatttgttaaattgaactgcattaatcagccttgcttcggagttcagtgaagttcaaaggctggtttccccagcctttaagcactctaagaggacttccaggacagcctttcaacctggcatgttccaggcattgtctatcttcttacttgtcacccaggcatctatatgtgctaattgcagcatcaatgaagaaaaggtacacattagcctgcacggattgttgggcagggttgataatggctctctggtctgatatttcaaccagggcagataagcatatgggctgacctgtgtcagtgcactctgacatacatgcagacaaagaccttcctctgtacagaacagataagctctcaagagcagaggacttagaggttagaccagaaagtcttatcattaggcccgggggatgttttgtgggaacctgggatcaggagaaaaacagttaggccttatatgccacctttttctaggctaagaaacatcttccctcaaatgtcagctctataaagggcagtgatttctgtcttttttatttgctgttgtatccctaatacctggcacattatccacacttggcatagatttaatgaatgaatgaatctgttagtagttctttgggatgaaagcagcatcttaacctaaggaatgggcttctggggttgttgcagtagagtagatgaaggtgtcttctcagaagctccttatgaaggaccctgctacacaggcctttagttataaccagaaggacttctctaccaaattctttataaggaatctgttttcacttggctgcagttgccttcgtcttttctcattgttatttggaacgacagtgtcatggtgtatagcttgaacctaaatgtggttctatttctgcctttacatctgcttcccctttccttcatatcctgtcttcattcccactagaattgttcaaaatattcatcttattccagctatccaaaagtgaacatttggacctgacttttcttaaactcctaagaagaaaagaaatgattcttattccttaaaggcctgcctatgttaccctttccatagcagagtttagcttgctttgtgagaagcagggaaaagctaatggattattaagagggtgaggttttcattggtacaaatagacagcatcatgtatatgagatgtttgtttcagtgccttaaatcactttttttttttgcccaggtctattcttttgaataattatctctcatattgcttactgattgcattaaaggacagctattagcatattgaagacacaaagctgaccttttagaagctggaaagatatttataatggagcacttgcagagggtgataggttttggatagagatacattttgcaaatttggctgtatatacaaaatacataaaaacagagtgagccctatttactttggcctgtgacaattcagtgagatatacgctggtgacatctctaagttcactgagtggtaatcatgccccctcacctcctgtgagaaaaagaaagaaggaagaatatacagagttgggaagtaactaccatccttctagttctatcccaaagcctcttccccccgagtgattacccactaaaaggcttttctgatggcagaaatagggatgcatctaaattgtgtgattttagcttcttgaggcaggaatgtggaaaaaactggggtttaaggagggaaaatatggaaaatatggagaattgattaaacctgttgagacaactggcaagctctttggctaattacccctgacagattttgtcactctgccaagcgggcccacccttcgtttccttcctgcccccatggtttccccacttcctaggactgtggggggtggcgggaagggctatcttcttgggccttcttgattttcagtcaaagtcatctagaatatccagagacatctcactcggccgtcccaaaggttttttttttttttttttttttttagcttcccactgccttcatgatttaggatggacagtctcaactgttagcgaatttatcagtttctgatgattctaataattgtctgcccaccttggcccaagccctttccttttcttttcctgtcttccttagaaccagaggcacaaagattctagcacagtgtttaaaagcataggctctagagacagactggctcctatcccagctcctctgcttcctgtgcgacttgggatagattacttaacttctctgagcctcagtctccttttctgtgaaatggtgataatagtggtacctatctagcagggctgaatacagtatattgcaagctcttagcacagtgaatggtgtatagttggtgccaattaatagctattgctagtatgtggtggggaagtattctcccatccctatcccagtcttgaagaggtagagatctttgcatgtccaaggcactttacagtcaaattttgatgattatttgtatatcccatcacagaaatcaacactaaactttgttttcaagacacccactctagtatttaactttggcctctatacttgcaggtgcataaatgctgtgttttgacagcaatccaaatgtggcactcaagatgtatagcttaacctttttaaaaatccagttgtgctacctagatgtgctccagcatgaatgaatttagtccctccactctatttacagataggtcaccagagacctagagaagattaaacccatgcccagggcaaaaagtcaccctagagccaggtttcgaattctacttgcacaggtctctggttgaaggttctctgaatacctgagaagttcagttcatcctttttctacttgcctggaaacctcccaaagaaggaagctaactcattatttttcttttgcctgcttccacagctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgaggtaaccatggtggttcatgtggaggcacttccacgaagaaccagcaaccctcctgggccctgcctgtgacagtcccaagatgttggaaagggcacatagcctcccagattctgttcagtgaggtgaaactgcttccttagggtcagtgaggtaaaactgcttccttagggtttctcaatctctgtttttcacatttttctctctgtctagttttaatatttattcatttatattcattgtctctctgtctttaccctttcttagtcttcctccttctctcccctgcatctctacctttatctttttggtatctgatccagttacagccatctcatgtaagggcttaacctcactcattaaagcaaaatgcatctcccgccaagccagtgattcacagacttcaatatgtaccagagtttctgggggagcttgttaagcagccctctcactcttgtcccccaagtcatgaattatcagtctcaggtaaggcatgagcatttttaggtttaatgagcatccctggtgattctgatgctgctggtcctactctctcacttggagaacaccggttgtgagtttaagcagaaaagagcttggagacaggactccacagaagatggaggctggatggacaaacctgggctccttcagtatgtcactttttttccccaagagctgtctctctacattccctaaccccattccttccatctctctgtcctaaatgaagatgagagccttcactctcgtactctcttaagcttagtagctgcaagttggcatttttaaagggcattttactgaacaggaagggaaaaccaatgggaaatgaaggcagcgttttaaaaggattaaacacacacacacacacacacacacacacacacacacacacacacattctctcttatatctttcttcttgactcggaaaactctgcattgaatctttttgtctccttccttccagaggaggggttaggttctattttctgtcccccagcctagggtccactgtggagtcagtagtacagctccaacatttttcaaagttcttatttctctacatcagtactgcccaatggaacttcctgcaatgatgaaaatgttccatgtctgcattctccaatatagtagctataagccaacaatttatggttgttgaagagttaaaatgtggctggtatgactgagaaatggaattttaaattgtatttacatttaattaactttaatttaggtaaccatatatctgtaatgacagccacattgaacagtatagctctggaaacaccaaggccaaggattttgtgcctgaactttctttatctcaactcattttctcacccctttcaggaagattaaaagttatcttttcccactgccccactccctgccctgccatgaggcagatagagtagaaagaacaagaggtctggggacatggaatgctggtttttcacattctaacttggtcattaattaaccctgtgggcttgaagataccccttaactcctctgacattcaattttcttatttttccaatgggcttcattatagcaatctcttaagtttgttgaggaaattaagtaaatagaatattgcaataacctatgctgtatttggaaaaaggtaattttcttttttgcctcctttttaaatttattcacccatccatccatatgtctttttcttcttcctcctcccttcacatcaatggctgatgctaaaaaaattccccctcggaatgtgctacatggcattcagcatcaaaccactgacatttcattcattcggcaaacttttagtggaattctgttctgtgccaggcctggacataacttctagcctcaaagtgtcgtactttagagcagcatctgcatcacctggaaacttgttataaatgcaaaatctttggctccaacccagacttactgaatcagattatgcattttaacaaagttactatttgatgtataatacatattaaagtttgaggagcattgctccaaaatgatacctatattacaatgtcatagtgtttttcataaaattaagtacaatctattcttcgcttggtagctgagggatgctgtcaagatctaagtcaggtcatatcactcctctgctcagaaccttccaatggctcaccatttctacctgagtaaaagtcaaagttattattgtttacaggggcctgtgtggtcaacccatccttgcctctatgactttcacctcctgctcctttctgctatgctttcgttactactccagctatactggcctcttgcttttccttcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatgaagggcagggattttcatctattgatttactgatatattcccccagcacagtgcctggtacatagtagatgctcgataaatattgcttaaagtcaaaattaaatataattgctcacatgtatgtactgctttgattggcaaagtacattcacatcatatgtcatttgatcttcaaacaggacaaaagttgttattgttattcctattttctagatcaacagatttaatctctaagaagcaaaattattttcccagagctctcaggtactagcccagtggaagtccttagaagtttctctcaactcccacacatcttggcctcttcctatgggacacagactcaggacagcaatggaagttatttgtctttccagaaagtagggggtgatatgatcctgctttaaggagtttccaatccagccaacccaatcaaaccttttgttgacaatttgctggttccttatttttcaacaattattggtgctgaaggtaagtatttaaatgggagctatctccttttctcaccctataatcacgggcatcaaagggaagtggagaaagctgcatctagctggatcagaagacagtagtttagcccaggattgtgtaatctttaaaccaaaagctgtgaggagcgaatggtttatcagaaagaataccagactcagaattgggagtgctgggttcaggacctaccttggtcactaactgactggggaatctcagatgagtcttttcaccctagggcttgtaccccatctctaaattgcataggttggaggagctctttaagttctgtttggctcttactttttctctagttctgtaagatgtagatatgccctcactagagaaaaactgtgatagcgagccaggctacttctgcattttctgcttcttccttcttggtaccattggaagcatgtcttactcaagcatggatgtgttaacatggcataaaccactctttctgtaggttatgggagagctctaaacacttcctacttttgtacttgttgaaggggaaagggggaaaattatattcaatataaaaaaagtcacactatttattagaggacattctttttccctcctgggagcagaaagtgctttacaaacatttaagttataacacccttattttacaaatgaagaagtaggaaataaaggggtttttaattgaagttattcaatgaggtcagtaagagacataatcttttcaaatgagttctctgcagattacattcttctttctaaacccagacagtggtataaaataccttcagtttagttctagatcaccttgaccaacaattggtgatattgcctcttataaccttagaactcaaagtacaatcaaggaaactgaggcaagagtaagcagagctaacgatgctttataaagctgtcttgtctgctttctcttgaggaagataatctcagccatctgatacctatgaaataccttctgtcttcaaatgcctccagagaagctggcctagctttcctcactcactctgtattagtgatcataccattcactatcaagaaattcttccttaggcatgctgtagcttcaagtcatttccatttggtatattttaagcctgaggttttcaaacgtattagccatttgggttttcccttctgcaaattgcctatctcaatacatcccaatagtctttacatcttggcacatagaaaatgataacacattgtataagatagtaatatttgtacagtatcctaggataaaaatatgagtcagctagtcagcctaaaatgccaagcccaggggtttctgcctgccataggccctacctgtccattctgtctggacattctgtgctgtgttcctatactttgcccattttcatggagtttcttatgtttttttcttgctgatttgtaagagttccttgtatattctagatatgaactccttgtcaactttccatgttgcaggtatcttctttattctcttgtttttgaataacttttttacttcatttgaagaaagggtttcctatctcaaagagaggaagaaggaaataaaagaaaaccaccaatttgaacattctgcttctaacttacctttgatcatcaccagcatgggaagaactaattagcatttagttgacaaataactgagcagcaactatatgccaggtattctgttaaactttgaggatacggctgtgaataacaaccatggtcattatctcctaattttcttaaaaatgtcttcaagatgtttgtcaggtcgcctatcaggcctcaggttccaggcaaaaaaaaaaagacatatgaaacccctagaatgtcagaactgaaaggatccatggacatctttttcgatgtcttcattttagagacagagacactgaggtctaaactttttgtgagggcccttccctaaagaatttcctaaaccccagatgatccaggggctgtttggttcatcctattttctggtagtttctaggatcttttctggagatcttgggtattgtttatatcccatatcaaggcattacttctagatcaatgcactaggtctcaactcgtagatcagccctggtgggtttaagaacaaagtgaaatagatgggcagctttccttgctgttaccataacaatgccagagctaatttatgccagttgtgactgatttgataatacccacatttatcttagctactctctggcctgccttcccacccatgcccactttactcctaggagacagagattaggctctaggaaactgcctcccttgagccatagtaccctgttccctgttaccattcagatggggcgttcaaagcatacctggcagtaagagccacagaccccttttgttccccctgccctgtgacaggccttcaatgggccctgagtgttatctaagacaaacaaattttatgtcttccatcattcttcatgatgttgcttttcaggcccctccctaccctgctcactcccctctggctgtgtgctattttcttggtgttcctctgaaaagagggtggactcaaaatttaattctgctctcctgcagtggtatgactaccttccaattgcctctcccatttttgcctctcaatatatttcttcttttttctaactgaaaatggtattaggctttttgacaatcacatttcactgccaactcattttaaacttacataccttcaaaaatgagtgaatgagagtagacaagtattgattgaccccctaatctaccctctgttcaccactgatgtggaaaatttgatagccatcaggccagccaaaagaaggggataaaaaaagcaagactccagggagctaatcatttctcctggcctttctttttccagaaacttgtgtggtatagaggtcgagggtgaccctttggggttatccagctactcccatattcttatgtctcatcgcttatttttttgataagggcagtttacatctattatttgtaatctttagcaagtgactatcttagatactatggctgcaggagatcttgagaagacattgggtcttccctcctctttccttgataatatttcattccaggcagccttcttatagctgcattttcttttctttacactctctggcaaagacttttatcccatttttgatcatgaagacaattaaaaaacagcattagaggaagtttaaaaataggaacaaaaaccagccagaatccatcaactataacagaattatttgcacttttgcataatcccttcaaatctgtccatatgtgtatatatttacagagttgtaatcacactgatataccattttatgtcctactttttaacattgtatcataaacaattttccatgtttctacatggtcttcctaattatcattttaactgctatgtaatatttcatcaagctaaatgtaccagaatatatttataatctatcattggctttaaaaataagagttgataaaacattctaaggtcctaccatcctgtgggcattcttcctaatatatcccctgccataacatacataatataatagaaagaaaatgatttccttgagagtggcaataaataacatatttagggacttaggaagttggactgaattctttattcattgtcttttcctaagatcactctcttagttttatttctgttatattttatgctgatgttgacttctagtatcattgttgaattctggtgattttatggtgttttgtttcttccctgagacttttcaaataggagcagtggacacaactattaaatattttctgaactggcttctcagcagataaatgagctatctacgctgccctcttctgtctctcattgtggtcactcatcagtacctattgcttacccagaagtaatatgttgaatgtgccactgttactgttttcccccagctgtgctcctcagcctgccttagggaaaaaaaagtgggagaaggggtaaggaagccttcactcccatttaatgttgagatgatatgctcactgctctccctgctccattgtagctaagacacgtccagagatggtagggtgaaagagacagatagacaggcacacaggcacagaccaacccagacatactaggctctgggaattacatattaggtagggaagggcctacaggagtttattgccattccttctggtagtcaatgtaaaactttctagggaggcagaatttggggagcaacctctgtaaaggtagtggagccaaaagggtgttctgggaattttcttcctgatcaaaaattgcatatgaaagaatgcaggaaattttcaacatgtcagtcaatgagggcacaaatcattagttaaacagatgtcaacacaggcatagactattaatttgccaactatttaaagacacctactaattaatggctaaattggagagtgagaacagatatgggaaggggaagtgagatttgttgtagaggtcagtaaaagacattgaagccagggatgaggatcttcttggagtgtgcccagatgacctcattggtagctgtgttaagggagacaaagcgaggatagggacagggctatatgtggtaaatcagtccctgtaaaactcttccttaggggttcaacccttaagaaaagtgttaagataatttcacttagctttttgatgaaagcaaatgactataatttcttctcaccaagaacatttttatgtgttactgatttctaatgaggacagtaactatcaagtgaaaacctatgatagtaggttccaaatggaagatgcaatttagattggggctgtttttgtcctgacttaagtatgccttgagtctggtttatgttaccccaatgctttcttactagaccaagaatctctttcatcctttttttctctttcatcagtggttatctttattaatgtgttttatgtgtttagggcacatttatgtgtttaagacacatgtgttaggtgttaggacatattaacgtgttaggacacatttatttataaatatatatatatatgatatatttataaatttatatatatatatataaatttataaatgtgtcctaaacacctgttctgttaaaaacaccatgtccaggcacacataggcttgttggctgagctcatctaaatgatcactcctggccagctacctcagatagttgagaaatttgctttgagaaatggtttgacagatatttgcataatgtgaatagtatgaatgcattttcttaaagtatgtgaagacatgaatgtctaagaaaatattgtatgtgtactttgatgtacacaacagggaaagtctaaaatgataaacaactattattcctggttatttcctgacattaaagttcatgaggaaacttttttttgaagaaatggttttgttttgtcaatttctgttcccttgtgggaagtttttctgttctggcctctgttcccaattttttgtcaatgttattaagacctttggtttggtcctataaggaatagaactttagagatgtgaatggatccagctaaaccagtagctaataagacctgtgaaaatgtgctcaaccagcttcttggaaagggatatttgactttgggggtcttcttcatagaggatggagggaaaagactttggagtctttgcactcttaagacttttgctggcaacccagctttcctaattactcactgggggagtgacttccttctgtaaacctcagtttcctcatatgaaaaatgaaaataattattccatgcctacttcttgggaccaaaatgaggctcttaagtgcttaggaagtgtaaagccttctggaagtcagggacttcctcagcctaggctttttctttgtctacagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcacgtaagtatcttatccatttggggagggttttgagaggtgttaggaaacaatggaaggagcgtttgagctgtctggttctgttcagctcctttttcctgcagtggggaatgggttcctcttgggccttcattttgacccctggtctctagccaggaaacaaggacttagaaaagtgctgtgatttgccctataaatgttaagcatgtgtatgacctgctggttccattcccgaatgtatattccagagaaactcacagaagtccacaagggagcacatacaaggctgttgttgattgcatggcagtgtcgtatgtggtggagtaccattagaagcaacctaggattctccttctttaccattcccctcccctctccctttccttcttggcagttaccagtagaatttttcttcatcttcccttttttgtttctgttaagtttccatgagactcagtattttgggaggaattcaaaatattcactgcacagagaatcaaggaatctgagaaataacaaggaccatggttagtaagaaagtggtccctgcaagacatttatgggaagggcactggagaaggtgaagtgacaaaaataggaaaagaacacatggacttcgaggatggagctctgggaaacaggatagtgacgatttgagtcctgtatctgtagtgtctgtctgggttactttgggcaagtccttcatgggctttggtttgttcatctggaatgtgaggttacactgtatgatctctctggttctttgacatcatctgagtctcattcacaggtgacctagttgttttgacagcatgtttccccttttaataaagtatttatttttaaagatttaatatgtgcacttaatataaaattcaaatgacacacaaaagcatgcagctaaaaataagccttcttggaaatattcctgttttacttctgagactctgtgttggggtgggttccctaagatcactcttatgtttagtgatttggactcagaatatggttatattgaatgtggtttaggactcagaacatgtttatactcatagctatgatttattatagcaaaatgattcgaagtaaaatcagcaaaaggaaaaggcacacagggcaaagtgcagaggaaaccaggcacaagctttcaggagtccatcccccaatggagtcacacaggatgcacataaatcccctaggaatgagttgggacaacacatataaaatgttgtctgccaagaaaactcattagagactcagtgtccaaggttcttattgtgggctcatcatgtagacaccttctgcctagtgtgtactaaaattacagactcccagaaggaaagcaggtatttagcataaaccacattgtttgtacaggcagtctggacacagtgagccactcttatcagggaatagtgggggaaccctcttgagaaccaagtttcaagatgccagtcaaggggaaatatttccagcaggtttttctgagaacagcaatttcaggcctgatacgataactcttttctgtatggtatgtaaactcattcaaccattctagaaagcacctgggtagtatttataaatgttaaggatgtgtatgaccttctggttccattcttgaatgtatattccagagaaactctcacagaagtccacaagggagcacatacaaggctgttgttgattgcatggcagtgtcgtatgtgttggaataccattagaagcaacctaggtatttatcaccagggagatatataagtggatggggtttgcttattgtgaggtattatgtagcaacaaaccgaagactagatgtatgtaccttatagcaacatatatcagaaacatagtattgaatggggaaagtagaatatagaatagtggttctcaaccgggggctgccctgtacattgtaggatgtttaacagcattcctggtctctagccactagatgtctgtagcaatgccttgctacccagttgtgacaaccaaaaatgtctccagacattgacaaatgtcccctggggaaaaaaaagaatcacttatgttttgaaatgataacatacttttacctttaatctgttaatgcagtgaatttggattgaatgattttcatatgtgaaatgaacattgtattactgggatagaccccacttaaacactgtgtgttatctcttttaatgtattattttaccttttaaaattaattgtttacccttttattagttctagaatttcatttttatcagctttacgtagatataatttacatacaataagattcattcattttaagtgattttaagtgtatactttaaggagttttaacaaatgtatatagttgtgtaaccaccataataatcaaaatataggacatttctataactccacaaagtcctcttatctagacattgcaaacaatctgtgcccctactcctggctactggcaaacattgatctcctttttatttgaaattttgctttttctagaatgtcatatatgtgaaatcatacagtatataatcttttatgtttagcttctttcatttaacatagtgcctttgatatccatccatgctgttgcatatatctttcgtttatccttttttattgcttagtagcactccattgcatggatataccacctattcacaaattaatggatatttgagttgtctccagttttgaactctaatgcataaagctgctatgaacattctagtacaatattttttgagaatatatgttttcatttttcttggttaaggacttccagggttagggttgctaggtggcatggtagattttttagcttattagataatgccaaactattttccaaagtttctataccattttgcattttcactactaatacgtaagagttgaagttactccacatggtcatcaacacttgatattatcagtatttttttttttttttggagacagagtcttgcttcgttacccaggctggagtgcagtggtgcaatcttggcttgtagcaacctctgcctcccaggttcaagcaattctcctgcctcactgtcccaagtagctgggattacaggcatgtgccattacacccagctaatttttgtctttttagtagagatggggtttcaccatgttggccaggctggtctcaaactccttacctcaagtgatcttcccacctcggcctcccaaagtgctgactgggattataagcgtgagccatcgtgcctggccagtcactatttttttttttaattttcgccattctaacatgtaggtgtgtagtggtatctcattgtaattttaatttacatttccaatgtatagtgatgttgagcattttttcatgtgtttatttgccatctatataaaaactggtgaagtgtctattcatgtatttttcccgttttaagtgtattgtttgtttttttattgtttagttttgagagttcttttattaaaaattaatatgtaatttacttatttatggggtacatgtggttttttttttttttttttgagatggaatctcactctgtgacgcaggctggagtgcagtggtgctatctcagctcactgcaacttctgactcccgggttccagcaattctcctgcctcaacctcctgagtagctgggattacaggcatgtgctaccacgcccagctaatttttgcatttttttagtagagacggggtttcaccatattagctaggctcgtctggaactcctgacctcgtgatccatccaccttggcctcccaaattgctgggactacatgtggtgttttgatacatgaatacaatgtgtaatgattaaatcagggtaattgggatagccatcatctcaaacatttatcatttatttgtgttgggggcattccaaatcttctagctattttgaaacaagcaattaattattgttaactacaattgtttttataactattttgaaatatgccattaattattgttaactgctgtgatatcaaacactagaacttatttcttctatataactgtagttttatacccattaaacaacctctcttcatccttctctccccacaaccttcctaacttctggtaactactactatactctccacctccatgagatcaactttgatagcccctactcacatatgagtgaaaacatatgatatttgtctttctgtgcctggcttatttcagttgacataatgtcttccagttccacccatgttgctgcaaatgacaggattttctttttatagctcaataatattccattgtgtatatatagcaacatgttcttcatccattgatccatcagtgggcacttaggttgattccatatcttggctattttgaatagtgctgtgataaacaagggagtgcaaatatctcttctgacatattgatttttcttcttttggctatatacaatatatacccagcagtgggattgctggatcatatggtacttctgtgtttagttttccataccattttccataatggctgtactaatttacattccgatcagcagtgtatgagagttctctgttctctgcatcctcttcagcatttgttattttttgtctttttgataataaccattctaactgcggtgagatgatatgtccttgtgattttgatttgcatttccctgatgattaatgatgttgggcatttttcatatgcctattggccatttgtatgtcttcttttaagaaatgtctgttcagagcatttgcccacttttaaatcagattatttgtgtttttttgctattgagttgtttgagtcacttacatattttggctattaatgttttgtcagatggatagtttgcagatattttctctcattctgtatgttgttgcttcactctgttgattgtttcccttgctgtgcagaagctttttagcttgatataatcccatttgggtatttctgcttttgttatctgtgctttagaggtattactcaatagagtctttgtgcatatcaatgacctgaggcatttttccagtgttttattctagtagttttatagtttcaagtcttacgtttaagtcgttcatctattttgattttattttttcatatggtgagagataggggtctagttttattcttttgcatatggacatccagtttgtccaagaacataagttgaagaggctgtcctttctccaatatgtgttcttggtgtctttactgaaaatgaattggctgtaaatgcatgggtatattttgggattctctattctgttcaattggtctatgtgtctgtttttacttcagtaccatgcttttttggttactatagctttacagtgtattttgaagttaggtagtgtgatgcctccagctttgttctttttgctcgggattgctttggctattctgggtcttttgtgggtccatatgaaccttaggatttttttcccatttctgtggtgaatgtcattggtattttgatagagattgcatttaatctgtagattgcttttggtagtatattttagcaatattaatttaacaatattaatttaatattaattaattgcatttaatctataggttgctttaggcagtacattttaacaatattaattcttcccatccatcaatatgggatatctttccctttttgtgtgtagttgtcaatttttttcagcagtgctttttatttttattttagagatctttcacttctgtggttaaatttattcctatttttttttaaatcctgttttaaatgggattgcttttttggtttctttttcagattgttcactattggcaaacagaagtgcacctgctttttgtatgttgattttgtatcctgcaactttactgaatttgttgatcatttccagcatttcgtgtgtgtaggtagtctttaggtttttctaaatataagattatatcatctgctaacaaggataatttgatttcttccttttcaatatggataccctttatttcattctcttgcctaaattgctctggctagaacatgcagtactacactgaacataagtggtaaaagtgggcattcttgtcttggtctagatcttggaggaaaggcttttgatttttttcctgttcagtatgatgatagctgtgggtttgtgatatatggcttttattattttgatgcatgttccttctgtacccagtttgttgtctttttctcatggagggatcttgaattttatgaaatgctttttcagcatctattgaagtgatcatacaggttttgtccttggttctgttaatgtaatgtatcacgtttatttatttgcatatgttgaaccaaacttttgtccctgggatgagacccacttgatcatcgtgagtgatctttttaatgtgttgtttaattcagtttgctagtattttgtttggaatttttgcatctatgtttgccagtaatattggcctgtagttttctttttttgatgtgtttttgtctggtttgggtaccagggtaatgctggcctcatagaatgagtttgaagtattcctcctctttacttttttgaaataatttgcatagaattattatcagttcttttttaaatgtttggtggaattcagcagtgaaaccgtaaggtccttggcttttctttgatgagacactttttattactgttttgatcttgttacttgttattggtttgttcaggttttctatttattcatggttcaatcttggtacgtcatatgtatccaggaatttatccatttcttctaggttttccaatttgtttgcctgtagttgttcatattctctgtaatgatcctttgtatttttgtggtatcagttatattctcccttttcacctctgatttcatttatttgagtattctttttttcttagtctagctaaagatttgttgattttgagtatcttttcaaaaaaaacaacttttcatttcattgatcttttgtatttttcagccttaatttcatttatttctgctctggtgtttgttatttatttccttctactagctttgggtttggtttgttcttgccttcctaattctttgaagtgacttggtagattatttatttgaagactttctttttcttttttgatgaaagcttttattgccataaattttcctctttgtactgcttttgctttatttcataggctttagtatcttgtgttttcattttcatttgttttgagaaatttctattttttaaaagaattttgttatttacccactgatcattcaggagcaatgtatttaatttcggtgtatttgtacagtttcttaagtgctcttcttactgatttctagtgttgtttcattgtggtcagaaaagacacttgatattaatttgactttttaaaatttgttgagatttgtttatggcctaacatatggcctgttttcaagaatgttctatatgctgatgaggaaaatgtgtagtctccagcagttggatgatatgttctgttattttcagttacgtacatttggtctatagtacaactgaaatccagtatttctttgttgatatcttgtctggataatctgttcattgctgaaagtgagtgttgaagttccctattattatggtgttgtagtctgtctctctgtttaaatctactaatatttgttgtgtatatttgggtgctccagtgttgggtgcatgcgaatttataattgttatatcctgtagctgaattgacccatttattattatataatgacattctttgtcttttcttacagtttttgacctgaagtctgtttcgtatgatatatgtgtagccactgctgctcttttgtggtttctatttgtacgcagtatctttttccatcccttcacttttagtctctatgtgtcttattcactagaaattcacttaaagaagtgaacttcttgaaggcagcatatagttggatgctgttttttttaatccattcagccactctcttttaattggagaatttagtcccatttacattcaatgttatttttgaaaggtaaggacttactactgccattttgttattattttctgattgttttgtaactcctgtcttccattattttactactatcttcctttgttgtttagtgatttttctctggtggcatgtattaattatttgcttttgttagtgtatcttttacaggtttttgctttgatgttactgtggggcttagaacatcttattataaactgatgacaacttaactttgatcaaaagaaaaattaaaaactaaaatctctaaaatttaagtccattacttccccattttaactttttgttttctcagtttacatctttttatattgcctatcccttaataaattgcctttttgttttgttttgtttttgagatggagtcttgctctgtctcccaggctggagtgcagtggcacgatctcggctcactgcaacctctgcctcccgagttcaagcgattctcctatctcagcttcctgagtaggtgggattataggcacgtgccatcacactcagctaatttttgtattttttagtacagatggagtttcaccatgttggccaggctgaccttaataaattgtcattatttttgatagatttttttcagtcttcatactaaagttgtgaacggtttacacaccacaattcagtatttgtctgcatagtttattctgaatttgtctatatacgtttaccagtttattttataacttcaggtgttttcttgatacatattagtgttcttttaagattgaacaactggcttcagcagttcatgtaagacaaatcttctgttgatgaattccctcagcttctgtctgggaaagtctgtatctctccttcatgtttgaaggatggctctgctgggcacagtatgggaggtttttttgttgttgttgttttgtttttttcattcagtactttgaatatgttgcccccctccctcctgccctgtaggacttacactgaaaactctgttaccacaggaattgaaactcctttatatgttatttgcttcttttctcttgctgcttttaagatttccctctttgtctgttaacctttgagagtttgattattatatgccttagggtaatcttatttagattgaacatgtttggttgtctttaaccctgtacctggatatttatatctttctctaggtttggaaaagtctctgttattattactttgaataagctttctaccttttgttctttctcaacatcctctttaaagccaatgaccctttgacttgctcttttgaggctatcccctagatcttgttggcgttcttcatttttctcattattttttctcttcttattgtgtattttcaaatagtcttagggctcaccggttctttcttctgcttgatcaattctgttgttgagaccatcccatgtatttttcagtttgactattgtatttcttagctctaggatttctgtttaattttttaaaatttcaatttcattgttaaatttctgtaatacatttctgaattgcttttctgtgttacattggcattttctgagtttcctgaaaattgctattctgcattcttgatctgagagctcacacaacatcatctcattagggtcagtcactggctccttattttgtctatttgggaatgtcatggtttcctgtttgctctttctatggatatatgtctgtgcatttgcattgaaggattagttctttattccagtcttcactgtctggcttggtttggtctttcagaagtatgtctgtctagaggttttgtgcagagtgactatttagttcccttagcctgagatcactgcctccttttcaacactagatggcaccctgaacccagatttgacatagtctttctcaatttcagagtgctactcatcctggatggggaggaatcccaaagataccccagctctgtgggaaagctggatggaggtttgttcccagaggactgatgaagtgtgcttcctgcaacgtgatgctgttaaacagcctttctgatttggtgtcttttttgaggtcagatgaagggaagctggagtttcatgcactgggtgttgctaaccccacccccaccctctaactctagctgcctttgggattttttactctgcaggcattcaagaggcttcttacaggttgaggcaggaataatttttctggaaaggaatctaagatggtggggaagctagctgtccacttttattttttccagtattataggaaccttgattttgagggtgcctttctacacagtgcctggcagcttggggaaggagctattttaccttttgcttgcagtttttcagttctctgtggcctctgggattgtcacaacttcagtcattgagttctggaatattccttttgataatctgggcagtggctagttctttttggttttctgtggaggagagtaaagctacatatactgtgctattttggtgacattctcagttatgagaattatatattttgttaacaagtcctttgtcagataagttatttgcagacattatatcccagtctgtggcttagcctttcattttcttaactgtgtcttttctaagttgtgcatatttatggagtatgtgagaaatttttaacatatgtataatgcatagtgatcaagtcgggttttagggtacaatgcattttttttaagtatagtcatcctactctgctattgaacattgaatgtattccttctatcttatgtttgtaccctttaacccacttatcttcatgttctcccttctcacctgctcacacttccgtctctgttatttttccaccctctacctccatgtgttcaaattttttagcacccccaaataaatgagaacatgtgatatttgtctttttgtgcctggcttatttcacttaagacaatgacctctagtttcatctacgttgatgcaaatgacataatttcattctttttatggctgaatactattccattgtgtagaagtaccatattttctttatccattcatttgttgatggacacttagattgattccttatctttgctattatgaatgttgctgcggtaaatatgcaagtgccagtattcctttgatataatgatttattttctttaagtcaatacacagtaatgggattgctggattgaatggtaattcgatttttagttttaagagtatcttaattttattgaaatccagtttatcgctttattttattttatgggtcatactttttgtttcctactttctttgcctatctcaaaatcataacggttttctacttttttaaaaatagaagttatatagttttattttttacatttaggcctatgatcccttttgtggtaatttttatatatggcacaaaatacagatcaaggttaattggtttctgtatggatatttgttaaaaaatactgattcccctattgaattgcctgggcacctttgtcaaaaatcaattaagcatatatgtgcagatctatttttaggtatactcttctgttctagtgatctatatgactattcttgtaatagtaacccactttcttgattaatataggttcatagcaagtctttaaatcagatagcataactcctccaacttagttctttttcaaaacaattttagctattttaggttatttgtatttctatataaatttaagaataatcttgccaaattttaccaaaaacaagcaaacaaaaaccctatcagtgttttggttgggattgcattaaatctgtggatcagttttgggaacattgatatgatgagtcttcaaatccatgaacatttaactgtttatttcgatttttttgtgatttctcccaggattgttttttagttttcattgtatgattttgaccttttaaaatttgattgttttaaaaaatatttaaggtataaatttaagatgtacaatgtgatgttttgatataaatgatgaagtgatgactacagtcaaacagattaacatatcatctcacatagttacttttttgtggtaatagtatctaaaatttactctcttagcaaatttccagtgtataatacaataatgttgactctagtccccatgctgtaggttagatctctagacttttcctgtgtaactacaactttgtgccctttgacttatatcttcccattttctcccaccccctcacctctggtcaccaccatcctaatctgtttctatgtattcattttttttttccttttgattccacatataagtgaaatcatgcagtagttttctttctgtgactggattatttcatgtagcataatgtcctctaggttcctccatgttgtgacaaatgacataatctccttccctccttctttttaaagtctgaataatattctattctgtgtctctgtatgtatatgtaatatatatataaataaattaaaaatagaggtaatttattaaaatataggcaacatattacatatacatatacacccgacagtttctttacccatttatccattaatggacactttgtttgcttccacatcttggctattgttaatagtactgcaatgaacatgggagtgcagatatctttacaaggtagtgagtgcatttcctttgggcatatactcaaaagagggattactggataatttgataattctatttttgatttctttgggaacatcttaaaggtattattttccacagtggctgctgtaccaatatatattcctactaacagtgtacaagggtctccttttctctaaacccttgtcaacacttgttatgtcttatctttttgataatacccatcctaatagatgctaggttatttctcattgtggttttgatatgcattttcctgatgattaatgatgttgagcatcatcgtatacctgttggctatttttatgtcttttttggaggaatgtctattcaaattctttgctcatttcttaattagtttatttgtttatttgtttttttttgctgtgaagtgatgtgagttccttatatattttgaatattaaccactttatatattttatatatattaaccactttatgtatattttgaatattaaccactttacagtttgcaaatattttcactcagtctataggctacctttgcatgttgttgactttttttttctgcatagcagctttttaatttgatgcagtcccacttgtttctttttgcttttgttgcctgtgcttttggtgtcatataaaaaagcacagcagtagtgcttttagtagttttattatttcagctcttatgtttcagtctcttatgcattttgagttgatttttgtgtatggtctaaaatatgggcccaattttgttcttttgcatatagatatccagtttttccaacaacatttattgaagagactatacgttccccattgtgtcctgttggtgctcttgtcaaaaattagttcactatatttgcttcggtttatttctggactctctattctattacattggtatatctgtttttatgctagtaccatactgttttgatttccatagttttctaatattgtttgaaatcaaagagtgtgatgcctccagatttatttttatttctcagagttgctttggctatcaagggtctagtttggttccatagaaattttatatatgtttttgtctatttccatgaaaaatgccattggaatttagataggggttgtgttgaatctctatatcactttgagtagtagggacattttaacaatattggttcttccaatccttgcacatgggaaatctttctatttctttgtgtcttcttcagtttctttcatcagggtgttttggttttctgtgcacagatctttcaccttcttgaataaatgtattccttaagtatttcattctttttgatggtatcataaatatgattttttaaaatttctttttttgatacatcattataggtataaagagtgcaactgatttttgtacactgattttttttttgtatcctgcatctttactgaattcactttttctaacaggtttttttctttttaatttttggagggagtcttttgggctttctacatatataatcatcttatctccaaatagggctagtttacttctgatccaatttggatgcattttatttatttttcttatctgattgccatggttagtatttctagtactattttgaataaaattggcaagggtgggcatccttgtcttataccagatcttagaggaaaagctttccatttttcaccattgattatgatgttacctgtgggcatctcataaatggcctttcttatgctgaggaaatttttaatattaatacctaatttgtgaagatattttatcctgaaaggatgttgaactttgtgaaagctttttccacatctattgaaataaccgtgtggtttttaaattattccttttgctaatgtaatgtatcataataattgatttggatttgttaagccatacttgcatcccagggataaatcccacttggtcatgatgtatgatctttttgatatgttactgaattgggttagctactattttattgagaatctttatacctatgatcattagtgatactggcttgtagttttcttttcttcttttttttttttgacagagtctcgctctgtcacccaggctggagtgcagtggcgcaatgtcggctcactgcaagctccacctcctgggttcacgccattctcctgcctcggcctcccaagtagctgggactacaggcgcccgccaccacgcctggctaatttttttgtatttttattagagacggggtttcaccatgttagccaggatggtctcgatctcctgaccttgtgatctgcccacctcggcctcccaaagtgctaggattataggcgtgagccacagcgcctggcccttttcttgtatttctgtctgactttagaatcatttgggagtattccctttagttcttttatttatttatttatttatttatttatttatttatttattgaagagtttaagagggattgctactaattcttatctgggtatttggtagaattcagctgtgaagccatctggtcctatgatcttttgttgttaggagattttaaatgactacttcaatctctttatttgttaatgttcaggctctctatttcttcttgattcaatcttggtaggttttatatttctaggaatatattcatttcctctggtgtttccaagttgttgtcatataattgttcataatagtcccttgtaatccttttcatctctgagacatcttttgtaatatcttcatgttcatttctaattttatttacctatattctttttctctaaaaaccaagtcttagttttgttgatttttttccctaagtttttctgttctctgatttatatctgctttgatcttttatttttttccttctgctatctttgagtttactttgttcttctttttctagttccttgaggtggaatatcagattgtttatttcagattttttttaatgctatcaacgcccctcttagaactttttttgctgcatcccaaaggatttggtatgttgtgctttcaatttcatttgtctcaagatattttttaatttcccttttgattttttctttgacccatttgttattcagggatatgttgtttaatttctactgatttaagaatgttctagttttcttcctgttactgacttgtagttttatatcatcatgaccagaaaagatacttgatatgatgttgatcttcttaaatttgctaagacttattttgtggtatagcatgtggtctattctggacagtattccatgtgtgctttagaagaatttgtgtgatagcctgtctgcgtgggtcagctttggtaacatgtggtagtgagactagaatccctagtttgggaccctagggctgtttgcaggtacatgcatggtagctgtgctgggtcactgggccagagcatccaaggaggtagtacttgcttaagtacctagagaatgcaaaggctcctgtgctgagtccctttgccaaggcacctgtggtaggagtagctcaggcagctctgggcatgggggagggaaagctctggtggatcagggatctggagaatgtgaaagctgttggcctacatcaccccttcccactgggctatagtaaccacagcagcagttgggcagctctgggtggctccaggaagtagagaagaagaagggacatggctcaggcatgttttttgttgttgttgttgttgttgttgttgtttgtttgtttgttttttctcctaaaactcaaaaggaagaaaaaacaacccatggacccttagcagtataagctgcagggcgtctgctgatactatactagcagttggttttctcagcaggaaaagctgaaaaagcttctggggtctgtgactgtgaacactgaagaatcttgagaggtaaaatctacaggaggtacccagtggctatgagggctattgaggtccttgacagagaggcctactggggccctgtgccaaagaggccacggcagatcactgcgactcctgctactttgctgatactgatataaccaatccctattctttgctctctgctgtttccagacatctaggctatatctgtcttttcagagatctgggtgggatgaaactgaagctggtcattagggcagtgtcccataaagctggggaagctggttgtacactcctgtctcctccctgtatgtaggacacaagatccaagatccaagttgctgtttcataatgagcagtaccagctatggggacggggtgatgcaagcaaaatgaaactgtttttcctactcgttttgtgtatttgttttctgactttttctttcactatattgctgtggcttcttaagtggacccctaagcttttccagaattattttttgttcatggatagctaccaaattgttgttgtttgctgaagaaaggaaggcgatatttcctactctgccatcttactgacatcctctcctaaaagttgatttctaagtatttaaaattttttcggctgccattgtaagtggtattttaaaatgtcaatttcctatagtctattactattacacaggaatacggttgatttttgtacattgactttgtgtcctgacacataaccaaattcactaattggttccagtattttttttgtagatttcttaggattttatgcatatacaattatgtcatctctgaaaaaaagagtttaatttcttcttttttcagtctatattctgtctatttccttttttatcttatttcactggccgggatatacagtacggtgttaactagaaatggtgagaacaggcatctttgtcttgttttgatcttaggggcaagcattcaatattttaccaagtaattagcttaacgtttttcatgggtgtcctttattacattgtggtagtgtctttctatttctagtttgctgatgtctttgtcataaatttattttctcaaatgcttattcagcattattgaaacgatcatgtaatttttctcctttaatctgtcaatgtggtaaattacattgggataagtctgtcctgatcatggtatattattctttttatgtgctattttgcttgtttttcaacccttatataacaactctatcttgattttttgttgatcagtttctattgcctattgtttctcttgggttttataaatattttctattctaatgtatcaggttatcttttattaagtacttgtcaatatataataaaaattatagagtttttttaaaactttacttggaattaatttcaaacttatggaaaggttgaaaaataagaaccatacaaaaaatacccagattcccctgttgttaacattttaccattttgtcttatcatttgagtgtgctctccctctctctcctgactctctcctcttcccctctctttatgtacatatttatatgtccatacatacatatacacacactcatacatttttttctcagccattagtgttttaacttgcatacatcttagattccttacctctaaacacttcatcacattgtgtttccttagggacattttatggagataatatcaggctctggattgtgtgattccttcaaacagatatttatttatatttttagcttttccagctactctcagtggcagggtttgcctgcaacaacttagtctgtcattgccagaagtagagtcactgatctcttgctttttgtgatccagtcccagagttttatttccatgctgtgttttactcttattagggccagtgttcccttattacccttcttttacagaatgtccctactattcctatgtactcatttttctataagaaatttacagtcagtttgtcttgttactgaataatttgttttgatatttattattaaattatgaatcaatttaagaataattgactcattatcattttaatatttctgcctaagaatatgatctgtctttccattacttcaagacttcttttggggtccttggtagacttttcctttcctttttttcttttcccacagcaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacaggtaagggatcgagggagtcaggagtgaatgagggaacttcctctatctgttggttctcattgagaatacatgtccttttgccctttctgagcttctgttaacttatctgcaaaacaggatgatacattcttgattgcctcatagccaacagggtacagaaggcagagctatcactggctttgttactcacacaaaaggagggtcctttgccactatatttgggttaaaatctgaaatctgcctagggctccagaaccactaaagcatataagatatgatttgttagagaagcagcatcaatccaaaaacgaacccaaagatgtaaaccaaaccaactggcccacacccatggctcatgcatctgggtctgaaagttagccccaaggagaccaagcaatggagctaaatcatacttgtggactgataatattcactaggtaaattatatatggcataattcatcttaaaagttccagaaaaaagtttttaagcatagctcaaagctatgttagtttcttaggccaaaacaacctcagagctttttgggggtttggtgggcaccaaaaagataggacattcgcctgggatttgccatttctgtacactttcaccttgtgactggaactcctgcttcaaagtcctcttgccatctaggtccctgattccctctcctctcaccccttgcgctccagagtgacagtagagtagctcaggcagtgtcaggcgacatcaatttctgccctttctcagagtgacccgttgggcccagcacaactcccacgacatagacaaccccttttggcaggtctcaggaatctgtattaagatgatggctcctgccatgcatgtcaagagtagctcggatttgaaggcaactaaaggctgatgccagcttggaagcttagtaagataggtgttcagataggtagggctgaaatacaggcagtcagaatggcccctgagggagaagattagatgaagaatgataaatagagaagaatactgactttgcttacagatgattgatataattccctaccctaccttccttaagttgatgagaatgaagactgcatgtaagagggaggctagctgacatgtctggaagtagaaaatctttgttctgttgttctccccaataagaggctgggcccagacctcatctgagggctttgaccagggttaggctggaccacagctattcctttcttctcctgccgactgctaaaactagtaggacaggttagagatgggcacattccccctctagccattttgagaaaggcagccagctaaagatggcaaaaataggcagtatgggacactgacagtgaggaatccatgactgagtagtcttggtgtagaggaaatgaacattgtcatgccaggactgcccagtagaactttctgcaacaatgcaaatagtctatatttgtgttattcaatatagtagttacccaccacatgtgactacttgagtactaagaaacatagctagtgcaactgaggaactaaattttaaattttacttaattttgattaaatatggctaatagctaccatgttggacagtacagctctgtgctttacttccaagaaagtggtttagagcactgatctcctcaaatcagagaaaggaaaggtacaggggcagaaaatgggtccaaagagcaggagcacttacttatgttagcagcttctgtgctgcaatcttcccttctgtcaccactctacctccttctaagtgtcaggctcagacatcttgccaaggagaaacttcggtgatgtcacagagcccaaaagatccccatacattggagcaactaactgtaaaagaatgaaatgtaacagaaacaaatgtagagtgtttccattgggtctaagataagaaataaatagctcacggacaggctgagagagatacagcttctagagtgtgttttgaagagacttaggaagtgttagttggccataagctcaatatgggtcagcaatgggatccagaagaaaaactgataatagctaacattcactgaggctcagaataaagacttttctaacatatttgtcttgagacagaatagactggttaggaagtatagtgaaaagcctttcactggaggtgataatgtaacattgtttgagagccatggctctgacaggtgtgcagatcacagattggagtgagggatgtgaactaggaggaggtactacgtaggatctgccctggcaattagaagtccctttcctctgcctttctttggtccatcaacccactattcaatgttgtgggtgtgcagttgtgcagttgtgcaaagatgtgcggttgttgcacatctatttttttctccttccttttttaaaaaatggtactgagagattaagcagactagtgaccacaaggcattttcagtttctctaaagaaaggtgttaacactgaactgtaaggcatcctcttgtcttctcagtttatttttgcccccactgaatggctgagatctcactatcaatctgcctttcccaagagccatttgattgcaaatcagaaaagaacagcagaaaaaaactggataggatatgtaactctcaacacgtctgctatccagagtcccaggatgtggggccaagggttacacgtctgagactaggggttttaagaggcatcccatgtgatggctctactacggaaatgtttgatttgtaataatagtactgctaacatttgttatatgccaagagtaaaatagtttacatggatgattgtatttaatttatgaaaccttcaataaactatacttttccccattttacagatgaggaaattgagtcaatgagagagggagtgaggcttgccaaaggccatactgctagtcagtgagaaaaactggcatttgatcccacaaagtctggcttcagactttatgctcttacccactgtgctacattctgtttctatattgtgcaaaagcaaacgtgaggatatttcagagtgattttgggcagaagctccatagaaatagatgatggaagagatgataaggtggtctatactgtgtcatgtgtgaggctcccttcttggtccttggctggctgtatcagataggacacaaaaaaagtgatgtaacaaaatagtggtccatttgtctctcatgtaaaagaagtatgtattctgaagtttatgactggtatggtggcctcatggtcatcagaaacatgagcaccctacagctatctactatcctatacctagggtattgaccttgtccttatggtccaagatggctaccagaggttcggccatcacatcaacattccaagcatcaggattgagtaaaggctaaagaagcgtatgctctctaccttaaaggtgatttctcagaaggcctacctgatagagcaggagcaccgtcatcttggacaaacactgccacttcaagttccagctccctttctagcctcatgcatttcaaggaaatcacttcttttctaactacaagcagccagaaagagcagacagtaagagagctcaggcacagaaggaggtaggggggaaagtctcttgagtaactgccaaacttcaccctcatacaatgggccccagtaaaacagtgggcgttaataaacacattccttttccttcaggtgcactaagatagagaagatgaaagcagactcaggggatatgcctgcagctgcaaaaagatgtatgggaacagacacacaactctctcttcccagataagcacaacaaagaggcgcaaaagcagtctatgcctctgataaagtctcccaccctgaatccttaaaaactcttagtctgtaagaaagtgtggctctgacctaactcggccagccgctcctctcaggtttatttaaaatcaacctgtccctgttgactgaaaagccatccttcatgtttctctcctctttctttaattcttacactacgcaacacttctatttacatatcagtgtacaaaacttacttgcatagtcatttttgctgaaacaaaagatagaaaatgtagtctttaggtggtgtgggttcccatctgaaaatcaggactctgttactaaggaggtagaggagagtggatgttaagattggcacctagcacattggttctttggcacattggttggttcaacttgcactcttttgttttcacagtgactacaggtatgtggcagctgctttggctgtcatgagaaatgtgactcagcagatcaacgaacgcaagcgacgtttagagaatattgacaagattgctcagtggcaggcttctgtcctagactgggaggtaggaaacttaccaaccagggtattgggaaatctgaatagcttggcaaaagcttcccatcttagctaaggacaggtgaagagaaattacatttgaagagcaacagtaaggatttagattagactcaaggtaaaatttcttgctaatgagaagtgttggatacttgaataactttctaagaagcttggagaaatttttgtgatgatacctcattaagaaatgaaaggttcatttcttcaggtattgccaaggaacaattagggttgattcagtagcctttcaaagctctttctggatttatgaccaacagattcacacttagataagaaatagtatatactaatttacttccagacacagaatacgaggttggttctcctgttcccaaccatgcaggacagccaacatacttttttttttatcggtgataccacctcaccctagcacatctattaggtctctctattaggcctgtacactataggccacaaccatcatccctgccaaatccacagttttcacatctgtttttaaaataatccctgattatttcattgcagacagccatgacttctctgaattctgaaagaccttcccttcctagatgcccaccaaaagtatcaggagtaatgacatttcacatatgtcttgcaggcccaggttgtgcaatctgatagtctgctggctaaaataaccaagataggagaggctggacgtgctactagggagggattagcaatcttaagccttgtggtcacaatatagaggtagggtctgctccctattccactgacctcaactcaagtgtcattttcagtgattaagaggtagtatttctcttaatacttaaagtattttagcccgttccaagggaaccaagcatcatcctcacaaacagctgcttaaccaaggcccagaaaaaagtcactttccttttattctgctacctctgtcctaccttaatgtagattgctgaaaaagaccacaattctgatcagctgacatccttttgggctatatttgaaggataatgttcccatataagtagaacagcactttgatttgcagagaaaggaatttgtctagatgaagagaccctcattctcttaagcagaagccagcactgggccagacttactagaaaattgtgggtccttttttccttgtgttggcattgctttggccatttgcctgattaaaggcagagagctggaccaaatgacttctagcaagcccatcaactctaagacactctaaaattaaggtggattagctggccttattctctctcgttggcagggttttttgtaagagaaggtgcccagcagcagttgtcttcctattccctggagcatctccccaacttcccaatgcctagaagactttctgattcccctgtgtgctctgggacatcagtccttggagcaggagccatggggaaccaaaaatagcatgaaattacctggcctactcagggagcttcagtagcaccaagctcaataacactgagctatgatttaaacactcagcatctcagaaggaatttcctgcatgtatgtctgaatggggccacaaaaacacagttctaacagtgtctgcctcctttattagcctgattgattggtactctaatctcatgtaagcccacacatcccttgtacgctcctgcttggtgaagcctttcttcatctaaattgacatcctacttcattcaggctgctataacaaaataccatagactgggtggcttataaacaacagaaatttatttctcataattgtggaagctgggaagtccaagatcaaggaaccagtagattcagtgcctggtgagggccctcttcatagactgttgtcttctcattgtaacctcacatggcagaaaggatgagagaactctttggggtctcttttatgaatgctattcccatttaattcatgactgcctcattctcatgaccatcatcccccaaggccttacctccaaataccatcacagtagagattatgtttcaacatgtgaattttatggggatacaaacattcagcctatagcaatttgtaagaagaaaaattcttcatggtcttcttgtcagactgaggtcactgtggaacttgccagttccagcgaagttgtcctctaggaagtcttttctctagtaaagcctgatggatatatttcaaaggccaagcctaaagtttctgtcatatttgccatacctgtgttaaagacttctagaatgtcagaatcaccaaggctcttagaggactccccctacaaccctgacgattcttgtgtgtatacacatgcacatatgcacatgtacacatactctcacacacttactctcaaacaccttgcaatgatggtgaaagacagagaagcagagagaggtttatttcctaccaaggccacacagcaagtcagtgacaaagctggaacttgaatctagtcccctgattccttgtgtggtattgttttcagtaaggtaccacatattccttcaaccttctgcctctcacagcccaattgctgttctttgtgatatttcagcgacttgctttttgtatgtagtaaagagtttatatttaaataagacagtgagactaccttggggaggtcatccaaatcccagtcaggtggtgggtgagtgctggggagtctccccaagaaagcaatgagacatggatgctccatggcttgatgatggttaggattggtggcccaatttcacaggttccctggtataggttctttgtgcattccacctgcccaagaagttgtctaggcaaggagagacattctgccagattgccgaggactgctgtgaacagaccgtgcaaatcaagaaaaagatgccatattttgctgtctctgccaccccccttgtctcccagatgtttgaacaaacagagtggctgtcaaaagcatctgcatgataatttcagcttcatttgtcaaatgaaaaagaggagtcataggggaaaccttcagagcttaatctcccttgaagaggaatttggagggtagcatgcaggcaattagtgtctgctcaatagatcagagtgtctggctagagagcaggaagccctgcattatatcaaggcctgacccttctcttagcttattccgtgaacattcttggtctctttgcccaactctggttattatccctgccctctaccattctatagggactagagttcctgaagtaactttccttttaccccaccccccagggctcctgaaaatcaaatggatgagtaaaagtgtcagtcatctctctactaatcaatacattagagcagtatgcgggagcagcagggagaataatctgttcccagggactgcagtttctgggaaatttctatttctaatttccatgatgctgaggtttggttgagctgtcactttgccaccttgcacactcatttaatccacttgaaaacaagggaaaggtaacatatcctggatagcttctttttaatctttttttttttctggagatttgtagcaggaacctaacattgtagctcatatttgggagcttgattgtgtgtggttgtaatttcctctttgtgggatccctctcctcccagcctggttgtgtaatacccaaggacctgttccactttgctatttgatgactgaatccaaagaagttggaggaaacaagaaaacccaacatgatgaaggcagcaaaagcatctacttaaaagctaaagtggcttgatgaggcatactcctgggacaagaagatcaaatgtagggctagatggatttgttactcctctgccttcctgtcagtaggcagcattgaaaataaactagttaaaaagtatggcattccccttgtcctttccctggatctgctcagattacagccccacatcaattggcctataattagaatggggtgaaatcaggcagaatggggtgaattagaattagaatggggtgaggcctcttcgctcgggctctgaccccaaggaaggaaggtagataagctggcaagaaagctttgggtagtttttggtggccactgttcattccacacctattgatttagttgtcaaacagtatttattgagtatttaaatatcaagtactctgtgtcagaccttattctaggttctgcaaagacatcagtgaacatgacaaagtttccactctcattgatttatattccagtagggaaaagaggcaacaaacaaacatatatcatcaggtagatgggcctctgaagaaaaataaagtaggataacaggttagggagtaatgtggatactacctgaggaagtaacagttaagaacagacctgaaggagaggaaggagcaaaccatgtggttttcttggggcacagaattccagacagaggggaaaacaaacacgaagaccctgaaatataggagtgtgtgctaaaggaacaacacggaagccagtgttgttactctacccagagtagagtaagtgagtgagagagtgggagcaaatgaagttagggaggtgactggaggtcagatcctgtcttcataagactgactgttagtttgagtgagatgggagccactggagggtttttgagcaaatacgtgaaattatgagacttatgttttgaacatttcccctcatatgccaggccctatgctgggcaatgaggatattgagatcaatgagatgtggccttgaacatctagtgcggacaaacatattccagcagagggaacagtgtgagcaaaatcctggagggagtgaacagatccaaaggcccacggttggggatttttggaaggagttgtacttttgggggcaagacaaagagatgtgttatataagtggagcagaggaagcaagggtgagatctctaaacaatgagagggctgtctcctttccatgaactcatttgacgctctcaaacagccatgtgaagtgggtcaaacaggaactgttttaatattccccctctacaaatgaggaaacagatggcgagagtttaagctagtttctaactcaagagtgagttggtagcagcattggactcagagcccaggtcttttgagattctcaccttagaaatcttccatggcatctggttgttcccctgggttggtgacagtaggaggagattgggtgggggccatcattctaatgtggtttggtggataagagcataggctttggagggcttctgacctaggttctgcccctttgggcaaattacttccaatttctttgaccctggttttggggtaataacaaaacatcacttactgggttgctatattactaggagacaggataggtatggaaactggggcacacagtaatagtcaagaaaataagtatcacttatgttgagcttatagtgtgatgtgtaccttctaggcactttatatgttttaatttaaataatcctcacaacacccaaatgaagttggtactgttattatccccatgttaatgatgaggcaactgagttatagagagactacgtgtgttgctcaaggttagtcagcttggtgagcatagaggagtattattttaattttttttctaattggtggagttacatgttgcaagtaattaaaatataattgatgctgggcaccgtggctaacatctgtaattccagcactttgggaggctgaggtcggtggatcgcttgaggtcaggagtttgagaccagcctggccaacatagcaaaaaatcatctctactaaaaatataaaaattagctgggcatggtgtcacacacatgcctgtaatgccagctacttgggaggctgagacacaagtatcgcttgaggccaggaggcagagtttgcagtgagccgagatcgtgccactatactgcagcctgggcaacagagggagactctgtctcaaaaaagaaaaaaaaaaatgtagaattgagatgcccctggctggtggagtggatggaccagataatactgggtagccctcctggtcgtatcatccacatttagtaaattgtatatttaaaagtcattctgaccatcttcttatggcattggctctcttttatggctttattggacttcatacatattcaaagtggactgtagcacatcttcctagcctgcatcagggtgggaacctctctcagcttcccatccctccagcaggaaatcgctgtactgctccctaacctggtggctttctttcccagtatcaggcctccagaggttctgtgctagtatgtcagcccctctagaaggagtgtttacctagttcctggataatattgaggctaagtcgggagcctaaagttgaagcagtatttctaagctttttttcggcagtggggtggggggttctattattagaaaataattctactgagttccccctttccttcccatcctttagactggggaaaaaaatggtatgctcgaatacaccatttctagatgccccactctctggcctactaccctgcctgatttgtgtttgcctctgattatttctgggaggtataaaggtctccatctctaaccttgccttgaagcttttgggtgaaaggctgagatcttagcatcaaggtatcagccctatcatgaagatcatcctcatactacatctgggaaaactgacacctagagagagaggaaggaacgggttctccaatgcctttttggcctaaagacagtataatatagtacaaggagtgagcatattctatggagccccagaggttggagttgggtcatggacctgtagctaactagttgggcaactttggcttatcacttgatctttttgtacctctaactgtaaaatgggagcaagaatatctacttcccagggctatcgcgagtctcagataagatagattgaaaatatctggcgcactgtctgactcatataggtgctcaggaaatattaattcttctgtgtcttgggacactactctttgtccctatcttcacataggccctggaatactcacccctgtgcccacaacttcggtgttggtttgccttgtgtttcatgagttttgagcatacctgcattcgtctcctccatgaagacataagctccttgaggacaggggccaggtctaccttgacatctgacacacacctgcaacatacttctgacctatcagagttgccataaagaaggagtaggacttggaaactctgtagaattgaattagctaggacttaggtgtcttggtgcctatttgtgtcagactctttgtagcaaggaggataagtagttctaggctttctggataacagaccaaggaatcatgtggcagttaagtttcttattcaatcagtagattttagtgaactgagaggagaaggaaaaacaattataagaggggagtgggttctttttctctccctctgttatcatcttccttcttgtcctcccgtttccttctactcatgtgggaggcagtgagattaaggcctgttcttcaagtattagaaagagactgagggaccagagcagggattgagagactgggacagaaaaagagatttatagagaagagagatggagaaatatatatatgtgtgtgtgtgtgtgtgtgtgtgtgtgtgtgtgtatgtatatatatatgtgtgtatgtgtgtgtgtgtgtatatatatatatataaagaaaatctctctctctctctttctccacacacatatatatgtgtgtatgtagagagagagagagagagagagaggcagacacagagagagacagacagacagagaacttataggaccagagggtaactggtgtagaaaagctgtagcagtcccgggtggcagggcacatttggccttggggtgaataagaaaatgggtcttcctagctcacagagctgtaaagctttttgaggagtcccaggagtccctctctccctctgtctctaccaggccctttctggcctcttcctatcccagtctatgcccagccttgggtgcctccaggcaggtgatggtgccatccttctgcctggctgcctctcatcatcacatgtccttcccagggcgaggacatcctagacaggagctcggagctgatctacactggggagatggcctggatctaccagccctacggccgcaaccagcagcgggtcttcttcctgtttgaccaccagatggtcctctgcaagaaggtaaccctgcccccttcttccctgagggagatgggtacctaacagggtaccggaccctcctcttcatcatccccaggctcccaacaaagtgggcaaatactgatggggggaaaacagacaggagattggcagcaattctgtatcaggaacactaatgtggcatgaatgtcacaggcagggttggcttgtgggcagtgaaaaactctgaagtcggtgcattttgtcttggtattttttttaccctttgccctaatgaccctggggtgctccttctcactttcttctacccagagctgctggtctgcaccatttgtaaaaaatattgaaatatgtctatcttagttggtaaatagtagtttccctgagcactttccctcatttccactctaatggctctggccatgtggcccctctctgccctgggaaccaacgaggagcctcctacttttgccctgacaggtaggtacctttgtgatataggaattttttccatgcctctacctatttcctatacaaggtgcactggttccccacaacccccaaccgtgctcttctccactcttccttctttgtaatccattagaggagaggtcttactcttgtcactgactctggataactctgtgtatgttggtttctaggactcttctcctttgtgaggctgggaagggtagcatatgttctaagcgtcactcctccttatgggatactcttacccctacttcctcactcacagtagagagttcagaccagttttggctccaggggctaactgggaagaattggggaccaaggaaagtaaaaatggaagaagaaaccagaatgcttagagtgactttacaaattcaccatgctaccctttgctcttttgccatcatctagtccctttgtcctctccttcacccagtagtgaatgcctctgaagaggagtgctgagtcacaaaacaccagagtaaatagtgttacatttttctgggctggaacatgaaccacacagttttaagccccctgtcctctgtgtgtgtatgtgtgtgccatatcttgtattgaatctttatccatttgctttgacagtggattgaggggaaaaacactgagcttaggttcagactgcctcagtgtttggtgataagctctgaatgtccactctagaaccaatagccagtcagttaatggggataataacttacctcagtatggagctaaccctcaaacagagaacttttatgaatctgaaactcagccaaacactaatgcttctttttagctcccccaactcttctcaggactttcataaaatcaggaggtaggatttttgagggttaatttaggtggccatggaaattctcagcatatcagccatgtcaccaacactaatgtgcctgttcttcccactaaggtgtttacactcagaacaagtagccatagaggcagtaaacaaataggaacctggcttattttatagttctgcaccccctaggccctgttaattttggcatctgttagccaaggctgggattactttaactaaattgtgaaactaggctctagaaagcagtggctataagagatagaccaggatccagaacataaaacagtgagtcagaagccaggaataaaggggaagaaacaagataaacaatgggtttaacttagaactcaacgggcagtggaagaccaagatggagtaatgagccatgtctaagccagatagtgggagccaatgattaggaagaaactagaagtcaagccagggctggggattcaaaccagctaagctggcagggtaggggaagcatataacagggatggtgaaaacaagagaaacctcgaagcagtcatagcttcccacagaagggagctttcttgttttcacaagaaccataggctttcttcccaagacacagccagcctagagtctggagtataaaggctaccaactccatatacctgggtgttcttgacactggcttcccagaacacgagcagttatagcctaattgttcaaaggccattaaaactacctgatgtttgttttgaagatttccatttgttatctacaataagactttccattcaacaagtagggataaacttttgaaaaatgatcatgggaccaaaagaaggtatgcagagagacaaggtattttgtctgctgggttgtttagggaccttttgccattactacaaaagactctcttcttgagatagagctgggaggaatggactaggctctctggaggtgaaaattcctttgacaaagagaatccatggaggaaaggaagggaatgtctggattgggccaaggtgagtgaggctgtcaccttgttcacctcaggcacacaatttaattggatgtccgaaagttcagtaatcctttttaccaggaagaaaggaggtgaggatgctaaataatgaaatatggccacattaagctttctgatgatctcatatttaaaaaggaggaaacaaagacccctaggaagtggctaaataatatataatattttacatatgatataatatttaacaggggtgacaaaagagtttcatgaatcctagaatgagtcaaaattagtttttaaaaatgcttaattttaattacttttaaagctatgttcaaatgaagaaaaaagaagtgatagtctgacaaccccctgtttgaggcagatggtttactgataacaggggaatataaattccttctctatcaaggaaaagaagtcataaacttgtttcaaagggaattgaagcccaaaggatctgaggttgtaagagagtactttactgctctgaattctttcatgctatagatattgagcccctcttctgtgccaaccagctctactttcataaggattctagtctaacagaacttaagtatgatgttatttaaaaatatatacatcccagagcactgaaataattctatgatgtcccaagtggaattgctctaggtcatcttgacagaattatgggttccaggagatctgtgagaagactacacataggaaaatgtaccagttttcaaagcagaaaataatatgttctagaaagtagaaatcaacaataaagtattaatgaactagcatttattgagtgcttctatgattctgttctaagaactttacacttattaactcaatttaatcctcacaacaaacctatgaggtaggtactattattatattatttccatgttaaggatatgtaaagtgagacctagataagttatataattttcccaaggtgaaatagctaatgagtgatagagccaggaattacattcagatacgctggctccagattccacattggtaatatttatgtcattattaccattgagcttgtcaaaattctgtacttgattattaaacagcctgtgaacatttagaaagagatacagtggccacaggggtcatctttggctttctgagaacaagtcatatcctataaaactcagtttctattttgccagtaacttaattagttaataggaggattgcacaggacagagagtgtcctcctgcatttcagattttcccatggtttccttgcagacagaagtcatatggagtgatagataaaacataaagtttgtaatcagacaattctgggctcaaatcctgatttcaacactcgctaactatatgatttcaagcaagtgactttttccttcttgtacctccattatatcagttgtgaatggtgagaataactattctacaggattgtcatgaagattaaatggaatcaatgcatataaaatgcctgatagagtgcctggtactcattaatctcatcttacccaacctccaacaaagaaatagacagccttataaagtagtgaggtccccatcactagatgtacccaaatatgggctagattattatgtgccaaagatagtatagtaaacattgaaacactgatctctctccatgagcatgtggcctcaccactaagttctcatccaactgttaagattcccttaattcccagtcaattatgcaacaatgtgcctgttttgtacattgggaattgggattgactaatccactcagaacagcttaaacaacttatgcagcttgtagcttgtttcagagagagagagagagagagagagagaaaaggagagcaagagagtacgtgggcatgtgtgaaggtacctttaaaatggcaattatagtgtgtgggaaagtcaccagtggcttctaattatgtgaccccttctttaatttttgctgtcaccactcttttaacttttcttccaaaaaatccagataagactctgttctttttcttcgtattatctatactgtcagtctctgctcctctgtgtttcattgaatttttattttagtttttgatgtgttttattattttcttcgtgatataattatttgggaaattattttgatgctttgaggggatttttttctctttgactatttactgtggaaaggagcagatccgcttttcctgcaccctctgtcctattgtgccagtctggccatgttctgttgtcccttgtgtcataactgttctttattcctgttgctttcaccatattcaaggggatcagaactaaacaacgtgtaatgatgttgggcagaagacttctgttcagggaagtttctgcatttggacaatttcttcttgcactgaagggtcagacttggaggatgagctatttgggacagcttataaatccaataatagcaacagagatggggctggagcagaaagaagaaggggatttgaaaccagaactcctgagtacttaactttactctgtctcttaactaacttttctaaccattggccagttctttaactttgtccttattttcctcagtgtcaaatcaggctgatgatagaagtcatctcaagaggctttgggagagaaccacctgaggtagtggggaacagtggagtatggggttaagagcatgggtgctagggccagactagaaggcaatctcctttcgcccatgagctatatgaccttgggcaaactttctgtgcttataattatgcccttgtttgcaaaatgagaatgacagtgtatctacaaggaagggaagttgtgagggttaaatgagacaatgcagatgtagtacctggcacatagtaggtacttagtgaatgttggctattaatactattactatatatgcagtgttactaataattcattcagtacttttttatttagaggcaatatagcacattgtaaacaaaagcagagattttagagctggacagcctgaacccaaagccaagctctgccatttagtagcttttattcctggaaaaatttctgttttttcttccaatttttattttagctttagggggtgcatattcaaatttgttacgtaggtaaattgcatgttgccgggttttggtacacaaatgatttcatcacgcaggtaatgaacatagtaccaataggtggttttttattcccaccctcctcccaccttccaccctcaagtaaaccccagtgtctgttgtttccttctttgtgtccctgtgtactcaatatttagctccctcttgtaagcgagaacatgcggtatttggttttctgttcctgtgttaatttgcttaggataatggcctccagttccatccatgttgttgcaaaaggcatgatttcatttattttgatggctttgtggcattttatggtgtatatgtaccacattttctttatccagtctatcattgatcatcatttaggctgactccgtgtatttgctactgtgaaaagtgctgcagtgaacatacgcgtgcatgtgtctttgtggtagaacgatttatattcctttgggtacatacccgataatgggattgctgggtcaaaaggtagttcttttttaagttatttaagaaatatccaaactgctttctatcatggctgtactaatttacattcccaccagcagtgtataagcattctattcctgagaaagcttcttagctgctctatgtctatagttcctcatcagatggggttataacagtacctacattggaggattatttaggttaataaatgcagagcatttaggacagtacatggtacataatatatgctatttaaggggtcactgttgctattattgttgttcttattattttgatgtaattattaagcatgcattctaggatgctggaatatagtagtgagcgaaataaatccagtccaaaccccatgtaccttccctaggatctggagagaaaaggctagagaagagtaactagggtcccctctataaaggggcagggaggaccttatttacaaacaagtgaagcaggctacaatcctgaacagttacattccccagattgcagcatctgtcatttgtagagaatatcctgcaatgtcttactaaggaggaactagctcccttaatgtctcccaattcagacgagcacaaggaaaaaggaggaaggctggcattttattggaaatgataaacttcattaggcaggaaagttgtgatgatccaaatagcatctgttttgagcacctgctcaccgtgtccctgtgaaggcactcagactaccattaacaagtggcatatgggcagcctggttccaacaagaccacaggcaaccagggttcaagaggactttgtccccttgccatgtgcagaggacaaccagaggaaactctggggctttgtcagctgctcttctctggacaatccctaagtgaagcaagaccaaagaagatagagtgctgggcacagcctttaatgggcaggcaaactaaaagctgtgagcagcatggtggctaagtgccaagtgtgtggtatgtcagggccttcacaattggtgtcagaatttggagaaggggagccacatcagcttgagcagtcagagaaagtttatttcaggaataagaatgtgtaagtttgacctcgaaggctaagattggaataggaagcatagttgggccagagagcagctattagtgtgaccccaaatatatatctgttattttggtgacaaataccaccctgtcctgaaaggatgtatagaatttccagggacagtggggcagctatgtaaattgaaaaaatattcagagttacccttgctttgacttatttttactcacaatatttaaattatttggaaagtttaaatgagctaaaggaggtagtgagatgtttttcctttaagtttatcaaaagagggttttaaggactatgaaacactggcccaggagcaagaaagctcagggctgtatttggtggacaagtctggcctcatgtcctggaaatgacatgtttatattagagctttatagctattttacagagtaaggataactgtcttcatttcttagttgaggaaattggggctcagagaggttaactggcttgtccgtaaccatacagctggtaggttaggcagcaaggcatcaaactcagggcttcagactctacatcatgctctttcttttgttccatgctgcttactgcttatagtcttagctactctttctgattggagttcctcaactagtaggtcattcttaattattcctatcacatctttacatttggcttatgacaaatctagcgcctgaaaactcacatttaaccctctgggggaccagggagaacaggcaaagggataattttagtaacacatctctctagccctgtttccccaccacagaagcagaaattctctctagcttcttgtcatccttacatatctaaagaaacaataggagattcaattgatgcttttaatgtagctccaagatcatgcatattctttctatttttgggaactagcaaatgtgttgaaagctctcaatgactatgacacaccaactcggaatgggggcggagcggaaggaggctgcggactgaagttagcaacaaggaagttgaggctgcctgttttaggcaatgtggtccggtgagaatgtgtggttcagatctggctttccaggtttgtatgtattatattatgtatggtaaggcacaattcaaacctttctgagatcgagataaattacattcatacattctgcctagcttatcctgcttttgtacttagattagcctgatagggcccactttttatacatgtgtctcaaaaagtgttcctgagaattgtggaactcagtgtatgggaatcactctatccttttggccaggattgagcttgtgcacactgaacatggtaaaaggaacccaggttctgaaataggcttggggcaacattggccctctctgtatagctgaactcttcctctcctgtgaacttgatcctggggacaaccaatagatcagaatccatctatattcttttcttatttatatgaacaatcattatgggaggaaaaaagtaacatgattgttattttttcaaaagcaattcaacgacatctgtattttccagcctgggcctttgaggttgacagagctatgctgggaaaccttgctatgctgggaatcctgcaaggtagcctttcccagcccaactgaaaatctcagtataccgcacaatgtgaagagttaggattgggaatgtgagtgggcaaaagaagatccttcatagggagcacacagctgagaagtgagtcaagttaggcaattcagtagaatggaaatggtttaattgaactgtaaaatgctaataaaaattaatgagcatttctgactctgtccagctgactgaaagagcagataaagcagagaggagggagagctggcccgaagatatctgtcaggacaggactcataggggccttcctcaacctgactcagccataccacatctcccagcagtggatgtgttctcagaggaggctgagggcagcgccaagaggaggaggggctgaaaggccactccaagatatttataagatctgacattccataggcctatatgtcatttcttccatccctctattttcctttttaacttatgaaatatttgacattcaaaaagatataaaaataatataatgagtacccacgtgtttactatccgcattaagaaataattcattacaaatagttttccttcccaccctctcttctgcttctttttcttccccttcctctcttgcccctccccgttttctgctctgtactgtctggaacgtggcatatatcattgtcacttatttctttataattttctacatacatatgtatctttaaacattatgtggcatttttttgtatgtttttcaaggtaacagatacagatgaggtaaaactatatagaaaggaaaccatggaaatgatgaacataggatttaggatggaggatgccttggagttgtaactttgggattggtggcagattcaccagtactttatattattaaaataagtaagtaaatgaataaatagagaaataaaaatgccatgcatggaccaattatgagtgtctcatggactagggttaggattaatccaattttgtgtctatgagagcaaaacaacaataacaaataggcgacatactgtttgtatccatctacaacttctgtttttctccataagatttgtgacattcatctgtgttgatatgtgaacttctttatttaattttacctccatttctcttggcagactgggccttttctaaaaatccccagagtgctaagtgttagaccccccctaggtaatcctttgccagcagtctgtggcctcctagctactcttactactcagtccccctctgatgttcaggtctcactggcctgcacagatatttgaacacactccaggcaaccagccagctcatttcatacctctagtgggcttgctgatgttttcgaaaaggagaagcccttgctagccgtgtttatgtggcttactgtttcctacctcccatcagcagacttgcacacacgtccaaggattgattctggtgtctgaaatgatctttcgaggtgagacagaggctttttctttgggcatctagttaaccaacctgtcagtgtcagactactagtataacctggccaaatttagaacaaaccaacccccattggtacttcaaaacggtgacagtgttagcattctgctgtgcccctgtgccaactcttctagtactcgccgtgcacataccttcaagaaacctcttccttcccatctaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggtaagtgacctgagagtagaaagaagaacatggctatgaagaacataggaggtttgaattggtttccattttcttggagtcagagggaagatttctgttgcaaactgacttaagctactttggtggttccttattattaggttctttttggtaagtaccaatagcttccattagtcagtggtaggtttgaactataggttgtcctcccctactagctaagaatatcacactgaaagccagcctcaggcttgattctcccaaacatacatttattagcaaataaacaaaaatcagttatacaacctgttctgtaatcttcataaagcctgagctctctgtcattaggtatatagtttgtactcctgattaggatacttcagatgttaactaaatccccctagactgtagattcaaataatatgcacatacacttcacactttctgtgtggaagtatttaaagtaaattatagaaaatataacaggacttaaaaccatgaccattttcatgatttcaaatcacactgaaacatacttttttgccttacaataagttgtttctcttttccagtggggatatagatagtagagatatttttcatgttgcttcccaactgtgggatttagacgccattggctatagctttgtgacttataaagtactgtctggtctcttgctcatggtcctgcctttctgtcataaaaaataccaagcaaccagacttgttaattccctgagaagacatacagtttctgtctttgccctattgcttatgggagtgaaattgtactttagaaggcctgaaagctcaagtttatggaaattgtctctagaaaaatgggcctactcattgaatcctggtgcaaaagggttctcttatccttccatgtgggcgattgaaattatccagaggtaagaaaggatggtcagaaagacaaatctaactccagtcttctcctcagaacttgggtagagtgcaaattaataactcactttgagtctcattggaatcagactgctttcagtatgtggacactccattgggacatgatgtggagtggcatataaatgttgctggctacttctctcaatagcaagcagcagcagccactgaccttgcctaggctgttagagttattaaaggaatggtcttagtgttcagaccctgaatcaattagaaggcccctgccattcccattggctctaacacaatgtctcccacacaatgccctaataaacctgtgactttatctgcttctaatagaaaagcttctagaaattactttctgaacaggcatatgttcatctttaaaaatgttgaggttttttttttttggtttgataataacagtaaatcacttccattgtaggaaatttagggaaaaagcaacagaaaagtacaagaaaaaaaaaaaacacatgaacatactcagtaataactttcataaacattttgatatatatttccagccttttttatgtgtctaattagaaaaatcaaggtgactgaatcttttttctttctctccccatacctgcctctctatagtggatagatataattttgtatcctcattttcactcatcattatatcattagcatttctatcagatcacttcatatttttaatcattattttatgagggtcatatagttttatcatagcttttttaaacttttactttttaattataaaattaatgcatgaccattataaccatttaaacaaatatggaaatatataaagaaaacttagcattccttccccttctctgtcacttccatactgaatgaaataaccagtgttaacagtgcagtatgcatctttccatacttatctcatgtccatataaacatatacaaacataatacttttatatttacaaaaattatattatatatattaccttgtaggttgcttttttaaacttaatttatcataagtaactccccagataaataatatagaatctaactataaccccttgtatcagttagggttcaaccaaagaggcataacctgtaggagatatatcataccactgctgaaaattgcattacaaggaattggcttatgtgattgtgaatgttgactaagtggctcagaattccatagagcaggcagtcagaaatggaggatcacaggcaggctcaaacccatggacataggccaaagctgtcatctacaggcagtcaggaagagaagctcatgagaaggatgaagtggcacagacatgggctaaagctgtggtgcacaggtagaatttctgccctttctgtgtgagacctaggctctacttttaaggtcttgcaacagattcagtcaggtccatccagattatctaggatattgtcccttatataaagtcaactgattagggcctgtattagcccatgttcacagtgctataaatacctgagactgggtaatttatgaagaaaagaggtttaattgactcacagttctgcaggcttaacaggaagcatcactgggaggcctcaggaaatttagaatcatagtagaaggcaaaggggaagcaagcatcttcttcacatagtggcaggagagagagagagcaagagggaagtgccacatacttttaaaccatcagatctcgtgagaactcacccactatcatgagaacagcatgggagaaattccccccatgatccaatcacctcccactaggcccctcccccaacacatggggattaccattccacatgagatttgggtggggacacagagccaaaccgtatcaggggctttgattatatctgtaaaataccttcatggcaacacctacattagtgaggactacagtctagtcgaatgggcacatcaataaattcatcacacttttcttataaacagctgtataacattccataatattatgtaataaccacagtcatctcttggtatgcacgggatattggttccaggactcccgtgcatatcaaaatccatggatgctcaaatcccttatataaaatgatatagtatttacatataacctatgtacatcctccatatactttcaatcatttctagattatttataatacctaacacaatgtaaatgctatgtaaataattgttatactgtattgtttagggaataaaaacaaggcaaaaatccatatgtgttcagtaaagaagcaaccagccgcttttttctgcatatttttgatccacagttgattgaatccagatgtggaacccatggttacagagggctgactgttcgttttttgctagacattcattttatatttagctttatttcccactacagatattgctgcaataaatatccatgtacgtatctgattgttacttactgatgcttttattcctgtaggatctgtaccctaaagtggaatgactgaatgttaggatgtgaacagttttaatacatacttgcatattaaattctgaaagatttgtagaatctatactcctagcataattttatgagtacccacttccgcatagcctcaccagcactggatagtatctatttgtttcagtttgccatttctcaactagtaaattgaaaaaaagtgttggaaccttttttttttcatatgcttaatggctattttcatttcttttgtgaattgcctcataccctttactcattcttttaacataaatttggaaggactctatattgttgatgtgacactttgtcagtcacgaatttcacgttttcaccagtctgttttttgtcttttgagtttgtttatattgcctacttctataaatatttaaatttttactttgaaaaatgtatctattattccttttttggcccctagtttcatcttgcttaagatctcttgccatccaaactataaaatttcctgattaaaaatatatttttggtttatttttagaacagtaatccatccggaatttacatttttatatgatgtgagaaaggggacctcatttttttcttcaaggtggatagtcagttgcatctgcatcatttattaaataaatcatttattttccacacagtttaaatgccatttttcatatatagtaactctgcatatatacttagatgtgtttttaaactttctattctgttccactcttctgtttgtcatttcttgtatcaagactatgctgtttcaattacagtagattttgagaaagatttaatgcctggtacaatcaattcttattcactcttatcattgcttcttagcagttcttagatgtttattctttgatatgaatatcaaatttatttattctaggtttaaaaacactgccgtaaaaactggcatagaaagcccatttggattctgattggcattatattaaattttttaatatgtaacggcttggcattgttattaagttttcacatttaagacaaggctctgctctcctttcatcaaaatcttgttctgtatgcttcaggaaaatggtagagttttctttagattctgtacatttctgcctctttgtacattacttttgataatttctatttttctgggaaattgttcatttcctctggatttttaatttaatgctatatatctacacataatattttctaattatcatatcttccataattgtagttatctctcttcttttgggttcataatatttcatatatttttattttctcactttaatcttttaatcaggcttatcagggagtattgatcttttttatgtatatataatcattatacatatttttaaggtacatgtgatattttgatacctgtatacaatgtgtaatgatcaaatcagggtaattgcgatattcatcacctcaaatgctcatcttttctttgtgttgggaacattccaaatattttttttagctattttgagatatacaataaattattattaactctaatttccctactgtcctatcacaaactaaatcttattccttctaactgtgtttttgtacctattaaccagcccctctccattgacctgagcctttctttctgagccactgataatcaccattctactctctatctttatgaaatccacctttcagctcccatgtatgagggaaaataatcttatttcacttaacataatatcctccagttccatccatgtttctgcagatgacaggatttcatttttttatggctgaataatataacatcgtgtatatatgccacatttcctttatacattaatccactgatgggcatttaggttgatttcatattttggttattgtgaataatgctgtgataaacatgagagcatagatatttcctcggtatattgatatcctttcttttggatacatacccagcagtggcattgctggattatatagtagttctatttttaatttttttaggaacttttctactgtttttctataatggctgtactaatttacatttggtcgtttcaaagaacgtgtttttggtttgtttatcccttctgcagtttatttctgtttcttcttaattttcacttttatttccttctttttcctactttcaggatttaaggaatattttagatcctttccactctttcattgactgaatacttactttgtttattttgatttttacaaaatcagaaaatcattttagacatgggagggtgtatgtgtcgaggaatttgtccatttcttctagattttctagtttatttgcgtagaggtgtttatagtattctctgatggtagtttgtatttctgtgggatcagtggtgatatcccctttatcattttttattgtgtctatttgattcttctctcttttcttctttattagtcttgctagtggtctatcaattttgttgttcttttcaaaaaaccagctcctggattcattgattttttgaagggttttttgtgtctctatttccttcagttctgctctgatcttagttatttcttgcattctgctaccttttgaatgtatttgctcttgcttctctagttcttttaattgtgatgttagggtgtcaatttaagatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagttctagtttgatttcactgtggtctgagagacagtttgttataatttctgttcttttacatttgctgaggagtgctttactatgtggtcaattttggaataggtgtggtgctgagaagaatgtatattctgttgatttggggtggagagttctgtagatgtctattaggtctgcttggtgcagagctgagttcaattcctggatatccttgttaactttttgtctcgttgatctgtctaatgttgacagtggggtgttaaagtctcccattattattgtgtgggagtctaagtctctttgtagatctctaaggacttgttttatgaatctgggtactcctgtattgggtgcatatatatttaggagagttagctcttcttgttgaattgatgcccttaccattatgtaatggccttctttgtctcttttgatctttgttggtttaaagtctgttttaaccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagccaatttacatttaaggttagtattgttatgtgtgaatctgatcctgtcattatgatcttagctggttattttgctcgttagttgatgcagtttcttcctagcctcgatggtctttacaatttggcgtgcttttgcagtggctggtacaggttgttcctttctgtgtttagtgcttccttcaggagctcttttagggcaggcctgctggtgacaaaatctctcagcatttgcttgtctgtaaaggattttatttctccttcacttatgaagcttagtttggctggatatgaaattctgggttgaaaattattttctttaagaatgttcaatattgacccccactctcttctggcttgtagagtttctgccgagagatccgctgttagtctgatgggcttccttttgtgggtgacccgacctttctctctggttgcccttaacattttttccttcatttcaactttggtgaatctgacaattatgtgtcttggagttgctcttttcgaggaatatctttgtggtgttctctgtatttcctgaatttgaatgttgacctgccttgctagattggggaagttctcctggatactatcctgcagagtgttttccaacttggttccgttctccctgtcactttcaggtacaccaatcagacatagatttggtcttttcacatagtcccatatttcttggaggctttgttcgtttacaggctctaaaattgaggcaataattaatagcctactaaccaaaaaaagtccaggaccagacggattcacagccaaattctaccagaggtacaaggaggagctggtaccattccttctgaaactattccaatcaatagaaaaagagggaatcctccctaactcattttatgaggcaagcatcatcctgataccaaagcctggcagagacaccacaaaaaaagagaattttagaccaatatccctgatgaacattgatgcaaaaatcctcaataaaatactggcaaaccgaatccagcagcacatcaaaaagcttatccaccatgatcaagtgggcttcatccctgggttgcaaggctggttcaacatatgcaaatcaataaatgtaatccagcatataaacagaaccaatgacaaaaaccacatgattatctcaatagatgcagaaaaggcctttgacaaaattcaacaacccttcatgctaaaaactctcaataaattacatactgatgggacgtatttcaaaataataagagctgtctatgacaaacccacagccgatatcataccgaatgggcaaaaactggaagcattccctttgaaaactggcacaagacagggatgccctctgtcaccattcctattcaacatagtgttggaagttctggccagggcaatcaggcaggggaaggaaataaagggtattcaattaggaaaagaggaagtcaaattgtccctgtttgcagatgacatgattatatatctagaaaaccccatcgtctcaggccaaaatctccttaaactgataagcaacttcagcaaagtctcaggatacaaaatcaatgtgcaaaaatcacaagcattcttatacaccaataatagacaaacagagagccaaatcatgagtgaactcccattcacaattgcttcaaagagaataaaatacctaggaatccaacttacaagggacgtgaaggaactcttcaaggacaactacaaaccactgctcaatgaaataaaagaggatacaaacaagtggaagaacattccatgctcatgggtaggaagaatcaatattgtgaaaatggccatactgcccaaggtaatttatagattcaatgccatccccatcaagctaccaatgactttcttcacataattggaaaaaactactttaaagttcatatggaaccaaaaaagagcccgcattgccaagtcaatcctaagccaaaagaacaaagctggagctatcacgctacctgacttcaaactatactacaaggctacagtaaccaaaacagcatgatagtggtaccaaaacagagatataaaccaatggaacagaacagagccctcagaaataatgatgcatatctacaaccatctgatctttgacaaacctgagaaaaacaagcaatggggaaacaattccctatttaataaatggtgctgggaaaactggctagccatatggagaaagctgaaactggatcccttccttacaccttatacaaaaattaattcaagatggattaaagacttaaatgttagacctaaaaccataaaaaccccagaagaaaacctaggcagtatcattcgggacatacgcatgggcaaggacttcatgtctaaaacactaaaagcaatggcaacaaaagccaaaattgacaaatgagatctaatgaaactaaagagcttctgcacagcaaaagaaactaccatcagagtgaacaggcaacctacagaatgggagaaaatttttgcaatctactcatctgacaaaggcctaatatccagaatctacaatgaactcaaacaaatttacaagaaaaaaacaaacaaccccatcaacaagtgggtgaaggatatgaacagacacttctcaaaagaagacatttatgcagccaaaagacacatgaaaaaatgctcatcatcactggccatcagagaaatgcagatcaaaacgacaatgaggtaccatctcactccagttggaatggcgatcattaaaaagtcaggaaacaacaggtggtggagaggatgtggagaaataggaacacttttacactgttggtgggactgtaaactagttcaaccattgtggaagtcagtgtggtgattcctcagggatctagaactagaaatcccatttgacccagccatcccattactgggtatatacccaaagggttataaatcatgctactataaagacacatgcacacgtatgtttattgcggcactattcacaatagcaaagacttggaaccaacccaaatgtccaacaatgatagactggattaagaaaatgtggcacatatgcaccatggaatactatgcagccataagaaacgatgagttcatgtcctttgtaggaacatggatgaagctggaaaccatcattctcagcaaactatctcaaggacaaaaaaccaaacgccgcacgttctcgctcataggtaggaattgaacaatgagaacacatggacacaggaaggggaacatcacacactggggcctgttgtggggttgggggaatggagagggaaagcattaggagatatacctaatgttaaatgacgagttaatgggtgcagcacaccaacatggcacatgtatacatatgtaacaaacctgtacattgtgcacatgtgccctaaaacttaaagtatattaaaaaaagtgaaaaaaaaatcattttagagtatattttcctttgaataaagtctcaactgtatctcagaggttttaatataaaatttcctttttatttatttttagatattttataacttcagttatggtttccttttgatccagggtttattcagaagactattacactgggtacagtggctcattcctgtaatcctagcattttgggaggctgaggtgggaggatcgtttgagcccaggaattcaacaccagcctggtaaacacagggagacctcgtgtctacaaaaaataacaattaaaaaacaattagccaggtgtggtggcatgagcctgtggccccagatactcaggaggctaaggttggaggattgcttaagcttgagagatcaaggctgcagtgagccatgatcatgatcatgccactacactccagcctgagtgacaaagcaaaaccttgcctccaaaaaaaaaaaaaataataataataatagaaggcgattccttccaatatttcagattaggattctagtaatattatgatgtctgttttttgttaagtgagctgtcctttctgttgtgaagcttgtcagattttttttttatcctgaagtttgggaattatactagtcaatatgtagatgtgcatctatgtatgctcatcctgcctgggacttagcaagaccttttattctttccacagtaagtatatcctttttttccccttaaccgagtgttttgttacttatttgttactattttccatttgattttttcctccttcttaaacttttataatctatatatacatttgctgtttgaattatcttttgcctcattatgtccttttctttataattttgcttttggttacaaaatattttttccctatgtcatgctttatttaacgattctccattaacagactcttagcccatgttcataattctttttttggctctctattctgtgttgtgcattttgtagctaagtttttgttcaagtttgtgacaaatttccttagtgaaattcctagaaattactgggttaaagggaatgattttttttttttttgtatttcaagattttttatatgtcttagcaaatctttcttacagaaaagtttactcatttatacactcagtaagggtgtgtgtttctcatttaaaaaatcatatatttttcttttttaggctttgaaatttctgaaaaccagaagaggcaggctgcaatgactgtgagaaaagtccctaagcaaaaaggtaaagctgccccactcagtctctgtgaaagactatggaatcataagctatatgcttacatattcttaggcccatttctgtgctgaggtttacttgggggtggtggaggagtatccaggtccctaggtgtccttgatgacaggtagcaaatggttttaaatgcttaaggctaaggagtgaatagtatagggtattggtatccaaagatagctcattgagtatagcaaaaaatataacctctgttcctcttttttttttttttacttaaaaataagggaaactttactaacaatttatagatcaatggacaacatgatctttatttaataagtatagtttgggcatgatggctcacgcctgtaatcccagcactttgggaggccgaggcaggcggatcacaaggtcaggagattgagaccagcctggccaacttggtgaaaccccgcctctactaaaaatacaaaaatcagctgagtgcctgtagtcccagctactggggagattgaggcaggagaatcgcttgaacctgggaggcggaggttgcagtgagccgagattgtgccactgcactccagtctggcaacagagtgagactacatctcaaaaaaaaaaaaaaaaagtataaagatattgctcagctttctgtcaccggtctggaggcatgtgccaaatcaggagacccaaatcacaataaagaatctcaaactaagccaagacaaaagattcagatattctctttctcttaactacaagccaaagtacttaagaaaaaataccttgcaaatcaatttaaatctgaagttaagctttagtttctcttttctcatgaaccagaacaaaactatcatgctcagccaaacaaagggaaggaactaccttctgcttattggaatacctattcagtgtcagtcactttatatgttatttcatttcatctttatggtaatcctgagaagctggacactattaactctatttctcagatgaggtagctgagggtctttgagtgaagtaactgaacttaatttgacttgactcagagtccactgctttctcctctccatctcagggtcctgatgaagccccatgcttggaaagaagagtttggttttctgtcttgcctcaattactgacagctgcttctattactgatagccatgttcactgtccccaggtgtgggcaatcttaatgagaccttactttccccaggcctttccttctgctttctcagtgggctttgtggttctgaatgagtcaccatccaaaatgatcagattcaagtctcctgaaatttccagcagccatgtaaagcactattttttttccattgaagcttcttttgattgaggctgaatgcctgtgaacatctgatttccagttaagcagtgcacctagctccgctgactagacatgcctccccttcaactgcttattacttcttgctcttgggaggcccttattgtctcttttcctcatcatgcgaatgtgattccccttatatagggaatgaggccagccttaattagccaccaaaaagttgggagttaatttaaggtggggaattaactcctaaccttttgattgctataataacatgtgagagatggtgttagaaagcaatctggagttaatgtcagtaaggatatgacctgtattaacagaacttggtaagattttgctccagttcctcagacagaaatgtgagcagaaaagagcccagccaactgaagttttcaggctgcaaaagggatactgtcctaacagcttgtctcctggacgctctcaactcctgaactttctcactctgatttcctctacttcccccactgtattcttcagcgttctctagagggacagaactaataggagacatatatatatatatgagtttatatgagtttattaaggagtattaactcacacaatcgccaggtcccacaataggccatctgcaagctgaggagcaaggaagtcagtccgagtctcaaagctgaagaatttggagtctgatgtttgagggcaggaagcatccagcatggaagaaaggtgtaggcttggaggctaagccagtctagtgtttctaggttcttctgcctgctttttattctggccatgctggcagctgtttaaatggtgcccatccagattgagcatgggtctgcctctcccagtccactgactcaaatgttaatctctagcaacaccctcacagacacacccagcaacaatactttgcatccttcaatccagtcaagttgacactattaaccatcacatccaccatactgacctttatggtactcctttatccaagcctgggttcctcaagcatatctgagactgaattgtcttttcactgagaacacttcaaacaaaggaatatctataaagcaaccaggagttggttaaccagaagatagccctgctaactcatgccaagcattttggtcaaggtccttccccaccctatgtatctccaggccattccttttagggcctttcttgtctcccagtgtctaaatactgattcacttgaacagttttctttctttaacagcaattctaaagtcttcaaagaaattcatttagtttctgtctttctttctttttttttttttttttccctgagatggagtttcactctcatcgtgcaggctggagtgcaatggtgtgatcttagctcactgcaacctctgcctcctggtttcaagcgattctcctgcctcaccctcccgagtagctgggattacaggcacctgccaccacacccgactaatgtttgtatttttagtagagacggggtttcaccatgttggccaggctgatcttgaactcctgacctcaggtgatcccctcgcctcgtcctcccaaagttctgggattacagatgtgagccactgcgcccagcttcatttagtttcaaacctcccaggattactacaaatctcctcccttatttctatttttggtcttcaagactcctagtccagggctgtagtaactgatatgttttgagactcaagagtgccatacatgtggaagtggttctcaaatgtaggaattcagtagttacaatatgtacatgggaagagcaagaagggattatttaagataaccatgaaagctggcttccttgagcttttcaatgacccatcacaggaagtgaggggcattgttaagaggtctccaatgcggatgtcattagataggtaactactctaatgtccctttccaacaccatctgtaacactgggacattatcaactcagtctactgctctgggagagggggaacctggctgaaataacagtagagaataccagatctagctccaagaaaggccttttcacttgacctttgtctttcacgctgctttcattttaagtattgatatataacttcttgaaagttttatgctaattcctggtacataaacctaattaactagatcagtatagagctccccatggctatgagcacagactccatctccagaggccttggggccagcacaaaatcaaatgagtgccctagaatagcaaaaatgatctcgaaaaagaataaaatgtgagtaatcaatctacccagtttcaacactcattatatagttacagtaaccaagacagcgtaattttggcagaagggtggacatatcagatcaatgccacagaacccagaaataaatgtacacaaatatgcccaattgatttttaaatttattttgtattgatatgtaataattgtaaatctttactgagtacatgtgatattttgatatgcatacaatgtgtaatgatcaaattagggtaattaggatatctatcaccttaaacgtgtatcatttttttgtgttgggaacatttcaagtcttctgttttatgtattttgaaatatgcaataaattattgttaactactgttaccctgctgtgctactgaacactagaacttattccatctatcaaactgtatttttgaatccattaaccaacctctcttcatttccctaacaccatccttccaagcctctagtaaccatcattgtactctctacctccatggaatccacttttttagctcctacatttgagtgagatcatttgatatttgtctttctgtgcctggcttatttcacttaacattatgagctccagttccatccatgttgctgaaaatgataggatttcattctttttgtggctgaataatattccactgtgtatgtatactacattctcttcatccattcatctattgacagatactttggttgattccatatcttggttattgtgaatagtgctgtgataaacataggagtgcaaatatctcttcaacgtactgatttcctttattttagatatatacccagaagagattgtgattataaaagtgtaacaacagggatccttgtgatgatggaaatgttctatatcttgactgtatcctgttataatgtcaatatcctggctgtgatattgtactattgtactattgttttgcaaaatgttaccattgggaaaactgggtaaagagtacacaggatctctattatttcttaaaactgcatgtgaatctgtaatgatttcaaataaatgcttttaaaaaaaatcaaattagtaacaaaattccctctctaatatctgcgtattgtctgttggcattcagtaccctcatacttctgacacttaccaccttgcaaaactagctcttagaaaagattctgatctttctcactgaagtgccagtggctgatgatggcttaaatgatactacttccaggcaaagggacttagtcatcaagcaaaggcaaaaaaagtaactgtaatgttggaatttcagaccctgagtagcagatgaggaaggtatttgggagcagcagagaagccttcctgacatgtctgaattatatgctgtatgtcttgtcctattctgctctgaatgtagatcaggattaaactttcactttaggcctccaggttcctggaatcctccattaatgtggattttgctttgatggttgcaaacctacctacaaatgttgagaaggtttttaatattagtatcatttaagctattccgtttgaaaagacacacacatattccgtcttccttgctccccatgaattataccttctggtagtaagtttactttctccttcacctactaatgtcaattctctattaagtgcaggttcatcactctcaacccaggacagaacactaaatcacttgcaccttatgcttttagaaaatttctcctagaaacctgtcctgaagtcaatagttcttaaccaggctcttttaaaacttccaggggggactggagaaggcgaaatagagtttgttgggttctttgcaggaccaacccctgcataagggattctggtgtcttggaaagagctctgaactgagtagtcaaagaatgtaggttctaacccttgctttgtcgctaacttaccatgtgaccttgggtataacatttcttttcagatatcagtgttctcacctgtaaaacagattatagcaataccccaaatttctttgatacctgactagatgtggaagtgtgtagggttgcaatagtagccatggtattccaaaatctgtttgaaagaggaattctccccttggatgatttgtaaaaccagttcacactctctaaaccagtctgccttgagttgtctgcccagagtggtcactgggtaatttgagaagccctttgttacataacttataccctttccctttgatctctcatctactctaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatgatacctacagggaggcagataattttaaaataaagtaaataaaattatatttatagatggaccttttttcggagaagcactgttgaaatttatacacacacacacacacagagacccttgagtacacatacacacacacacacacagacacacacacacacacacacacacacacacacacagagagataaggaacaaaagtgttttctgttgttttggggaagtgaaatatgtggttggtaggaagaggtaccaatgacttccaaacatgtgattccgtcttaaaagttttccatttttaccctgtcccccttccctttgctttcagaagttgacatttctattcattgcttttcttgttaagataatctctttactcccctgtgagtgattcactgccttgtcattattacgatagatgtgtttgtattgttttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagttgccccaaataaccttttttcagcatcctctgtcctcagtcatgccagtctggacatgctctgttgtgccctgtgacaaaactgctcagtattcctattgcttttactgtgttttaggtactgtgaagggatcaaaaaaccaaacagaagcaagggagtatcagactatgatgatgctggagtggacttctgttcagggaacattttgcattcaggctgtttcttctatcactggggtttcccatgttgcagcacttctgggtcgttgcaattttgcatctaggagttagtttgatcgagttattctcttttttcaagtcacttttgttataggtctccccctaggcctgtctctcccttagcccaaaagatctgaactggaagcagaggttgagattctgcctcccaggagagggatttacctgccccctagtaccagataggtttagggcagtgatctctacagcaatcagttcagtgtcctggttgtccctgctcccatttacagatgtttgggcagcattgatagaagtatggaggggttcaagacagagcccacctgatcaagatcatcagctaccttcaaattattgacctggacagggtccaagtctgatagtaaccttttacaagaaagaacagggatgggaatggaaagagatagccttgatccacagtattgtacctgcattttctaccaccctaaaattgtgtgagacttctcccattgttaacagattgcatggacaatcttccctggcttctttctttccctctctctttcttctttctcctgccatcctagcacaggaggatttttggtattgatatagttaaagctgttctggcactcaaagaaggccgtgtttccaacatcctctcatcccaggacatttggggcaagtgagttaggggcccaggggcaattttccctctgaataacgtgtctgaggcagggatgctaccctcaggctcgcttttggccagctttttgcttgggaaaatctaacttctttcacaaggaggcaggcttcctatggatgttggagtacctgtttttcctccacacatagcccttttcatggatagaccttgaacaacaaaaagggtataagggaataaggatgaactctgctgtgaagagcaagccactgtagtgaggaatgtggagactgggagtctgtcctaaaccccatgggagaagacttcatcatgacaggacttcagcttaccaagcagcagccatagctgtgtggaggcttcagcatagctagcatgtttactgctctatgcctcctgatccagaccaggcattgcccagcctgggaatcttttctttgtgggaatcaaattacaagctatttaagtttatattccatcacaaccaagtcagacttgtattataagtcaaggatgagcctgatctggggagagggccggggctcgggactggccaccactgttcagcacatgacctaactacgtaagcctctttggcaagggtcctggtgcccagcacccaggctaaaatatcctgtctggcagagtgttttggtagctatgcaggcctcccttcagtgtacctctttttccaacttctcactcctccttactaggcttggccttgacatgcttcttcgagggttggcagcacaccgggaggggatgcttggacaagtttctgggcctacatttcttgactaggccctctcatttcctccctccttggggcttctgcccagggctccaggatcagggatattacttctcaacccgcacttctcctctactgaacccactggcatcacctgatgccactaatttgtgaacaacaagaaatcatttccccattggttggagtattccctcagcctatagcatcaaagcagaccagtggccaacagccccaaggggagcccaattaaatacctgggttcagtatcctaacctgttatgtcctgacagcaatggtaaccccagtaattctgtaatgttgtaatttccgcatggccctgagctcccttttcctcaactcagtgaggccaggatttgctctccaaaaggctttgctagtgtgttcaatgggacctgctgtggggagtcctaagacagacatctaattattctctctttttccccccctctctatgtgtatatttctaatggatctataagaacagcaacaagagagttctaacaattctagtgtgaagccaaatagtgatcttttagtgctttggggatggggtgggctggggtggatggatgggcaacagtgactttgattacccttgctgctctgcatttgccagtttattcttttgtttcttttatctgactgactctgtcaaacaagtgtcaaagttgtgtgttaaaaaatgtttaacaaaaaaaatgttgtaatgacacaaagccttatgaaaatatttatggagttcaataaaagaagtaaaaagac

SEQ ID NO: 36377 - DNA, 3328 bp, Homo sapiens
gtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctggcggcctggccactctgaaagtctccctagggaagagtgggcctgaggcttgtcactggtcggaccttccgcacggtaaagctaagctagggcctccataagacctccataagatctcttcctttcatcccttccggctcagcctgcatactgaagggtcctagcctccctttcccccccagttattccaaggggataataaccctctgtttaggctgcttttcctgacagtagtggggctgaacctttgagcgtagtggctgggaaagcagggataggcctcagtattgggggtgaggctgaggaaaaaagaccctcacccagttatgttctccagatccagagcgctgacctacccacccaacccccagcccagtctcccagaggcccgcacaagagtaccagattggcttggctctagtgggctcctggagatgggcgctccctgtgctagagatttggctgtagacaccaggaagacccaacagtggcaattcaccagccacctggggtgtggggtcaggggagacgcagccttcattcctttgtgcttcttcctagcttaggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatggtgtgctctggtgtgggctctcttcttgggggtctgacatagtagcactgcccacccatcacctcacttcccactttcttctagtagaccccaaaccccaggcaaaggattctccaggcaggccaggcaccgtggctcacgcctgtaatcctaacactttgggagatgaagacgagtggattgcctgagttcaggagttcgagaccagccagagcaacatggcaaaaccccgtctctactaaaatacaaaaaattagcagggtgtggtggtgcatgtctgtagtcccagctacttgggaggctgaggcaggagaattgcttgaacccaggaggcagaggttgcagcaagctgagatcgcgccactgcacctccagcctgggcaacagagtgagattctgtctcgaaaaattttttttaaaaaaaggattctccaggcatattatcctcttttcttcccacttggggttgggaagaccacagacttccccgtgacctgtgacatttgccatgcccaggtgtggggctccagcccagcctgtttccttctccctctacacagctctatgttctatgatgaggatggggatctggctcacgagttctatgaggagacaatcgtcaccaagaacgggcagaagcgggccaagctgaggcgagtgcataagaatctgattcctcaggtgaggggctgggcagcggtcacagagcctacactaagcgtgtggaggtggacccagatgggatctgttgtcatggtgggggcttttgcggggggatctgggaggaacaaggaagcttcctgaagtagaggccctgagctgacccttactagcctctgtttccatggcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgc

SEQ ID NO: 36378 - DNA, 254523 bp, Homo sapiens
agggagggaaggaaggaagagagggaggcgggcaagcaggcgggcgcgggggtcggggactgaggcagtagagggaggcgagagcccggcagccgcttcgcgctgtttgctgcgcgggcttttggagggggcggccgtttagtcggctgaggagaagcggacaccagcggcgttggtgatagcgcctgggggagggggactggagaggcgagaaggggggtcgctgcggtggttctctcgctgtcgctctctctttgcctcgctcccggctcggcgggctcctcccggcgtctctctcgcctccggggtcccgctccccgccccccgcggtatgtcttgatcccgagcagcgggtttcatggggctcctcaggattatgatgccgcccaagttgcagctgctggcggtggtggccttcgcggtggcgatgctcttcttggaaaaccagatccagaaactggaggagtcccgctcgaagctaggtgaggaactgaactgccccgggctgagtgctgtggaaggggccgaggaggcgctgccgccggagcaagtgggcgttcatctaacctggggtctggctcgggggctgaaagcggtttcaaagagaaccgggaacaaggggcagcgagagcacgagctccaagaatgggttgaattaagcttgagcggcgtgctgggctcgcgaggtcacggggcagaggttgcaaggttgggcttccctagccaaagggtagccccgaagtaggcattccgcggagagagagcgagagagaagaccgaactcagtggggagcgtgtgttgctggtctccggagacagaagcgcttagcatcgcgtgttctcttggaagtcgtacaggaagccctggcaatgtcagatgaggggtattctaatttgagctatgggcatctggatacgaattcttttgggggctcatgaagggataggtgcgcagaaatgggaggagatgctgggatgacggagagcaacatgtgaacactgtagcgagttgcactcttgtgctccgggcagcaaaggaccttgtaattgccagctgagggaggctggccgggtagtgcgggaacgcgagtgcaaagcttcatcggagtacggaaatgagggtccggagatttaaattcttctttagtggcgctaaactgatgaattggggcttgagaatagggatgcctatgtatgttgcttcacggcagtgttgatgtgaatttcgaagaggagggaacgctgaaggggaattatgtagtgaagtttgtgtttgttaaaggaaaagtaggattatgcggaaagctaaccatatggttaaataccttaaagggttaacaggtgctttaatggatgagggggtctaaagtacaaaaagttggtgtgaagttgtgaaagacaggccagaaaaaagcacagataataggtactttcggattaatagggcactttggcatttggaagagctcagcatggagagcgagagttaaaagaatgacagtgataaattttgatttaaaaatgtacatggcacttaaaaatcagctcaagaggatgtaatttgaatatggaaaagtaatgtgaagtgttttttgcatactctcacctcaaaatcattttaaataccttttgagaagccagcaaaaacaaaaacaaaaaaccctcagcagtgtaatttagactaagaaatagatgttactgtgagtggatgattaatttttaggaaaaatgtaccagaaaataattgtaatattatgtatagtagctattttggtacaaggctttgcaaaagccttgacattttaaagagccttgaaagaaaaaccatcaagtaaatctgagtgaagtgcaactaaagttggaggaaaactagagttacttccagccctcaattctagagtaaaatttgaagagatactcagtttatttacgaattcctttattaatatgtatcttgtgtggtggaaaaaaatgtccactttaaatattgaaggttatccagtctggtttttcttttcttttggatccatttagcgacattcagggtcatattctggcgttattaatgatccagctctacagaaaaaaagactcctcttgaagtggaaagttatattaaaattaaaatttgtacttattttttgttttgttactatttggaattgtctggagttgatttcttagacacgttacagtgggttagaatgacttaaatttttgattttcctcctttcctaacatttctttccccatatacttgaaaattgcttccatagacacaatctgaatgatttttaaaagaaagttatctgaagatgtataatgccacagttaaaatataaagtgctttcttgtgatacaagaaagaaaatttcataaaaagtagtaaatatgcatcaaaatcctcctgggactacagatgggtatacctgggagtacaggtgggtgttaccatgcctagcagaggaaaccatattttgacaaccatattctgtactaggcacttttcatcgtagatactcgtgtttaaagtaagaacaccatttaaagccatttttgaccagacacggtggctcacgcctgtaatcccagcactttgggaggccgaggccggcggatcatttgaggtcaggagttcgagaccagcctcgccaacatggtgaaaccctatctctactaaaaatacaaaaattagtcgggcggggtggcgggcgcctgtaatcccacctactcaggaggctaaggcatgagaaccgcttgaacctgggaggcagagattgcagtaagccaagatcacaccactgcactccagcctgggcaatagagtgagactcagtctcaaaaaaaaaaaaaccaaagaacaacagaaagccatttttgcagatgcaggaacaggcttagagaggttatataacttgcccaagaccacatcgcatttaagtggcagagccaggattgcaacccaggtatgtatgattccaaatcaagtgctcctttaattatgtccggctgcttaagactttatattgacattacgctgagatttaggtatttgaatagagttttaaaattgtaatatcagtgtttaattgcatttattgctaagaatgaatatcattcagagaaaattgaatttctgatacaaaggaattggtttaatgtaacgtctgccccttgtttagattcatgtaatgaacataattatgttacccaatgaaacaactgaattagatagcttatttttactataggaaagaaaaatctagctgttttccatacgtgcaaaatcacaatgttaaaaaagcatttttattttggcataaaaaacctattaaacattttgtccttaaaagtagttattatcattttcattgtagaagattccaaaggatagtattgtctgatagtggctttaatataccttgatttgagagtacagtattttgatggtgagacttctaatagagcaatagatgtattcaaaactgaggtgtactcattgactacttgggaaattcactaattaggaattcctaaaaaaaaaaattcagtaatacagctttttatttttattttttaaaaaacaaatatggcattgtagtccacatattacaatgcggcttgctttttttgccttgaatgttatacacatctttccaggtcagtacatatagatgtgacttactcattctattaataatagctgtataatattccaaagtatgcatgtatcataaattattaagccattattctagtaacggacattcagtttgtcccccatctgtcgtgtgtgtgcgtgtgtatatatacatatatatataatttttttgagtgtttcttttctttcttggtattataaacaattataggaaacatccttatgtgtccgtttaactcatgttgatgtcattttgtgctaggatgaattctgtatgtgagattgctgggacaaagaatatacatattttataatttaacagatttaaaaatctacttttcaacatttttttgtttttcaaaagatgtagtaatctacactgccagcacacattcattagcactagaagataatcagcttttaatttttgccagtgtgaagctgtgaaatgatatattcaattaatttaccttctaatttctaggtaggttgaacatctttacatgtttattgcccttttatttgttacttttttctatttttctattgggtggtttacttttttttttaaatattagaattagtaatcctttatctatcctatgtcttttttaaattttttttatttttatttatttatttatttatttatttttttgagatgagccttgctgtcacccaggctggagtgcagtggcacgatttcggctcactcctgcctcagcctcccaagtagcggggattgcaggtacgtgccaccacgcccaggtaatttttgtatttttagtagagacagggtttcaccatgttggccaggctggtcttgaactcctgacctcaagtgatctgcccccctctgccttccaaaatgctgggattacaggcatgagccactgcacccggcctcttatttgtttttgtccaagtttgccatttgtttcttgactttatggtgtgttttgctcatatagaagttttaaaatacacacagttaaatctatcaatttagggaagtcgttttcatattttgcttaggaagacttacccagagccaggattgtgtacattttctgtattttattatagtattttatagtttattacatttggctctttaaaccatttgtatgtttacagagatttatcatgattttctcagtaaatcattttttccaactgtatgttaacattccttcttttaatcacatactaagttttcatatgttcttggatcaattttggatgctattttccattaatcagagattctttaaacctcggggacccataaataggcttcaaggtatcagtgaattccctgaaattatatacataactttcatcagatttgcaaaggagtatgtgattcctttaatggcaaggatcacagatttatagtagatgtttcatatttagtggacttttttttgtttttagtaacataacgtgcagattgtgagttaaatttaggagataagcttattacctgtgaaaaagagaagtttttcaacttcaaatgaagttaatacttcattgtattaaaatgtagacttaattttctagtgagaaatggaaaaggacagggaatccaaatgaaaactatttaactgtgactcgttactataaaatgtcagaatttgtggctggtaaaaagtagttcttcccgaatttcaagagcgcacttgttgctaatattgactggtcgaacagtgcagtgaaatattttctcacataagtgatagaactatgtgcttggtaactttattttctatagggttttagcattgtaaataatatttgttgactgtattcttacatctctatatggatttatgagcacattaggaataatcttttacatggggaaaataattgagaatggattatgtaatcatccattggtgagaattaatgttagtcattatgttcttaaaactctactagactaaacaactaattccagggccaaggttgagactgctttttggaatttggtagtttttacaagtaagttcctgaaaccatgcagcaatacctgtaagatgttccagagaatgctagatttcctcacttctgaaatcatttggaaaacctcatagtagctactgttttgaggactttgggttaataggaatacagttattctagaattggtaattggtgcctcacttagtcttgaataggatgtctagtgccatggagtagtcacctgaaatagttgatctcaattaagataattccaggatgtctgtccaccactctggtaggccttctaatagctttttggcacttagagaaattgaaataataatgaatgttcaaagattgctctccagaagaccatttttgaaggatgtacttatagatgaacttcataatcatggttcactatagcctagttatttttaagatctacccacctaccagtacctgtacttacgtattctgcctttctgcctgttaacaatagatggtaactgtcagtgctcctgttcggtcatttgtgcacctgattctgttgcctcacttacctaaagacatggttcccgaagctttccctcattctcctgtcacaatgtattcttgaaaattgctaagagagtggattttaagtgttttcaccataccaaaaaaaaaagtatgtgaggtaatgcatgttgtcttaattagcttgatttagccatccatgatatatacatgttttaaaacatgttgtacatgataaatatatacagttttgtcaattacaaataaaaaaaaactatcttggtaaatgttccaggtgaacgtgaaaaatatgtattctgttgttattggctgaagtatgctgtagatgtcggttggtagtattgttatggtgttttgtattcttgatttttttctgcctcttcatcagttatggagaggggttttgaaatctttgataattgtggatttgtctgtttttcttgtagttatgtcactttttgcttcatgtattttgaagtgctgtgattaagtatatgcacatttaggctgtcatgtcttcttgatggaccaacccttttttttatacaagataccatctttatccttggtaatattctttgctctgaaacctactgctgtggtgttaatgtctcccccaaaattcacatgttggaaacttaatctccgatgcaacagtattggggcgggaggtggagggtgtttaggtgatgagggctctcccctcataactgtattaatactgttataaaagagcttgtggcagtgtgttctcttttttctacgtaagaagacagcatttgtcccccttttgccatttctacccccaaccatgtgaggatgccacaagaagtccctcaacagatgctggtgtcttgattttggacttctcagtttccagaactgtgaagaaatacatttctgttttctataaattacccagtctcaggtattttgttatagtaccacacaatggactatgatacttactttgtctaatactaatacagacacttcagttttcttttgattagtgtcaggtggtatatcttttcccatcctgttaatattaacctacttgtgtatttatatttaaagtggatttttggtagacagcatctaatctttcatctaatttcacaatctcttttgttaatggaatgtttagaacacttaatgtgattattgatgtggttgggtttaaattcgtgagttgctatttgttttctgtttatcttaactgttctgtgattcctttttttctgttgtctttaggattaaaggggtatttttaaattccattttttaatttgatgacttactagcagtgctctttgttgttgttttttttttaagtggttgcttaagggtttatggtatacatgatagaatttcatgtgtagtataagaaccttaatatattaccacttttttctgggttcttgctatcgtcattatacattttacttctatacatgagtcctacaatacattattatttttgctttaacttatattttaaaaatatataaaatgtttaaaaattttttaaaaatttgctgacatatttaccattcccagtgttcttcattttgtgtgtgtgtgtgtgtgtgtgtgtgtatgcagattttcatgtggtaccatttttttcactctgaagaatttcttttaacattacttacacttaaaaatatactggtgatgaattcttttcattttgtgtgtctgaaaaagtctttatttgctatagtgtttgaaggatatttttgttgggtatagaattctaagctgacatttttgttgtttcagtactttaaagatattgcttcattgtcttctggcttgcattgtttctgatgagaaggttgccatcattctttgttcaactatatgtagcgtgtcttttatttttcctcttttgcctacttttaagagtttcactaggtttttaattatttaattattaaattatgtttcttgtgcccttgtattatgtttcttgtgcctggggtttgttgagcttcttggatctgtgagtttacagtttttattacatttaaacatttttggctattatttcttcacgttagtttttctatgctgcttctcctctcaggaactcaaaatacacttacattagaccacatgaaattgttctacagttcagtgatgttctattcatcattctcagtctttttgtgtgtgtgtgtgttgttttagatagtttttactgctaggtctttaattcaccaatccttctgcagtatgtaatccacttttaatattacccagtttattttttatctcaggcgttgcctcccactcctccccctgcccttctagaagtttaatataggtctttaaaaaattatgtatcatttctttccttaacatcctgtattagcccgttttgacgccctgagactgagtaacttacaaaagaaagaggcttaattggacttacagttcacatggctggggaagcctcacaactgtggcagaaggcaaggagaagcaagtcacatcttatggtggcaggcaaaaaatgagaaagcttatgcaggggaacgccttttttttttttttttgagacagagtcttactctgtcacccaggctggagtgcagtggcgcaatctcggctcactgcaagctccgcctcttgggttcacgccattctcctgcctcagcctcccgagtagctgggactacaggtgcctgccaccacgcctggccaatattttgtatttttagtagagatggggtttcactgtgttagccaggctggtcttgatctcctgacctcatgatccacccaccttggcctcccaaagtgctgggattacaggtgtgagccacttcgcctggcgggaatgcctctttttaaaaccatcagatattttgagacttattcactatcatgggaacagcatgggaaagacttgcccccatgattcagttacctcccaccaggtccctcccacaacacaggggaattcaagatgggatttgtgtggggacacagccaatccatatcattccacccctggcccctcccaaatctcatgtcctcacatttcaaaaccaatcatgccttcccacagtcccccaaagtcttaactcatttcaacattaactcaaaagtccacagtccaaagtctcatctgagacaaggcaagtcccttctgcctatgagcctgtaaaatcaaaagcaagttagttacttcctagatacattgggtaaatacagccattccaagtgggagaaattggccaaaacaaaggtgttacaggccccatgcaagtctgaaatccagcggggcagtgaaatcttaaaccttcaaaatgatatcctttgactccatgtctcacatccaggtcacactgatgcaagagttgggctcccatggccttgggcagctccacccctttggctttgcatgatatagccccccactcctggctactttcacaggctggcattgagtgtctgtggcttttccaggtgcacggtgcaaactgtcagtggatctaccattctgaggtctagagaacagtggccctcttctcacagcgccactaggtggtgccccagtagggaatctgtgtgggggctgcaaccccacatttcccttccacactgccctagcagaggttctccatgagggccccgccccacagcaaacttctgcttgggtatccaggtgtttccatacatcttctgaaatctaggctgaggttctcaaacctcagttcttgacttctgtgcactcgcaggctcaacaccatgtggaagctgccaaggcttggggattgcaccctctgaaggcatggcccgagctctacgttggcccttttcagccatggcaggaggtctgggacaaagggtgccaagtccctaggttgcacatagcacggggaccctgggcctggcccacgaaaccattttttccttctaaacctctgggcctgtgatgggggggcactgacatggagacctctgacatgccttggagacattttccccattgtctaggggattaacattcagctccttgttacttatgcaatttcttcagtgggcttggatttctcctgagaaaatgaaattttcttttctattgcattgtcagtcttaaaattttcctaactttgatgctctgtttcccttttaaaattgaatgcctttaatggcacccaagtcatctcttgaatgctttgctgcttagaaatttctttcaccagaaaccctaaatcatctctctcaagttcaaagttccacagatctctagggcaggggcaaaatgctgccagtctcttttctaaaacataacaagagccacctttgctccagttcccaacaaattccttgtctccatctgagaccaccttagactggaccttattgttcatatcactatcagcaattcagcaagtctctaggaagttcccaaactttcccacattttcctgtcttgttctgagccctcaaaactgttctaacctctgcctattacccagtcccaaagtagcttccacatttttgggtatcttttcagcaatgccccactctatgataccagtttactgttttagtccgttttcatgctgctgataaagacatgcccaagacaacaattaactaaaagacgtttaatagttctacatggctggggaaacctcacaatcatggtggaaagcaaggaggggtaagtcacatcttatgtgatggtggcaggcaaaaaatgagaaagcttgttcaggggaacgcctctttttaaaaccatcagatctcatgagacttattcactatcatgagaacagaatgggaaagacttgcccccatgattcaattacctcctaccagttccctcctgcaacacatgtgaattcaacatgagatttgggtggggacacagccaaaccatatcacatgcttttcctaattttttttgaacaagtggaatattgttataataactctttctggtgctgttgtctactaattctatcatctgggtcatttcttggttgctttctattgatttgcttttctctacattatgggccatattttcttctttacgtgtctggtaatttttaactggatggcagacattattttaccttgctaggtcctggatatttccatattcctataaatactttcaaactttgttttgggacatacttaagttatccagagacagttttgtctttttgaggcttgcttttaagtttgtttgatggcaccacaaagcctttagcctaggactaattttgctccattactggcagtcccttgtagtgcccttcagagtattccacccagtgccctgtgtattacaaggttttgccactttggctgaagggaacactggttgagtgaattcccaaaattgttccacctgcccattttgaatggttcttttttggcctcagtttcttaacacatatacactgagaggtactctgctgaaaattctgtttttagctctgtcctcttcagtgcactgcccggcaaacttcagccgccttgtctttcctaaaaccttgattctcgctccttaattcaaggagaatgttggatccctgaattagactgagttctctctccctgtgctatagcctagaaactctctcaggcagtcataagactcacttcatttcctttttctcaggaatcctcatactatgctgatttcctgtttaatgtccaaagtctgaaaattgctgttctctattttatcattttgttttgttgtttcaggtaagagggtaaattcagtctcttttacttcatcttggctaggggtagaaactgggtgaatctttgattgtgtgtccccaagttgactgaggggaaagtagtgaagttggatcatttgaattatacttagtaattaaaactaatattgtaaattcagggaaagaatcatggttttattatgtctcttgatttcttcataatctctagcatggtattgagcacaggccttagcaagttgttaactgaaagttaggcgagacttatccatgatagtcccaccttcctccttccttatagaagtttcaagcgtatgttagttaattctttgaagtgttatcaattttattctgattttaagaaaccaggccttttgtatccctttagatacagctgagtctaagaggaagactctttcagactggctgatgaaccatctggctccagaagaggtttttgcttttcctgttagtatggttcttgagctaactggtcacattcttgctgggtgtggctggataaatagttctgttcagaggcttctttcctgtattccttccagaatacctttataccaagctaagtaatggggaagagaatcagagggatggtagtgctaatagtagttatattcaatatgttgcatgtatagaaaatgcatatagtttgccctatggtgaatattatcattatagtcctcagatcttcaacgtggcatggcacaattcttgctaaaggtagttaggttgtgctgaacctgtgagtactctaaagtgtcaaggagaagtcttttaaattgtaactcttggcttctcctgtgggaaggtagtgatttgaaaatggtgaattgatttgctgcttatatagcaacttaaaactggatttagagggaaagtaatgtccactttcctaaattccagcacaagttaggaataatccattagtatcaccttatgtttttccattatttatttttaaattcgtgacatagctagaaataagtgatttgtacaggtaagcactcagaaatgactataaagagtgatcagatgatgtcagttgggaaaggagagttgtgttgaaaacccttcgatttttgcttggtatggttaaggatttgaggttaagtggctatgcaagtgcagactaactcttggcatatttatttctaattacaaactacttttgagttgggcttaatgaatgtaatttagagatgttattggttcattgataagcttctgctatgtagtccctgtatgctgtgaagcaaaacactataggaaatgggctaatcaaactagttttatttttttctgctgcttaagttggtagtctgagtctccatagcttgtcttcagacaatgaattgtacatcaaatactctgttactatcatgctttcaaaataatgctttattacagtatgtctttgttaatagtaacttaaaaattgaaatctttagaagaaactaactgcgcagcataaacattcaaactaaaatcttgctgcaaacctgaatttttatagtgtattcagtagagttgtaaattctgccctatttttgttctaagactttgatgattagggctatctgcgtctttcagtttctaaggtgtgatgtaaaaggacattatcgtaagttttcagtgataaaaaatatactattttaaatataggcaggaatattagagctttgagtgaaattgaattactggattaaaatcaataaaatccttcttcaaccttgcatttgattaacttgttcaaattttgtccatgacaaactgaaactggctcaggagtgaggtttgacactaagattcttgaactatatttagatttgatctgtatttaagattcttgatttatattctgtatttgggtgttaagaaagtgcctccaattgccagtatttttatttcaacacagtcttattgcttttcaacacacccacctcttattaactgttggatgttcccagaatgttatacacctctggcagaaaaactcagttgtttcctctatagaaaggctgattagaaagactggcttaacatgattttaatgtattttaatagatagtttctgcatttttaaaaataaaatagaagaaaacattcatcattgtcttctaggacataaatttcttattttccttcctactttgaaggttaaaacaaaaaagcaaacaaagttgtgtgatgatattttagtgtcttgaaatggatttctcagccattaaaataagggatatgtatgacttttgcacctcacctgggatttgtcagtgatactctctgacttgatatgtaccttttcaggtttgtcttatagataagatgccatcgtgtgccctttttcttttaccctaggttggaactttgtgtttaattagtaagccatcatgacctctgaaccttcatttagacaataactaacagttatggagtacttactgtgtgtttataagtgttttatgtgtatagtttcatttaatgtaaatgatacttgtttttgctttcttcagagaattgctgtgaagttaaatgatgttcaaatgagataatgaatgtttgtacaaacactgtagttataaattgttattaataatgacaataatatctaactactttctctttgccattgttgtctttaaggtttaatatagtctacagcctacattttttggtgctgtagtttttcccagtgcctcatctcataggatgacacttgtctgataagtcctcagataaatcacatgatgttacatgagttatagatttgacattcagattagctttttattctttccttccctaggaagaagtaataatcactggcaattcatattgttatttgcctccttaaagtagaaatctatttgttttcatataaattctagaaaagctatggctttttgatgttactggactctcttcactctttcctattaatacctgtgaaattgacaatttaaagatagatttataaaatgcaaattaaatttaaattgtgatggagtttttgcatgtgtatatgtatgtgtttatgtgcgtatacatatataaaataactctttggcctctaaatttttaaaggattaatgatagtcaaattaatgaaagaagaaagaacctaagcctatttctccattttagaaaaagttttgtgtgatagttgctttattatattgtcagttttcccatggtgattcattgtcatatctcaaatagaggaatatgttctgtatcctttatttaaattaggaaagttcagtttttcttacctttttcactcaaatacagaacagtataggctgtacattaatatttattgccaagattttgaggatgactttagaaaagacaaaattcttgaatcttacacagcttcaaacactattaactcaggtaaatagttacttgccattctacaatcagaaattttggtagactgaaatggtggactatgagaggtaaactgtgttgtgatcacctcttttatcatatatattgctgctactttttttcaggaattatagcattattcttaagtacaggtcagccttactgttgaatttaacatgtagctgttgtgtacaatttgaagagtagagcagtgatttcatttgcgtattataatgttttatgtttatggatatctttaaaatttttcctaattagcagtgaaaacattttgaaagaaatgctggatttgttggaagctcagcttgcattttagctatacctttaaaactttaaaaaattcatttcttaatgactttaccaatctagaattgagaaagacagaatggagaaacaacatgaaccttttacatttcacctaaccttcctctatccccacatgaagcgtaataccccataggtggaaactgtcttaaattttattttgtttccaaaaacttaagcatacgttagtctgggcttttgggagttatcttgtagaataagattattaaaggaccttaccattttctaagtagattttatcctaaatttataattgcattggaaaagtgggctttttaaaaaaatttaaccaatgtcatatgacaccatcctcccctattcctcccaccctgagttaccagtttaatttgaaaactttgaatttcccacatatccaagtatgcaagattttgcattgtcctcacataaatgaacaaatcttcaaagcacgaaaagttgagtatttgttttatgtgctcttcatctaggtgcttgtagtaatgttggcacttacaggagaaattaagagatgaggcagagaggtgaagaaaggagtctttaaaataagtgattaaattttgggcatttatagtatgttgtgtgagtactttttgaaaatgactagttagtgggggaaagtaacatttctacctttaaaaagaatgttctttgaaatgagaagtagttttaaaagttacttaaataagaatggtaggttattttagttacaatctcacaaaaatgatgttgtagtatgtgacgtgaaatatagtaggttttgagagttttgactatgtacatgacgttgaatgtagtcaaaagttggcaatgtaatttttaaattgaattgtattatacattatttcacatttattattcagtttaattctaccttgtcctgaaaaagagttgaagagatacacagatgtgtttgtgtaatgcggaatgggtaaaaaggcaaatgaggtaggaaaataagtcaaagtaaagtatttgtatggatattaaataacttattttaattttgtagcccattttttttgttttgtttttgtgggtagtgaggtattaaagtaccaaaaagatctctatatgtaacccttacttcagattctgaggtaatttggagtgatagcatttttgcagccttttatttaaggagccaggaaagcagatttcatacttgcattttggtcacagaataaaagtgaaagttttattaaataataacaaggatagtttgggaagatgaggcatctagtgataagaattgagttaggattttgtgccgtacatgatttatgataaagcttttcttactatgatactaaaggctttgattgtaagttcaagtagttttcaatgcagaatccatcagtgtggaaccttatataatgattgttgagcacattttgacataatttaacatcatgttattgcttatttagaaaaaaatgcttaataccagtaatctttttatttcttctatcaagtatattttgtttctgagaggattaaaaataacacggtgcattgaagtgatatttcttggtggtttttaatttaagaaaatctgataaagtagtttataacttttctttcttctttttgtagagacaaggtcttgctttcttgcctaagctggtcttgaactcctgccctttaatgatcctcccatcttagcctcccaaagtgttgggattacaagcatgagccactgtgcacagctagatagctaagagaaatatggattaagttgagtattataagttatggttttcaaatatgatttaaaataaatattgttagactaacattaagggctaaagtgaaattaccaaagcacgtattaaagacaaatttggggcgatatcacatgttctcacatatgtgagagctaaaaaaatttgatcacatgagagtagagagtaaaaagataagagactgggaaaggtgagtgttggggagaatgaagagaagtgggttaaagggtacaaacatgcagacagacggaataaatttaatgttataattctcctggttgttcatgatataccatgtaccatttcatataattcatgtaatataccctcttattttataggcaaagcaacagcagcctaagtcttgctgggggataaaaatatttctgaataaataaagtgatacataaatcatataactttgattttaggctagggtcatgatcaaatacattgatttgttatttgtaaaattaaaattactgatttaataaatagtggtacctgtctttttctctgtctgtattagaacagcattagtaataggaagcaagcaggatagtcactaaaagcacatgcagtgtcagaaataagaagtgggatctcttttcaaggggaggagacagaagaaggcaggagaagtacagcaatccaggttaggttattgtggtaaacctgtctttctcagaagcttctgagcacaattctgaagaaggtaacataattataatgtgctcgtaaaataatggggcaaaaaaatattcttcaaagtagttaccttgaggaagttatacattagaaaatataattgctaaaatattttgaaattctttatgaaattggtttcagaaccttttaaaactgcaagatcatttttgtagccatagattaaaattataattaaaatttttaaattgtaaaagtaattatagaatatttagagaacatgaaaagtaacgcttttttcacatactaataaaaccattgttctttgcaaagttttttcatatggattctttagataaaacttattttaatctactcaggtgtagattttttggtgtttatccctcttgagttctttgagcttcatggatctgtagtttggtgtctgtcagttttggagaattaaccaccattattcacatatttcttctgtttcttttctcctgatattctcattatccatagttacaccttttgtaattgtccaacagttcttaaatattctgttactttttaaaaaaattctttttgcctttcagtttgggaagtttctatcaacgtatcttcaagttcactgattgttttctctgctgtgtctagtctgctgttgaatccgtcaaagcattcttcatttctgttactgatttttgttatttccatttcagtttgtcttagagtttccatgtctctgcctacagtgggcatcagtttttgaatgtcgtgtagttttttccattaaagcccttagcacattaattatagttactaaattctcacagtgatgattccaaaatctctgccatatatgagtctggttttgatgcccgcgttgtcttttcagactctgttttttgcctttagcatgccttgtaatttttttttttttttttgataagctggatgtgacataaggggtaaaaagaactgagataaacaggcctttagtgtggcctagaggcctatctggctaggagttaggctgtgtttactgtttgatgtagctttggtgtcagagattaaaatttcctctcgtgtaactgcttttgtctcctttgttgtctttgggtttccctaataactccttcataagtaggttccgaggcttgtagttatttaagctgtaagtccctgttattacacaggagccctattgatgtggtgtgtgtgtgtgtaaaagtgttctataatcttatgattagctcttagtgagcctgtgtctttggactgtgaccttcatgagtgctttttagctcctgcaacctttacctcccaatacttaagtgagaaagtaggaaggctgggaggcggctggagttttgtatttctcttcccacaagttggttagttggtggataacaaactggaatgtgaaacctcggatgaggggaggctactgtagtttcttttgaggacaggtctttgttattgagaacagagatcgctgggcaatttcagaatggttattttttctctcctattggaagctagagggaatttttctttgatcttcacttgtgaatctctgatggggcacctggaggtaaaactcaggaaagtttcctctgtctctcccccagccagactgcccatcccctgagcttttaattctcaagctagtccacgttgaacctccagcaatttacattacagtgttcctatggatactggctccagctgtttgtttctcttgctggggtttgtgatacccgtagctgtggttttctgtagtcacatctctctccagttttgggagcagcagtttgccctgaacctcaattctctattgggtctaagaagagttaactgattttcggccgggcacggtggctcacgccagtaatcccagcactttgggaggccgaggtgggcggatcaccaggtcaggagatccagaatatcctggctaacatggtgaaacactgtctctactaaaaatacaaaaaaattagctgggcgtggtggcgggcacctgtattcccagctacttgggagacagagccaggagaatggcgtgaacctgggaggcggagcttgcagtgagccgagatcctgccactgcattcctgcctgggcgacaaagccagactccatcccaaaaaaaaaaaaaaaaaaaaaaaaagagttactgattttcagtttgttcggctttctggttgtgaggatgggagtgatgacttccaagctctgtccacatcagaccagaaatccttaatgatatttccttttctgtacctttttgactgtttcgttctttagtctatctggaatttagctgtgtagggatgcagggaataggatatgtgtctagaccttctgattatgctactttgtctaatagttcttgtgttaggattatactattttaaatttttatagcattaaattctttagtatctggtagggctaatcttgctttactttcctatttattgttgcatatgaacctcagaattgttaagtcattaaaaaaaagaagtagaattataaatagaactgcttaaaattagtaatataattagaatgatagtgttatgatgtttggacttctctggaaatttatttctctttgttgactcagatcttcttttatgttttggaggttttgtaattttctttttctcctttttttttttttttttttttttttgagatagaggcttgctctgttgcccaggctagtgtgcagtggcacaatctcggctcactgcaaccactgtctccagggtgtaagtgattctcgtgtctcagcctcttgagtagctgagattccaggcgtgcaccaccactcccagcttattttttatatgtttagtagagatggggttttgccgtgttgaccaggctagtctcaaactcctggcctcaagtgatctgcgcacctcggcctcctaaagtgctggaattacaggcgtgagccaccacacatggcctcataattttctttgtctcatttacagaagtttcttgtgaggtgtattttctgcatttttaaagcctttttattttgaaataatctttaattcacatgaaagttgcgcagatagtacagaattcatgtgtatccttcacccagttttccccatcatgacagcttatgaaaccgtaatacaattatcaaacacaggaaatcgatggtggtatgatactattaattaaactatagaccttatttagattttaccagtttttacctgtactttttttgtcatatgtatagttttgctattattattgcaatggctttctactacatttctctctgtctctttgcctccttccctgccttctgaagagtaaaaatggtgttaattttcagaagctgctttgctaatagattttaaattctgagtttttagttgctttcattgaatgttttttaaatttttaaattatttttaaattttttctcttcttttcaaaggtactgatcattgaatttttagggatgtaattttctcatttgctaaaaatgttatttttgtttctataacatgtcattgcattggctaggctagatttccaaattatactttttgtgcctaatttttgtataatagtcctcgagtttccctttaagagaaaaattagctactgtgtacattattagttgatttctctaatatctgacattaaaattaatcattgatatgcaatgaatgctttaccaagtttcaggagttataatcatttcaaataaatcatgtaatttaacccttacaacctcctaagataggtgtcaatattattcctgtttacaggtgagtaaattcagttgggttaaatgatttatttgttcaaggtcacatagtttaggtaagaagctcaaacctgagttttaggtttcttactcattttgcatttaaccgttcttttatattctcttctattgcaatagaaaagatcaattgtaaactattcagatgaatttcattctacagcatacgtttattccatggaactggcattccagaatggagtgaattagggcatggtggctcaggcctgtaatcccagcactttgggaggctgaggtgggcggatcacgtgaggtcaggagcttgagaccagcctggccaacatggtgaaaccccgtctctactaaaaaaaaaaaaaaaaaaaaaattagccgggcatggtgttgcatgcctgtagtcccagctacttggtaggctgaggcaggacaatcgcttgaacccgggaggtggaggttgcagtaagctgagatcacgctactgcactccagcctgggcaacagagcaagactctgtctccaaaaaaaaacaaaaagaatggagtgaattaatttcataaagaaaattcaggttaaacactatttgcaaactgatattcccgaatttaaatagacttatcaaaattgtatgtttatattttaaaggatcaaaatactgagcctgcaccttcctccctccttccttccagaggtattaattaagtatagcccctattgagaacctaaatatgtcaaaatttacctaggtggatatggaattaagtgtgggaatacaaggaaattaatattttatatttaaatatgaaggacaatgtatagttagctttttgaagaacatcaaatattaacttttctatcatgcaagttgtatgcattctttcttatttgtgataactttaagatgatgtcaaagtttcactgtgacttaagagtgagtaaattataaaacagtagaatcatttatttgaaagaggccttggttttactcagcttccttcccattgtgggaatgccttcctctcctacattttttcagcatcttatttgggagaaaaggtttaattttttattcctagctgcagtctttaacagttttcttaaaatatttattcttttcagattgcctttccttctaccttatatatatataaaatccctttctaatctgagctaatcagtctttttttttcttttttttctggtagctatattgatttctttaggtacctttatcttctgcattggcattcgttggtaccttctcttccacctgtcctactcttatttcagtaatttagatgaggtaaaatttgtaaaaatcacacttgcgcttacagatcttaactatataataaaactttaaaaatgcattatatttttgtcattgccctttattacatgtgtactcagacaataatcattgtctgatatttaactagagcatgtgtttagcatgaatacctagcactgttctattactgtaacattcatattctgaaatcctctggaaggaaacagtaagattatatgttgatttcttcttatttaaggaaagattcattggttgaacatggttttatgttttgtgtttggagatggactgtatttagagacatctctttttcccccagaagttctgttttaaattaatgagaaattgggtgaacttattttcttgctgaggtacacagcttgaagttttggaagtaaagtatacatagtcttttctatatgggaatggtggaattttctagacttgattaaagtactgttgtttaattttttaatgagaaccttctttcccaatacttacaatgtcagtactttcaattaagttgctgtgaataattcctcctgcccattttttcttcagctttttaatttttccaagttgagttttgaatttttgatctcttttgacagcctttttttctttttggctaggactctctacataacttttttgatagttatggaaaacagtgggatagatgttcagatgttataacttctcttttttggctgggatggggtggatgagtaaaaagaaaaaatcaataagtcagtgaatgttggcaggtgttcagagattttttctgtgtgtcattcaccgtggcacagttaagtaactgcttatgattaagtttttcacagtctcagaaaataaggagtttcaaataataatgtgggtaactgattagtatccaactagtagtggtgttggatggattaattgattcttagagagtctaggaaatgtcagaacagtatacattcaaactgctattacgacaaagtaaaagttaccttgaaaaataagtaattcaactggtagaagaaactttaagggacagactagatttggttttctatatggtctttcattctgaatactaattagtacttgaacatatataaagctcaagtgttgttttttttagaaatacagttgtgaagtggttatgcaaataaattcaatttaaatttcttgtcatgtaaaatgtgtagaaggacttactgaggttactttcagtcttgtttttttctcagatagcgatgaaccattttcatcattattgtttggacttttattatatttaaggacaggagttaaatataagtcctgaagaaaaacaaatgtttcatatcacacttactttagagtaaagcttagttgtagctgtgtacaataatcagttgtaaaaaggtgtttccattcttccattgtccttttggcttatttctcttgtcttattcaatttgctgtggatttgtttttgtagtgggaaaattaatttgagctgaagtgtgtcaggattacttagcaaaaaattactgtttgttgtcccacaaaaaaagtagatactacttaaccttttttactccatgtcatggatgtacttatgttttcaccttgtggaatactgaatcaagtttacactcttaggatcttagaatagtggttttcgctcttggctacatgtaggaatcatgttggaagatttaaaaaatgctggtgcatgtgtcccacccttggaagattgattgattgccttagggtgtggcctgcgcctcagttcctatgtgcactaaggttaagagcctctagagactcatgcacaataacacgtgttaaaattggctcctaaaaattgtcatatagtcataagattaatatatcatgaatgtgtaaaatgatattcttgagtttgccatggtcttctaaaatgagcagtgttaataatactacacatattttgagaggagtttaccacatttggccaaaagaccaaaaagctcagcaattaactgcctaaagtaacaaagcaggtagagaaataatgttttcttagttagcctaataatgtatctttcaaggggatggataagattccagttaaactatttactgttagcaatatttttttgtaagctatttttgtaaatccacagtgtgccttctaggttttttttctcttactctcaaaactgaaataggcttggtacagtggctcatgcctataatgccagcattttgggaggccaaggtgggaggactgtgtgaggtcaggagttcaaaagttcaagaccagcctggacaacaaagtgagattccccgtctctacaaaaaattaaaaaattagccaggcatggtggtgtgtgcctatagacccagttactcaggagactgaggtgagaagataatttgagtccaggaggtaaagtctgcagtgagctatggtctcgccactgcattccagcctgggcaacagagcaagtccctattaaaaaagaaaaacagaaacctgaaacagatgatcaaagttgcatgtataaacgttattaaaaaagattcatcatttgaatatttagttactatttactaaagctgcatgtttaagagtttctttaggtgacttcacatatattattgtcatattcattaggctatggtaggaagtccagttagatttaaactgatacttgttctactcagaataatttatgtcacctgaagagaggctgatggctatattcttatttcagcatatttggatatgggaaaattaattaaactaaaattctcatatgactttggaaatgactattgaaaacacactggcgactgggcacagtggcttacacctgtaatcctagctagccctttgggaggctggggcagtaggattgcttaggcaaggagttcaagaccagcctgggcaacatagcaagaccccatctctacaaaatatacaaaaatttaccatgtgtggtggcatgtgcttgtggtcccagctacttgaggggctgaggtgtcaggatcacttgagcctgggaggtgcagtcgggtgagatggtgccactgcactccagcatgggtgacagaacaagaccctgtctcaaaaaaagaaaaaacacattgggaagtagaaaagctactcatgagccatctaagtgacatgtagtccaaacatctgtaatatgctgtagaactggaacaaaatgatattaaggataattttagaagcatcttcgtgaatagttactgatgtaggccagttcttggcaaaattatgtcattggtttgtatttggtccttgcctgttttctggagaccctcctactctgtccctagtgctgtgacactttccctttcattcttctctgaagtatctggatttgtcttcctataaattatataatattcctcattttttctcctcctttgaccaaaatcttttcttagccatggagtttttattcttggggaggggctgccaggttgagagacaaagcaattataccattttctccccaattatttacttaaccataaatctgtgtacctactacttggctttattaaatattaatgtacatctacatttataaaaaaaaaattacagccgggcaccgtggctcacacctgtaatcccagcactttgggaggctgaggcgggtggatcagttgaggtcaggagttgaagaccagcctggccaacatggtgaaaccctgtctctactgaaaatacaaaaaaattagccgggcattgtggcgggtgtctgtaatcccagctactcaggaggctaaggcaggagagtgggcttgaacccgggagacggaggttgcagtgagccgagattgcaccactgcactccagcctgggcaacagagcaagaatccatctcaaaaaaacaaaacaaaaaaactacagctatatcaaagcccctggtacctgctactgaacctgttttcctctgttctgctcacaggtaactgccaagtagagtttatctttttcagaaacattttcagaaaccaagtcaatcttttaagtaataaatcaaaatgagtgaaatttaggagggaaatgtttatgagcagaagcttaatactgtacttagaggttataaatagttgataaaaccagttctgcatctggattgttttcatccttctgtgtttgactattcagagctaattgtttaaagactttcctaataaaaatttgaaaatgcttgcaaacctaggctataaggagacacaaaggattaattctactttgttaaaatctactaatgtgtgttgaaatgtgattatggcttgtcgacaaggaaccattggatgaacagaattcagtgtttatagaactagattgttggcaggcacacttaactactgccagcatcactcaaaccagccaactctttcatctttagtaaatactttgtcaaataagttatcagtctctttaaaatttagataatgaatagaattcatttagatgttagttaacagtgcagttaaaataggctatcttagattatctttgttcttctgttctatttggtttagattaaaagtgctaaaggaatgctgaagagggtggaacaacagcataaacatttttgagagggtggaatagagaacataaacatttttggagttctaaatctaaataaaattatttcagaaataatgaaaatattttgtattatttctgaggaaaatcagctttttggggggtactttttctgcagcactgtttagctatttttggcaaatgaaaaaggtattggggtagagacagagatttcctatttgaagttgaggcaatgaataactcctttcccctactccaatctccttaagaagaaataagcttttcttcattgataaggtaaagttagttttatactgtttatttaaaacaccaccaccaccagcatctcaactcttcccccaaattagctttgtgtctgaactctactttagtcaatgattcctttatatttttatatctcttaggcttgaaaactaggagtcatccttgattttttttccccccttatctacaatcatcagactttctggctctgtctccttggggcttgctttaagctttacccttcataacaaacatgatatgttagtagtttctttcagctttaaaatattatgacctttaagatctaaaattaaatgttgaaatgtaaaatttaaaggcttattgaaagaatgttaataacttttaaaaaaagtattggtttaagattagattctcctaactaaaaggatcctaaaaattaagagtaagatatttagaactttgtactaagtgtaaagtcttagtattacaaataaatcattgggtatttattattatttaaatgtctgatactgagctttgcatcttattatggagaaaaactttggattccaattgaaacgagaagaaattattgttatatcttaaccagcgtctaggcaacttggacccttcagatactgacactgagagaacttaatcccaaaataaataaaaattttgaattaacattctttttagtccgggtgcagtgccccacgcctttaatcccagcactttggaggctgaggttgaggctggtggatcacttgagcctagaagtttgagaccagcctgggcaacatggcaaaacgttgtctctacaaaaagtacaaaaattagccaggtatggtggcaggcacctgtggttccagctatttgtgaagctgaagtgggaggatctgagccctgggagattgagagtacagtgagcactgattacaccactgcactccagcctaggcagaactagaccctatctcagaaaaaaaaaagaaaaaaaaaattctggccaggcagggtagctcacacctgtaatcccagcactttgggtggctgaggcaggtggattacctgagatcaggagtttgagaccagcctggccaacatggtgaaaccccatctctactaaaaatgcaaaaattagctgggcatggtggcgggtgcctgtaatctcagctacttgggaggctgaggcaggagaatcgcttgaacccaggaggtggaggtttgcagtgagccaagactgcgccattgcactctccctgggtaacgagtgaaactctgtctcaaaaaaaaaaaattcttttagaagtcaccttgaaacatttaatgttgtttatttccttcatggtgggtagggggtgataaattgcaaaaagagataatgtataggttggtcttatgcaaataccctaaaattaagaaaaaaattattcgatagtggaagttgtccaggagaattaataggaagcataaacagttttgaagacagggaacttctgagggtataacttttgaggtagagtgggtgataaatttgagtagataacttagaaaatgttaaatgccagaatgacataaacgttttttggcctagtgatttttaaaaattgacatgtttttcttttttatttttttgagacagtctcatactgttgcccaggctggagtgcagtggcgtgatcttgacttactgcaacctcccccttctgggttctaggagttctcatacctcagcctcccgagtagctggaattataggtgtgcaccaccatgcccggctcatttttgtatttttagtagagatggggtttcaccatgttgaccaggctggtctcgaactcctgacctcaagtgatccaccaccttggtctcccatagtgctgggattacaggcgtgagccactgtgccctgccaaaattgacatgcttttctgaatggtgtcttgctatttaggaaattttatttttaatggtaaaagcatatttgcttgaagaaaatgctgtggtgtgcctttttctctactaaactatccccgttcctaaatctgcatagaaccatgaaaaatattatttttaacttcctaggcctttttgcttatgttcattaagtcaactcaaattgtcatgaagcaactcctgggtatactagatactccgctgtttttaccccacttccattgtacgtttagcttcaaacataagattcattcctttggcctatttctaatttgcaacctgctgtattctactttctatgaaactagtgtgtattatctcttatatccctctaaattttcttgacggttaatagtatgtttccctttgatcaccaccagcaagcttcgggggtcagactgactctgaaagtagcagatatttgaagttctcttgaaggaacatgggattttattaaggattttaagaatggataggaatttgatgaggaaaattcatgcagagaggatggcatgatctaaggtgtgaaaatggagtgctcaacataagagatgtgatatggtagaaatatagaatattattgggatatagtaggggatatcattgggaagatggagaaaagatcatcgaaatgagtttctggtcgtttagtaatgtctgtcatttattgaatgcttactgcatatccaactgtgttaggctctttatgaaaaatctaatttaattatgacaacagttttgtgtggcagatattattctctgaagaaattgggatttagacagactaaataggttataagactcatggagctaataaattagatttgattccgcatctcttttaaaatatgctgccatcataagcctctttaattaatctgctttgcagtgatctctagattctattcaagaagaaatttgcgacaatcttgaacttgtacttatagactaggtgattactttaacagggaagaaccatgattatgaatatgccaggcatcggaagaacttcaaatataaatctactacaggaatatgaactgatggcctgaaaaagactgcatttattttggataacaaaataatttcttggccaggtgcagtggctcatgcctgtaatctcagcactttggaagggcgaggcaggtggatggattgagcccaggagtttgagaccaccctgggcagcatggcaaaacctggtctctataaaaataaaaataaaataacctttatccgaggctctttaaaacaaaattcaagtctccaaaacaaatactgaaagctgtatgttcaaagaggttttcatcgctctttctaagtcttaagtatttgacagtttaggtctgggcgaaataaacattgggttttactaataatatggttgcctattttggcaccttaaatttagaagttgatttttatgtgttaaaattttttttaatccaaacgtagcattgtttataccttaaaagaatgccagactgacgtatttttgttattattgtttagtttggtaggacaataatgttttccattgaactgcaacatttactgcaactggtagcatgtaaattaaagaattttagagttgaaaggatcttagtgattgtccagtgaagtcttcttgctgtacagataaggcaaatgaagcacttttgaattagatgaatgtggctccagttactcaattaatgctattctaggattagaactctttttaccaaactacactacttccagtgtttataagagggtatatgtagatcaccaccataacagtacatgattatgttactggttatgaggctggcttgcctgaagtaatggtcttagctgggtaagatatagatggtcgcataacagaatctcttaggattctttttacaaaatacatataccaacccctctttgaaatccgcttggctgaagagactgtcagtttaagagcatctttaatcagtaagcataggcccccctggcaacaaaaataggcaaaatattcttgtgctttggaaataggtgtctagaaaatatgtagcttagtaacctaattaatgcacatagcattgcagatgtgtaccataaagctatcctttccactgttcactaacaaaagacatttgactcagttaccatatatgttctgaaaaactattagtaaaaaacttagacttgtgagacctcttattttttcatattattatttttatggatgtacaaattctccttgtcaagaattgtgaagggtctgagattttattgcaggctaataaattagcctactacaggatagtaattatggataactgaaggtaaaaagacatgagtatcagcatgttttgcaccagtttcctgagctctagctaccatagaatgacatgaagtgggctggatgatatctgcacatgcatgggatgcagacaggaaccttaagttgagggagcccacatttttgctccagagggagacatactttctttatcttccaaggtttttgctaagtgaccacccttgaaaagatagtctgaagcaaagagcatgtttgcagcttgcaggacaggcagaaatgtgagagagcaatggagaattgtctcctaataggcattatattatattagaccaatgagaccattatttattctcaatgtaaatgaaatatgttcagaaattcttagtgtgttaggaatgtgacctctgtgcactttgtttttaattccagaaaaatatctgttgtttgcgtattacttgcccttgtttagtatagtaacatgaaagttaacttgctttagttttgatgaagggtgttctggttaattggattttatttttaaatatttaaattcctttatgccaaatggacataccctgttcctttgtcccttctcctttttttttttttttaaagtgaaaacatttatcctccatgttttaatttcagcaaatacttaacagtgtgcctatcataggccaaattctgaatgctagccaggtgtatagataagaaagattgtgcattcatttattcagagttattatatgctgggtgtgtttatatttatttaatcctctcaccaaatgtgtgccgtttgagggaaggagacacaaggtaggctaaatattagaatgatgttcctgggagagcaaatagtatgtgcaaagggtttggagaagatggtataggcagaaaagcacatcccaagaagaagagcaatatatatggaacattcagaagagagaaacaatgtaggttgtgagtacttcatgatactgatattaacctatttttaaaactgaacttccaaatttaaactgttggggttcttgcaaagtatactgtatcagggagtgaagtttggatttcatggatctctggttgtgcttaccatatatgaagctttccatgaagacttctcaaagctccagaaacaaaaaaaaaacaaaaaagacttctcaactcttctttgggagtgcagggggagaaacatctcactatatatcttttaggtttagaatgctacagtataagaagtatattttttgaggagactgcatatgagtttgctggggcttttttcattagttacgtttatttgtatagagactaggtcttgctatgttgctgaagcaggactgcagtggctgttcatgggcataatcatagtgtacagcaggctggaatttctgggctctagtaaacctcccacttcggcctgagtctagctgggcctacacgcctgtaccactgcgcctgccaagtttgctgtttaaagcatagcgttcattcatgtgtagttgttagtaatgaaattttcaaagtagatttatttaaccaggcctcttttacttaatgaccagaattgtggtttgtttttcacctgaaaaattgatcacttcttccagtcacaatatggtctatattcttaagctgtccagtgacattagaaattaatgtgccatttatttttaattagaatagtaaaggtgttgctacattcaaaaaatagtctaacaattagaagtttccattaactattggttccctctaacttaacggttttaggatctgttattaaaatttttagcacataaaaatgtagattacattaacattttaagtggcccttgtttttctaaatgtactttgttcaagagagctctgctataattaattacaagggtgatttcattatgaaaaatttcttaaaaaggtttgtttagagtcatagcaaggcttaaatgagagtctgtgtaaggtacctgttataaaatttggcctacagaaagttctcaaagtaatagttactacttcttttaccgtattattattttaaaaagctgattaagtttctgttacatgtatttgcatttaggtaggaaactttccttaaaaaatgataaaaaatttattttattttgtttatttattttaagatggagtcttgctctttcgctcaggccggagtgcaatgctgtgatctcagctcactacaacctctgcctcctgggttcaagtgattctctcacctcagcctcccgaatagatgggattacaggcacataccaccatgtccgtctaatttttgtatttttagtagaggcagggtttcgccatgttggccaggctggtctcaaactcctgacctcaagtgatctgccggccttggcgtcccaaagtgctgagattacaggtgtgagccaccatgctcacccaagaatcttcactttaaattttttatattttttggccatacatctctacagaaatagaggcttaagcaggagaatcacttgagcccaaaaggcagaggttgcagtgagctgagatagagccactgcactccaccctgggtgacagagcgagactgcatctcagaaaagagaaaaaaagattctctaagcttaccctgtccgatacagtagctactagctgtatgtggttgtttaaagtaaattaaaaattctgctctttggttctattaaccacgtttcaagtgctcaaatagccatgtgtggctagtggttcctgtcgatggtgcagaacattttcatctttccagaaacttacattggacactgttgttctaagctatgttttcagttttacccccaataattagactcctattatcataacattttaaatagaataccatataaaaaggtagtgagatgcagttgtgcttttcaggagatgcaaaatctacttcatttaacctccccatggccttcagaacacagggcttttaggaccctagttggccatttgttctttgttttaaacaactaataaatgtagaaggaattatagaaaatccataaatagaaaaagcactatagaaacatttgattaagataagatgctgaaaccatttggtgaaagattgttgggattggattcggagaaatctgaccagtttaacttaatgctctaacttaacatcaacattatgggacaaactgacgttacgtattccttgatatggtgcgctgagaagagtacaacttcacctgtttggtacttaatgccatttttttctttttgccagaacttgttgaagaaataataaggcagttctaaataggaaatcttcatgtcttggacccttcaaaaatgctagtagttggtatcatgaaagactagatagatacatgggtagatagataggtaggtaggtaggtaggtagatagacagacagacagacagaaagttaaaggcgagacatggaaattaactgtgttgtgcagtggatcctgcattgggtcttggactggaggacaaaacagatctaaaggacattattagggtgactggagaaattgtagaatggatttgaatggtgtaatatgaatattaaattttctgagtgataatttattctgattacataggaaaatactcttcttcttaatggggtacatgttgacatatttaggagtgaaatgtcatgatgctgcaagtaacattcaaattgttaaccaaagaaaaattgtgtctgtgcaagtatgtgtaaagagagaaaggaaatgtggcaaaatgttaacaattggtcagagactgaataatttagatgaagaaggaagaatgtacttcattgtatttttttacggccttttagtaggtttgaagttttcagcataaaaagtgggtaaaagaaatgacctctttatgctgtctgcttagcagacagttccaggaaaagcccctccctctttccggctacatgattgcaatagaatggatctgtcaagtttctacagtcctttccagagaaattgatgtggagctgaacctctgatagagtgttcagttggattagtaggaaagcaggcatttaaggcaaggaaacacataagtaatacatcttagtagtttgtaagtttcaatatttgtttcagccagaatttattagcagtacatgcttcagatttattctttccttttaatggcaaattgggaatgcatatgaaaaacatttacatatcagttctctaggagcactctccctcatcccccaccatgcatagtctcaatgtcttaaagctaggcaactgtaggtagactcaattggagactgcctgtttctgccttcttaacattctggtgaccacctggattcagatatttgttataaaaacaggcgtatctcagaaatattatgggttcaattccagagcaccgaaataaggcaaatagtgcaataaagcaagtgacacgaatattttgacttctcagtgcatgtaaaagttatgtttacactatgctgtagtctattaagtgtgcagtagcattatgtctaaagaaacaatgcacatatctaaattaaaatgtactttattgctaaaaaaaatgctaacaatcatctgagtctttagtgagttataaattttttgctgataggaggaccttgtgttgatttaaatgactgctgactaatcagagtggtggctggaggtgggggtgactgtggcaatttcttcaaataagacaacagtgaggtttagatttctctgtagcacggagtgctgtttgatagcattttacccacagtagaaattccttcaaaattggagtcaatctcaaaccctgatgctgctttatcaactatgtttatgggatattctatgtcctttgttgtcatttcagcatgttcacagcatcttcaccaggcatagatttcatctcaaaccattttctttgctcgtccctaagaagcaactcctcatttgttcaagttttgtcatgaaattgcaggaattcagtcacattttcagtccccgcttctaactctagttctgttgctaatcccagcacgtgtagtgacttcctccattggagtcttgaaccccacaaagtcattcatgagagttagaattcttccaaacttaatattgatattttgaaatccttccatgaatcatgaatgttctgaatggcatctagaatgatgaatcctttctagaacgttttcagtttactttgcccagatagaggaatcactgtccgtggcagctatagccttacaaaatgtttttcttaaataataaatactttttttgagatagaatctcgctgtgttgcccaggctggagtcctgtggtgtgatctcggctcactgcagcctttgcctcctgggctcaagtgattctcctgcctcagtctcctgagtagctgggattacaggcacgtaccaccacgcccggcaaatttttatgtttttagtagagatggggtttcaccatgttggccaggctggtcttgaactcctggtctcaagtgatctgcctgccctggtctcccaaactgctgggataacaggcatgagccagcatgcccagccaaataataaaacttgaaagtcaaaattactctctgatgcatgggttgcagaataaatgttgtgttagcagttatgaaaacaactttaatctcattgtattctccatcagagttattgggtaactaggtgtgttgtcaatgagcagtaacattttgagaggaatcttttttcctgagcaataggtctcaacagtgggcttaaaatattcagtaaaccgggtggtaaactgaggtgctatcagctagctagtctttgttgtcccatttatagatcacaggcagagtcgatttagcataattcttaaaggccctaggaattttcatatggtaaatgagcattggcttcaacttaaagtcactagctttctttagttcctggtagagtcagcttgttcttcgaaggcaggcattgacttctctatagctatgaaagtcctagatgccatcttcttccagtacaatgctgtttcatctacatggaaaatctatagtttattgtagccaccttcatcaggtatcctagctagacggggataacttcctacagcttctgcatctgcacttgttgctttaccttgcacttttatattatgaagatggcatgattctttaaacctgtactagcttcatactttacttctgcagcttcctcacttctctcagccttcttggaattgaagagagttaagcatttgctctggggtaggctttgacttaagggaatgttgtggccagtttgatctatcaaggtcacttaaactttctccatttcagcgataaggcagtttcgttttcttatcatggtgtgttcactggagtggcacttttaatttccttcaagaactcttcctttgcattctcaacttgactctttggcacaagagtcctagctttcagcctgtcttggctttcagcatgcctttgatttaaagtgagtgatgagggagtaatggctcatgcctgtaatcccagcactttgggaagccaaggcaggcagcggatcacttgaggtcaggagtttgtgaccagcctggccaacatggtgaaaccctgtctctactaaaaatacaaaaattagctgggcatggtggtgggtgcctgtaatccagctactcaggtggctgaggcaggagaatcgcttgaacctgggagatggaggttgcagtgagctgagattgcaccactgcactccatcctgggtgacagagtgagactcccgtctcaaaaaataaaaaaatttaaaaataaagtgaatgacatgggactcttcctttcacttgagcacttagaggccattataagggttattattaggcctaatttcaatattgttgtatacccaggaatagggaagcctgagcagaggggggaaaatggggaatggctggtctgcggaacagtcagaaaacacacaacttgtattaagttcactgttttatgtgggcatggtttgtgacgccccaaaacaattgcaatagtaataacaaacatcactgttttttttaaaaaaaaaaaaaaaaaaaaaaaaaaaaaggccgggcttggtggctcacgcctctaatcccagcactttgggaggtcgaggcgggcaggtcacgaggtcaggagtttgagaccagcctggccaacatggtaaaacccagtctctctaaaaatacaaaaatcagcctggcgtggtggcacacacctgtagtcctagctacttgggaggctgaggcaggagaatcacttgaacccgggaggcagaggttgcagtgagccaagatcgtgccattgcactccagcctgggtgacagagcaagactctgtctccaaaaaaaaaggcagtatctgtgaagtgcattgacgtgaagtgcaataaaatctgtctgtaatatttggtttaggttcttgaattaagatttatgataaaaaaagacgttgatttgagaataacttatccatgctcaatatgaacacattgtaataggcttaccaaattgtttaattatacattgttcaactaattataaatatcctgtataggatcagtaaccagtgtgaattttatttgaaccattaatgcctttcctctgggaaattgttgataatgattcattggttagaattggctaagtcaaagcaccagtctgttttgttccactttcttctcatgtatgttacagggcattttcaggtttcttctgaatctcagtggggaaaaataggatcagtataaaatatatattcaatgagaaaagagtcaagttttttagcatcaggacaaaatatatatcagaatagaaaggccagatgataggaacattagagtacatatgctatctcaagagtctgaaatccacttgagcccaggagtttgagaccagcctatgcaacatagtgagacatcatctctacaaaaaatagaaaaaattagccaggtgtggtggctcatccctgtagtcccagctactcaggaggctgaggtgggcgaatcacttgaactggggagatcgaggctgcagtgagccgtgatcgtgaggtgaaattttttatttatctagagtgaaatgtacaaatcttaagtgtacagcttgataaatttgagctatgaatttggttctgcatttctgtgtctaaagacaaaaataatttcttagaggagattaaacttttcttagtgcttatttctgaaataaaatttttgaatgagacctcaatatagggaatattgagtcatgtagtgtaggagtccccaaccctggggccactgactgggccgcacgtgaggtgcaggccagcattagcacctggcagtggcattagattctcatgggaacgtgaactctattgtgaattgcgcttgcgaggagggatctaggtggtgctccttaagaaaatctaatcccaggtggaacagtttttatcccgaaaccattcccgcccaccccctgtggaaaaattgtcttccacaaaacccgtccctcttgccaaaaaggtttttacagtataccaagtgaaatctcaggtcatgaagctgaggtgcaatttttaatgggagtgaagggtggggagctaaataaataatcttcatccaaaaataaaacctagagtatataaagaaattggacactttttggcttcttttggttttcttgtaattgaaataaaaacaaaaacaaaaaaatggccagtgcagtggcttacacctgtagtcccagcactttgggaggccaaggtgggcggattgcctgagtccaggagtttgggaccagcctaggcaacatagcaaaaccccctctctaccaaaaatacaataaattatacgtgcatgggtggtgcacgcctgtggccccagcaactcaggaagctgaggtgggaggatcactggagtcctggaggggtggaggttgaactgagctgtgatcctgccactgtactccagcctgggttgcagagtgagacctgtttcaaaaaagataaaataaaaaaaggagaaatagttgatctgcatattctgtaaataaaatagctaaatagctgtctcttcatacatatatgtgtgtatatatacataagtgaatatatgcacacatgtgtaatttctttgaacatatttgttaagaattaggcatggaaaggacttcagcaacaattttttggggttatttactggggtggatctgctgctttaaggaataagtaagcaagtgataatattgactccttttctgaaaattccagattaaaaaaagatttccttttgattccaagattgtcccacattcagaggaaagagtaatagagaacctgcaggcaaagccaggatttttctgaaggaacaattctgtgtttgattcagtgcctgaaaaggaatcagttaagtcctcaaagttctttaaaacagagcatggcctagatccttttagctggaaagatagcttaaaacaaatgtttccacttggtcactatggctgtagaaaaataacagtactgctcccatgaaaatctgattttcagcagtgtgaacctgcccagaaggaactgatggtgagaggtactttttttcttctataaattctttgtgatgcctaccctaaatcactttctgtgatctgacttttttggctctcctaccttgattttatgttattagaaaacctgtagcttagttaggggaggattgacttctttataggttgccaccaagaatacttttcaccagaaaaaatatattaccctatggtgctcgatgcatctctgttgtaacttaccctgcatttagagaggtttatacttctacatggttttctctttacactttgagtaacatgttcttgctagttgaatttaaggagttagtagcatatattcagtaattgcaaaacagaccttctttcctcacccctgaatctttggacagtaaaaatacattatataacattgaaatcattcacaatttagtggtttgaaattccagatggtaatgccatgaaaagacctgtcatattttgtaccttatattatgaagagggttatattaatcacaattagcaagtgagttgtgggcttcaagttgtcaagtgaatttttaggtaatgaacaagtttctagacatttatagtctaagtttcaggacatttatagtctaagtttcttgaataaattttgtcattttaaagagcaaggataaatgattgaaaaagaatttctgaatttaaatttttacatgaattatttaatttgacaatttaattcttacatgggtaagtaatgttaatcatcccattttacagaggaagaaacatgactctcataggacaaatggcccatcacatgtttagcaagtgatggaaaccagatttaaactccagcagtcttatgcttaaccactttgctgtgattctcaaaatgtgtagaataaacacaattgcaacatgtgatgtctcagctctctcctaagactgaattgctaaggtctctgctcttttattttacttctctttttacttcctaatccccagtttttgcttgttttaataataaaatctagaggaaatagaactgctacagttaaatatacttggattgaaagaccagatcttttatttattcatagctacatgacaagttacttcatttgagctcacttaaaaaaaaatgtaataatgtactaataagggagttaaaaacataatgttttgttgtgaatagtacacaggtataatttttaaagtattgaaatcattacctggaagatattagaggtttttttagattttttttttttttttttgagatggagtttcattctagtcatccaggctggagtgcaatggtgtgctctcagctcactgcaaactctgcctcccgggttcaacgtttctcctgcctagcctcctgagtagctgggattacaggcatgcatcaccacatccagctgatttttgtatttttagtaaagacggggtttcaccatgttggccaggctgttctcgaactcctgaccacggtgatccacccgcctcggcctcccaaagtgctgggattacaggcatgagccatcacacccagctaaggggtttatatataggtagctacagttgacccttcaacaatgagaggatcaggggcatcagcgcctctgctgcacagtgggaaatccacatgtaacttttgactttctaaaaaacttaactactgatagcctactgttgactggaagactcaccgataacattaacagccacttaacacaaattttgtgtgtatgttatgtgtattctgtactgtattgttacaataaagtagctagagaaaaggttattaagaaaatcacaaggaatagaaaatgtattcctgtttattaaatgggagtgaatcatcataaaggtcttcatccttgctgtgttcacattgaataggttgaggaggaagaggaggagttggtcttgctgtctcaggagtggcaaaggtggaagaaaattcttgtgtaagtggacctgtgcagttcaaacccatgttgttcaagggtcaactacagtgttattttgtaattaacattatgcatattattacctacatttctactttaaaagctaaatgttttattttaaaaaatctccctgattctactatgcatttaaggaagaaattataccagttctctacagtctcttccagaaaatagaaacagggggaatacttcttaactcagcattactcttaataccaaagagtacctaataccgaagaccatacaagaaaggaaaactaaactacagaccaaaatcttttgtgaatataaatgtaaaaatcctcaaccgaatattagcaaatcaaatccaaaaatgtataaaaagaattacatactatagctaagtgggatttattccaggtatgcaaggctggttcaacatgtggaaatcaattcatgtaatcgatcacatccacagtctaaataagaaaaatcatatggtcatatcagtagatgcagaaaaagcatttgataaaatccaacatccattcttgattaaaatctctcaggaaactaggaatgggggaaaattcctcaacttgataaagaaaatctacaaaaaacttacagctaacatcatatttactaatgagaacatagatccttttctattatgattagggaaaaggcaaatatgtcccctctcactactcttcagcatcatcctggaagtcctggttaatgcaataagacaggaaaagaaaataaaaggtataccgattgagaaggaagaaataaaacttaattcacaaatgacatgttggtatatgtagaaagtcccaacaaatcacaagtgctctggaactaataagtgattatagcaggttgggtgcagtggctcacgcctgtaatcccagcactttgggaggcagaggtgggcggattgcctgaggtcaggagtttaagaccagcctggctaacatggtgaaaccccgtctctactaaaaatacaaaaatcagctgggcgtggtggtgcacgtctgtagtcccagctactcgggaggctgaggcaggagaatcgcttgaacctgggaggtggatgttgcagagagctgagatcacgccactgctctccagcctgggtgacagagcaagactttgtctccaaaaaaaataaaagactatagcagtgttgcaataccatttatattagcacaaaaaaattaaagtccttagatataaatcttgcaacataagtacagtacaagatctatatgaggaaaatgacaaaaataaaaaatcgaagatctaaataaacagatattccatgttcatgcttaggcagactcaatattgttaagatgtcaagttcttcccaacgtgatctatagattcagtgtaatttaattcagaatcgcagcaggttattttgtggctatcagcaaagttattctaaagtttatattggtcagagacctagactaggcaacacaatattataggagaacaaagtcagactgacactattgtacttaaagacttatgaagccacagtaatcaagacattgtggtattgttgaaagaataaatagatcattgaagcaaaatagcgcataggtagaccacgaatatagtaaattgatccttgacaaaggagcagagacaaggaaaaacggtaattttttccacaagtggcactggaataacaggatatctcattcccctccacgccaccaaaaaaaaaaaaaaaaagaatcttgacacagactttatacttttcacaaaaactacctcagagtgaattgtagcctttaatgttaagcacaaaaatgtaaaactcctagaagataataaaggagaaaatctggtgaccttaggtttggtgataactttttagacaaaacaccaaaagcatactccatgaaagaaagacgttgttaagttggacttcgttaaaataaaatatgtacgttttgtgaaagttactgtttagggactaaagagataagtcacagactgggagaaaatctttggaaaatacatacctgaaaaagaactggcatccaaaaatattcagagaacccttataactcaataataaatgaacaacacaattaaatggacaaaaaaatctgaacctccttggagaagatatacagatggcaagcaagcatttcaaaagatgtttccacatatcattagagaacatgcaaatttaaaccacagtgagatactatacacctattagagtgatgaaaattccagacactgacaataccacatgctggtgagtatgtggagtaatgggaattctcattcattgctggtgggaatgcaaaataataaccttcaaaagacacttgggcagtttctttaaaagctaaacatattcttaccatatgatccagcagtcatgttccttggtgtttatccaaatgaactgaaaactttaagtccacataaaaatctgccgatacatgtttgtagcaactttatttgtaattgcccaaacttggaagcaaccaagatgtccttcagtaggttaatggataaacaaactgtggtacatccagacgatgcaatattatctagccataaaaagaaatgagttatcaggccatgaaaagacatgcacagagtctatttaataaaaaaaaaaaaatctacttggagattgaggttacagtgagctatgaccacaccactgtaccccagcctgggtgaacagagtgagactctgtccattaaaaaaaaaaattccttgaactatacaagcaataaaatgaactacagatgtgatgaatattacaaatacagtggtgagtacaagaaatcaagggaaaacatatactatgatgaaattttactatattgtttaatattgtttgaataagaatatattgttgataaaacaagaaaagctaagaaatgattaccggaaggatagtttttatctctgtggaagggagaatcaagaaggaacacttgagagatttctgagggtggtggaagagttttatttcccatcatcatggtggtgtgttatttaagtactcattttctaagtctttaaattgtacatatttttcttcaaatacattcttttaattgaggtgaaaatcacttcacagtcaaataatcattgtcaaatgtacttttctgtgttatttagtgtattcataatgtgcaaccaaaactaacagctctttctagtttcaaaattttttcatcacactccagaaacaccctatactccattaggtaatcattccctaacctccccctaagcaggtcccctcataacttttaatctgctttttctctatatggatgtgcctgtcctgaatgtatcataaaaaggaatcatacaatttgtgaccttttttgtgtggcttctttcgtttaacataatggtctcaagattcatccaagttatagtatatatatttgagttttttttatgactaatatttcattatatgtatgtaactgttcacccacttatcactgatggacatctggtttattttcatatttcgagtattgtaagtaatgctgccataaatgttctatacatctagtttaatgtattgcaatatatgtaagatacatattgtgaaaaaaataagaaggaaaaacatcttgttgggaccgtgtgcattaccaatagtggcatgttgctaaatattgacagacacaaagataaattaagcatgatccttaccctcaagggtatgtacggaattttgttgtggaattacaaaaacagtaatctaacattgcatattttagagcatcattgtagaattgaggctcccccttgaagtagttttaaggtaatacaaattgagataacacagataattataaaatatgaagtttgtacacggatgattaagatacttggatccttaagcatgatcatgattaagcataatccttaccctcaagggtatatatggaattttactgtggaattacaaaaacagtaacctaacattgcacattttagagcttcattgtagaatcgagcctccccttgaagtagttttaaggtaatacaaattgagataatgcagataattataaaatatgaagtttggacacatgattgggtaagatacgtggcttgcctggatgctgtgttcagctagacagctgtgatttacaggtgaattacaaaaaccaacaacaacaacaaaacaaaactacagctctgagattcctaatgatcattgaaaagagaggctagtctgtacaataagatttttttttcaaagtaaatataggttataggtagttgtagataagtttttggattggaacatacagttttatttttttcccaagcattctctaaaagatatgaagtcatatatccattgcctaaagtcagtaagttccataagtgaaaataattgatttcttcaattgataattgatttcttctcttccaaggtagtgattctcctctagtcttcaacccctagaaaaaggtggtagtatagaaagaggtggtattgctgtatttatttttggataagctaaaagcagggggctaattctctattagtagctaaaaacaaaaagtcctgagaaagttcgaattttttttcatatttttctgtcagaaggtacagaaaaattgtgtttattaaatctttttttttgtattttttttttttaattgatcattcttgggtgtttctcgcatagggggatttggcagggtcataggacaatagtggagggaaggtcagcagataaacaagtgaacaaaggtctctggttttcctaggcagaggatcctgcggcctaccgcagtgtttgtgtccgtgggtacttgagattagggagtggtgatgactcctaaggagcatgccgccttcaagcatctgtttaacaaagcacatcttgcactgcccttaatccatttaaccctgagtggacacagcacatgtttcagagagcaccgggttgtgggtaaggtcatagatcaacagcatcccaaggcagaatttttcttagtacagaacaaaatggagtctcctatgtctacttctttctacacagacacagcaataatctgatttctctatcttttccccacgtttcccccttttctattcaacaaaaccgccatcgtcatcatggcccgttctcagtgagctgttgggtacacctcccagacgggggtgacagccgggcagaggggcttctcacttcccagaaggggcggccaggcagaggcgcccccccccccacctcccggacggggcagctggccgggtgggggctggcccccacctccccccctggacggggcggctggccgggcgggggctgccccccacctcccgcccggacggggtggctggccgggcggggcggctggcctggcgggggctgccccccacctcccggacggggcggctgctgggcggagacgctcctcacttcccaaatgggtcggctgccgggcggaggggctcctcacttctcagacagggcggccgggcagagacgctcctcacctcccagacggggtcgcggccgggcagaggcgctcctcacatcccacacggggtggcggggcagaggcattccccacatctcagacgatgggcagccgggcagagacgctcctcacttcctagacgggatggcggccgggaagaggcgctcctcacttcccagacgatgggcggccaggcaaagacactcctcacttcccagacggggtggcggccaggcagaggctgcaatctcggcactttgggaggccaaggcaggcggctgggaggtggaggttgtagctagccgagatcacgccaccgcactccagcctgggcaacattgagcactgaatgaacgagactctgtctgcaatcccggcacctcgggaggccgaggctggcagatcactcacggttaggagctggagaccagcccggccaacacagcgaaaccccgtctccaccaaaaaaatacgaaaaccagtcaggcgtggcggcacgcgcctgcaatcgcaggcactgggcaggctgaggcaggagaatcaggcagggaggttgcagtgagccgagatggcagcagtacagtccagcttcggctcggcatcagagggagaccttggaaagagagggagaccgtggggagagggagagggagagctgtgtttattaaatcttaaagctaaatatctttaagaatattctttagtaattgcttcctttctacacacagacacacatgtatatttatttatcatgagtaagtgacaggtgattcagtgccaatctgagttcctaaaggttacacagttcaatttatttgtttttattgttttgtgattagcagcaataatgttagtaatagtagatacactctcttcatatgtgaagactgatgatgtcccgtgtgcttagagctatttttctagtagtcatggtagatttgcactagtttactcattctagatctcctttaaacattatacatttgtagtattactgataatgtgtgtaaatgactgatctgctagccaagattaggtgtgtctgggtcatattttaagtgatccccttaatttcagacttgtttcaaaaaggattttatgcatctttcagtaatagagtaagacaaagtaattagctaaggaaatcaggatgactggaaaatgagcacaattgagtggcattttgtgcctggtacttttctgaccatctactggctctctcttgttccttcaccttaccctgcttgggggcttatctctgcttggttccttaccattcattcattagttcccacttgaggcatggcatttatcccaaaattcttgaacctcggtgggcttttcccccctctgcacagctcctaagggactaaggtactagggcatcttattttttcttttgtggccttccagaatagttccttgctgccctcttctggctgagaccttagggtgttgttgagcaaattttggtttttaatcctttaaattccagcaatattttggataaaccagtggttctcaagcctggctgcgtattagaatcactctggggagttttaagaaaactaccactgtgtgggccccacttttggaggttctgatttaattggtcttggggtggaggtgggaggctggtttttttttaggggattaaaatctctagccagtgattaagatctaaccactaggataaatgacccttggaatcctgaagggcttgtgctacttagatatagtcctcacatttttagatatcataatggatttttaaaaaatagcattaaagttagaaatacaggagtatttctaccctctcaggaaaagaatagtttatacaaggaatgatatgaataagcaataggatctaaggtctttgtagtgtctactaataccagaagagattttgggaagatactttgtgttatcatttgcctgtttggttttctgtttctcaattttcatttcctctgtttctgttttaagggccaagccacaggcttctgcatgagtttggccattgacagatactagcggaagattggaggacaggtagaagggagaagccagggtattttttggttgtcatgtctggtaaaggctatttctctggtaggggcttcttgtcctttgtgactttagctcttatcagagagctcctccttccatggtccaaatgtgtgctggaaaatttcctgtattagtagctatgtcttctattaaatatatggagaggtttctgtttttttgattggactcctatttgatgtaccctgtaaatactacaatatgcttctctttcctctcttctgtgtttctacctttcctcctatctgttctttggtacttttcctactccggtgatagccacctgaattctgaacaatatttataacagttagggttagggggcattgctcttaaattggagtctctaattttatggaatgttctttctaagttttacttttttactttctgaaacttgtaaagcattcatacgatattatttcttagttggattagaaacgtgatgggaaataaaactttaatatgaacttgttgaatacagtttgttagtagatacaatttgtaatcatcctgttttgtttgtttgtttgaggtagaggtcttacagcccaggctgatcttgaactcttgggctcaaatgatcctaaccattgaaacctcttgagtagctggtagattaccagcacatgctaccatgcccaatttatcatctttttaataatgctttttgtttgttaattattttgttaagaatactgttgcagctactttgtttttaacattttgacccatgatacaaatctctcttactaaactttagtttgggtcatttaaaaaaataatagagtgcattccttttttttttttgaggcggaatttcgctcttgttgcccaggctggagtgcaatggtgcgatctcagctcactgcaacctctgcctcccaggtttaagcgattctcctgcatcagcctcctgagtagctgggattacaggcatatgccaccatgcccagccggttttgcatttttagtagagatggggtttctccatgttggtcaggctggtctcgaactcctgacctcaggtgatctgcccaccttggcctcccaaagtgctgggattacaggtgggattacagccaccatgcccggcttatttagtctttgaaggagtattaggatctttagtttctaaaagtggcgtattaactagctctttattatgtaaccatttgtactatatttcttattttttaatttttaaaaatttcaagagcttttggggtacaggtggtttttggttacatgggtggattatatcgtggtgaattctgagattttagtttgcctctcaccaaagtagtgtacattgtacccaatatgtagtcttttattccacattcccctccccttctccccctactgagtctccaaagtccattacatcaccctgattggttttgcatactcataatgtagctcctacttataagtgagaacatagggtatttggttgtccattcctgagttacttcacttagaataatggcttccagttccatccaagttgctgcagaagacattattctgttccattttatgtctgagtagcattccatggtgtatatataccacattttgtttatccactcattggtcattgggcacttaggttggttccatacctttgcagttgtgaattgtgctgcaacaaacatttatgtgcctgcgtctttttcatataatgacttcttttcctttaggtagatatccagtagtgggattgctggattgaatggtagacctacttttagttctttaaggaatctccgtactgttttccatagaggctgcactaattaacatctgcaccagcagggtgtaagtttctgttttcaccacatccatgccaacatgtattgttttatgactttttaatggccattccttcaggaataaggtgatatctcattgcggtgttaatttgcatttccctgatgattagtgatgttgagcagcgtttcatatgttttttggccatttgtatatcttcttttcaaaaatgtcgtttgcccacttattgatgggattatttgttttcttcttactgatttctttgagttccttggagattgtggatactagtactttgtcagatgcatagttggcaattattttctcccattctgtgggttgtctgtacattctgatgattatttgttttgctgatttgcactatatttcctttgatgtgggatttatttatttagatgtaggctttgcatgatatccaaagcatatatatgtatttggtaacacagtttttgaagtcttgagttttgtgtggttttggcttaggtaatctttggattacttatttctccaatccttttttttttgagcgaggtctcactctgttacccaggctagagtgcagtggcacagttgaaccctccaggctcaagtgattctcccacctcagcctcccgagtagctgggactacaggtgtatgccaccaggcccagctgtttttttgactttttgtagaaatgaggtctcactatattgcccaggctggtctcgggactcctggcctcaagcattcctcctacctccgccttcctaagtggtggattacaggcatgagccagcacacccagcctccagtcctcataagtggttcttctaactttctctattattgtagacggtttaaacgtctttactttaatcatttgtttaaaaaaaaaagcttcatgctgctagatttaagatgccaagaaatcatatttttgggaatttaactctgttaaaaatgaatgttgtaaactaattttattctctcatatttgtgtggagacataagatgaatcattagtaccattcagctgagtagtgtagaaaacggaattgtttttctttgctgaaagaattgaataaaaatattttcatgaagttattctttgtaccaattccatgtaagtaaggttgctacaaatatatgatttcttgacatatatgcatgtcaaagtatgtactaaatataaagtgttacttttcatacttaatactttatcttaatactttacctacagaggttttcatttaaaagcctgttcttaaaattacattaatctttcaggcttaaaattgcctttcaggtttaaaattttacttcttagttctaacctcagttataagtccctggttagggttcttctgaaacctcaatttggatttaaggatacattttctttctatgcccttttctttctgaagcacacatttttaacttgtttattgagcctttttctctacttgtgacttatggaagtagctttataaacgtgtgtgtgtgtgtgcgcacgtgcctgtgtggaattgcagcagaagtcattccttctcagctaatttcatgtaattcatttcagcgtgaaggttggaatgatctaatggttttctaagagctagactttcataataatgttacacattaaaacacataaacacagttgtatagatgttactgaaacttagaattatgatcatatgaagtagaagagttaattttacaaatttataaaaacaatttggagttggctttttacttctagctgtaacttgtttactgacaagactgagttatataaaatattttaattaagtataaaataatttaaatattttaattaagttatataaaatatcttaattaagagttggctttttacttttagcagtaacttgtttactgataagactgagttatataaaatattttaattaagagtatttagttggggccgggtgcggtggctcacgcctgtaatcccagcactttgggaggccgaggcaggtggttcacctgaagtcaggagttcgagaccagcctgaccaacgtggagaaacctcgtctctactaaatatacaaaattagccaggcgtggtggcacatgcctgtaatcccagctactcggggggctgaggcaggagaatcacttgaacctgggaggcagagatcgcggtgagtcaagatcgcgccattgcactccagcctgggcaacaagagtgaaactccatctcaaaaaaaaaaaaaaaatgagtatttagttaaagagacaactttaacattttataacagaatgattttattttgttttggttattcatcctaacaatgcacattttacaagtaataatgtattaatgcaaataaacatgattaaaatagtttcctctgtaagccataacagtgctgggaagaatccacaagaagtataggtcagttgtgaataaaaaaactgaatgaaaaatctgcttaatgaaatataaattaaaagattttaagcataattttaatttataattttttttttgagacagagtcttgctcagttgcccaggctggagtgcagtggcatgatctcagatcactgcagcctccacctcccgggttcaagtgattgttgtgcctcagcctcccaagttgctgggactacaggcgtgcaccaccatgcttggcaaatttttgttttgaaatggggtttcaccatgttggccaggctggtctcgaacacctgacctcaagtgatccaccctccttggcctcccaaagtgctgggattgcaggcatgagccactgtgccctgcctgtaatttttatttaatttttccggtgatggcatgagtgaatgtccacatttaaagttattttggttcacacatggcctttgtttattatttatgagaaaaaattatagaaataatttaagggtggtacagaaatgcaaatctagaggacttaaaatgtacatgaaaactccatttgatatgacaaataatttacaggtcaaatattttaatatttatatatataatagatgccagttagcacaattgacaagttctcttttacggaaaaggccccaaaatgtcttctactgatgccagatcagttgattatctagggatagatatctgaaataagctaggccaatttgattttctcactcaggaattactttattgactaattttattagttcattcagtcagcaagtatttattgaaggcctgttacatgtttggttgctagagatacaatgatggaaaattcagataaagtttctgctcaaacaaagaaattaaattggctagacatggaaatagtggcatccaagagggaaggtctatacattagtgctgttaaggcctatagaactcctctgattcctgtcattatttaaaaaacaaaacaaaacaaaacaaaacaaaaaaaaaccttggcggtttagttatttcttcagttctgtgagctacccaagcatccttccagtctttccaataaaacggaccacctccttcttactcttatttttaatttcttaaatttgttttaagccaaaaaaccctaaccaatatataaattggacctagggtggggttttattatgtactcagcttaggtcagatggttagatgtctagtcttatatctaacagattggctatgaagatgtggaatttgaataaaagtgatagcttctttacacgtccaatcttagagtagggaaatgagcatttcacagcagaaagttttgttctgaacaaaacagagtcccttgtagtgtatatctatcatatatactgcattatgtttggttaggacttgaaaattttatttcattgcatcatgtttttgatcaagaatttgtaggaattttgtgcaacaagaggttataatgttaatacgtattaatattctgaccgaggttgaagtcttcattcttgaaagaaaaaaaaaatgcaaaagtattctgatctcagaagatatgaaaactatcactcttcagaattactggctttgtgttttgaactagctctttcaatagtttaaccttcaactttttatacttgtcataacttgtttattaaatgaatcactatgtcaccacattctatactgatttacatagagaagatgttcagtaaaagttggcatgatttaaattttacaacaattaaccatagagtttcatcataagattggtttaagtgcattcattattgcagttgcaaggttatgagttgttaatgtttcagaaaaatttttaaggaccccttttaaaaaacgttttgtgtttacatatatacatacctccttcatcctaggtttcactttctctagtttcagttagccaaggtcaaccttggtctgaaaattgatgagtacagtataataaaatattttgagagggagagagagaacattcacatggcttgtattacaatgttattataatctatttaataattatttttttttaagagatggaggtctcattctatcgcccaggctggagtgcagtggtgtaatcatagctcactgtagccttgaactctagggctcaagccatcctcctggctcagccccaagtagctgggattacagccaagaaccaccacacctggctattttattattgttgctgttaatctcttattgtgcctaatttgtaaattaaacttaatcataggtatgtataggataaaacttagtacatatgtagtgttcaatattgtttgcagtttcaagcatccactgggggtcttggggcgcatcccctggggatagggtgctgggactactgtgttccttacacagtttcatctaatgttaacattttgcataaccatgggacagttattcaaactaggaggttgacatatatgttattaactgcaggccttatttgaattccacgtgtttttcttctaatgcctttcttctgatcaggatataatccaggattgcacattagatttagttgtctttattctgcagtctataatagttctgcagactttttgtcttctatggctacactttgagtttgtacaatgtgctctcatgattgggccagagttatgcatatttgacaacaatatcacagaaacaatatgtcttttgtcatggggttcacgatgtatgtcttctttactggtgatagcaaccttgatcacttgttaaggtggtttctgctgggtttctccactgtaaagctatctttccatttgcagttaatacatttcttgggagacactttgagactatgcagataaaatctaaggatctttctttgttcttaaattttttttttaatttgtgtaaatttatggtcttttttttttttaaatctaactaattaccaagatctatggatttatcattcaaaatcaatctttccttttttttggatcaagtttagatcagtttccttaaattcattttatcattcaatgatcaagtatgctaaaatgaaaaacgctagggatgcgaaaatgaacaagatgtaaatcttgtagtatcacctaatagtaggccttggcattagacagatctgatttcaaaccctaaattctaatcttggagtcctgtgaagttgtgcaagttgcttacctttgttgggcctcaaattacctcacagaattattagtaagggataaatatgaaattctagaaaggcaaaactagtctacaatgccagtacattgttgattgccttgggctaagagtgggaagttgacccaaagggagctgaggaaccttttgggatgaaggaaatatcttctatcttaatttttttcccaaaaccttatagtgtacatttgaagtgagtatattttattgtaggcaaattatattttaatgaaattgatttgaaaaccaaggtggttctccttgaacccagttttccatttaatgggataaaatatgatatgtagaattcataagtcttaaggttttagaaatcagtcgtctagctctcccttatccagaggagtcttgtgacaatttagcatttgcagagcaatttaagagtttaagtctatagttgtgacagagtaagaaatatatttttggtcctacccccagttcctgacacagagaacatgaaagcccttataatttcctgagttgtaggagtactgtcctatattctgttttaatatttggtcattgaccctggttcctgtctcagaactcctaaatccctttaaatttttggggtgatagtagagtcttttgttctaatggggtgacacttgggctcctgcatagcttcagaatgggggctggtcaccagaaagtccacaccataattagaaccttggaaatttcagccccactcccatcttctggaaaggggagagggactggagattgaattaataatcgattatacctacatgatgaatgctaaaaattattaaactgtgggatttggagagcttctaggttgcattgaaatgagtccagagaggccatgggagttctgtgcacctcctctaccttgccttacacatctcttccatttggctgtttctgagttgcattcattataataaactggtaaatgtaactaaagtgctttcctgagttttgtgaattgtcatagtaaattatcaaaccaaatggaggatgtcatggaaacctctgatttataaccaatccaaacagaagtttgtgaataacctgaggacccttacttggaactggcatctgaagtgggaacagtcttgtgggactgaacctttaagctgtgggttctgcactaactctgagcagaattgggttaaattgtaggacagtcagttggtgactgcagagaattggagcattgcttggtatggaaaacccacacattaagacccactggtgtttctgtgtgagtataggagaaaaacaatgttttcatttagtagtcatcgcattttggcatgtctttaggtctgagactctcaagttattctttttcttaagtagattccaaactcaggatctttctgatctcttttggtctctttagaatcttttaaattgattatctatggagtttgattacctagaggttcaaattgactgaagtcaacttcttgggactcctttgagtacagaattttattcttccctttgcaaccacagaactggctggattctggtgagctcctgaaagttattatttggtaatctgtagtttttaagatttgttcggttggcatacccttatgtatctacatgaaccttaaatttaatttattctcttccaaagtactcaaagactttggtagagaaaaaagttttatacgcatattttaaaatcatgttactttccatgtgatctaaaagtcattttctgtggaaaagagatcagtgttttaaaattatagctttttctttttttttttttaagcttttcctattttggtggtaggcaaaggaagaagtactgttgtaatttatagtgctcaaaatgctaattggctgcataaaaaaaggcaccttaatttttcttttctctgattgagataaaattatttggtagctcttagaaagaccaaaggctgaggggaggaagctgaaatgatgacatatagctatgtagctactaatatatgtaaatagaaattctgaatctgtagataatctaaatgagactgcttaaagggaatggcagagcttttgactcacatgtagttagtgtagttaataaaattttgttgatatcaagatggcattaaactgttggataaattctaaatatgtgttcaatttaaatctgaggtaatttttacagtttaaggcattgtttattttataccttttaccaaatgctatgatatgcttttaaatgtaactgatggcatttagtaaatctttatatgtatttaaaagcattatcaatggaaaagtttataaattttgttctctggttatacaactgtgagagcctattttaagggtgaagtacaggggctagtaactaaaaatcacgacctttctactggctatttctacaggctgtaaattttggccaaatactttggaggatttaaatagttctcatgagattcagctttacaaatccaaatttaaagtgccatggcaaatgtatctttggtattttttgtcctaattatctagcataaaaccaaagtgtacatttattaaatgcattatgattattagactgaattgctgcaatttacgtatctatagcagaaacatagtttggaataatagatttaaagtttctgtttctattcagtggcagatgttaacacattctaagttggaaaccctcatggtaatagattttgattgagaacttgtcagtcattgtagcagctgctttagaccacatttatatttaaataggagaaagtgatctgtttagaatttttaaagttgttgccatggcaaagtaacttgctatttcatctttttatctgccatcgaagtgatctgtctggctgcttattcccaggagtaggggggatgaactgttctgttggaaagcttatattaggacaatgctgaatgcttcctaatgggatataagttagaaagactaaagctttcagaaaccatggctttggttaggtataattagaattgatttttttctcaattaaaaacaggcaagataaagctaaaacattttttaagaagaaaaatatgagcttaatttaacaccacttttgacaaattcaatgaataacatattcaaattaaatgctatgaaaaagaatttctttgaatgagtctattatttctgtagcatgaaacactttgtaaatccatcttttctttataaaattgtatatatatatatatattttaaatgcccagtgtctcctgctgcccattttttttttacttgttctcttgaaaaccatggcagtgggctgggtgtgatggctcatacttgtaataccagcactatgggaggccaaggccagaggaccccttgaggccagaagttccagtccagcctgggcagcatagtgagactctgtctctaccagaaataaaaaatgtgccttgtagtcctagctacttgagaggctgaggtgggaggatctttgagcctggtttttcaaggatacatgagctatgttcacaccactgtgttccagcctgggcaacagagagaaaccttgtctcaaaaaacaaaacaacaacaacaacaaaaaccatggcatcataatctgatttggtataaatgattttgtgtttcatatttactttgattacattaaatttcttaaaaggaagaatattagtgcagttcttttcaggctaataattacctacatgatggatattaactccatactaaagcttaatttttttatttgtttatgtcatcagacaatgtatacactagtagtcaaagccacacaaattgagggtgattggcaagtggcaaattgtcatttgccaacaaagtcctcccgaataaaagaatttgactttcagaggcacgcacaagggagtgagaagatttgcaccagtagttgtatattgtaaggctgacatgtctttgattaacttgagatattttgtattatattggcttggcagctttaaggcatactgcatatttgtaatgtcatatgctaaaataatgtgactattgtgacatttactgagacaaaattatgatttcttggtcatctgagcatatggaagaccatctaataaaatatcaagtcttgtacttaaaaggaagatactcacttaatacctaagcagcttttcaaataggaaaggacttttaacctcaagcccaagagaaagcaaggcagtgtcaaatttatcaggtcttctttctattctactggctatttggtaatgcttttatggctaactacttgagagaaatgagtacattagctgaaggtaacacttattttgtttttcagagatgcagaaatataaagatacggagaacatgagaagttaaaaagcaactaaaggaaagtttgggtcattgattttgtggtttcagtacagtcatgtaccacataaggatgttttaatcaacaaacaactgcatatacaatggtggtcccataaaattatagtaaagctgaaaaattcctatctcctaatgacattatacctgtcataacttgtattgcaacacatgatcttttctatgcctagatacacaagtaccattgtgttacaattgcctaaatttagtacagtaacatgctgtataggtttgtagcctataagcaataggctatagcatctattaacaggtttgtgtaaatgcactctgatgttcgcacaatgatgaaatcactgaataaaggcggttttcagaacatctatctgtcattaggagatgcataactgtacacatataaaagctaataaaaatcttacagaaccctaaatatttgtaagttttaagtgaattttaagaatttatcatgtattatgcatgttttaatcacttaaatattgggcagtgtctcagagacaaattcagatatatctctgctaggtaagttttactcaaaaagggaatactcatgagaaatttttaaagaggcagttttctatttagtaagtctggaataccagttttgaaatccttaataaatgtcctttttcttgaatcctcatatccatatatggccacaaattagactctctgtatttgaatagactagcatctaaattatcagatgatactgtggttaaacatttagtaagtttgtggttgtataatttggcatgttgcagaagatctgaacattgagaatatatagttcataattacattccaactgaataattacatataataatagaaatggaattttaaaaattaagaatataatatattgatagtggtaaaatagatgcaggactgtatctcagtcccttttgtctaaaaggagaaatattttatttgaaaaatactgattcctgattcctaagggtttttacttgtgaatctttttttttttttttttttttgagacaggccctcactttgtcacccaggctggagtgcagtggcatgatcttggctcactgcagcctctaccaggactcaagcgatcctcccacctcagcaccccaagtagctgggattacaggcacgcgccaccacacctggttaatcttttttgtagagatggggttttgccatgttgcccaggctagtcttgaactcctgagcttaagcaatccgcctgcctcagccccctaaaatgctaggattataggcgtgagccactgccgctggctgtgaatctttattcttatttgcttttcaattatttttcattgtaataaaatatacgtaaaacttgtcatttaaaacaatttttaagcgtatatagttcattaacattacgttcatagagttgtgcaaccattatcactatctatttacagaactttatcatcatgtcaaactcaaactctgtacccattaaacaataactttccattttctccttcccccagcccctgggtaaccactgttctatctctgtatgtgaatttgactattccagatatctcatgtaaatagtcatatagcactggattttgtgttcgtattgttgtgtcttttttcactcaacataatgtcttcaatgtttattcatgttatatagcatgtgtggaatttcatttttaaggctgagtactattacattgaatgtatacacattttgttaatccattcatctattcacggacacttggattgcttctaccttttggctttttgtgactagtgctgccatgaacctgggtgtacaaatatctgtttgagtgcctgcctttacttcttttgactgtagacccagaagtggaattgctcagtcatacggtaattctatctttcactttttgaggaatcatcataccattttccatggcagctgcatagttttacatttccaccagtaatgcacaaggattccagttaattcacatccttgctaacacttgttattttctttctttttttagtagccatcctaaaggtcatgaagtatattcttatttgtttttacttctgcataagattaccctgtcttcactggatatgctatttcttctttggaaaatcttgctcaatataaaagacaaattacttagataaggtatggcgagaaaaagctcaatgtatttgttacattaaggaggaattatctctaaaaagagaattgctaaataagttcattcattcattcaaaaatgtgtattgaatgcctgctcactctatgttgggcaatgtgctaagcattgagtatacagtgataaatgagaaaatcatggcccctgctttgagggaacttgcattgtagtgggagagacatatgacaaattaatgaatacaaaattaaaatataactgtcatgaaatttatatgacattgtgccttcaaagacaatgtatacaatattcagtgaaaatagtaatattaaataaagaatatatattgcaagattgtatttataccaactataacctcatttttaaaaatgcttgtgaaagaaaacaatgtcaacaaaatgctaacaatggttctaggatgatccaattcattgattttttttttcttaactaaaatttcttcagtgtgcatatattgttaatttagaaattgcaaataattacataaacaataaattaataatttagggatgatgtttaatttgactttcctgttgccagtggtgaccaaaaagtgctaagtattattgaacattttatctaccttaattatgccaagtaaatccagggcttattgtgatttataccaagtaaatccaaggttttttatgattgaatgttaattttagctctaggaaggtagttcttatttttggtcagtttgcaatactattaggatatcggggacaaaatggaaagtatgattttaaaaactgctcagtatttattaacggaaaattgtcatttttataagaaagaaatagtggaaaattcactatagttctttctggctaaaaagtgtgtaatatatgagtatataaaatatgaattagtctgttttcacactgctataaaaaacacctgagactggataatttataaaagaaagaggtttaattgacatacagttccacatggctagggaggcctcaggaaacttacaatcatggtggaaggcgaaggggaggaaagcaaggtatggtcttacaaggcagcaggagaggggtggggaactaccactttttaaccatcagatcatgtgagaactcactatcacgagaacagcatgggggaacctgcctccatgattcaatcacctcccttgctccctcaacatgtggggattacaggtccctccctcaatacatgggaattacaatttgagatgagatttgggttgggatgcaaagccaaaccatattccaccccagacccctcccaaatctcatgtccttctcacatttcaaaacacaatcataccttcccaacagtaccccaaagtcttaactcattctaacattaacccaaaagtccaagtccaaagtctcatctgacacaagacaagtcccttctacctgtgagcctgtaaaatgacaaacaagttagttatttccaagatacagtgggggtacaggcattgggtaaatgttcccattgcaacttggagaaattggccaaaacaaaggggccataggctccatgcaagtcagaaacccggccaggcagtcattaaatcttaaagctccaaaatctcatttgattccatgtctcacatccaggacacactgatgcaagggataggctcccacggccttgggcactctgcccttgtggctctgcagggtatagcccttgtggctgctttcctgggctggcattgagtgcctgcagcgtttccaggtacccagtgcaagctattggtggacctacctttctggggtctggaggacggtggcccttttctcacagctcaactaggcagtgccccagtggggactctctgttggggctccaaccccacatttcctttccacaccgtcctagcagaggttctccatgagagctctgcccctgcagcacacttctgcctggccatccaagtgtttccatacatgctgtgaaatctaggcagaggttcccaaacatcagttcttgtcttctgtgcacccacaggcccaacaccacatggaagctgccagtgcttgggggcgtgcaccctctgaagcaacggcctaagctgtaccttggccccttttagccacagctggagctggagcagctggaatgcagggtgctctcctggggctgcacagagcagcagaggcccagctgatgataccactgttccttcttaggcctctgggcctatgatgggaggggctgccatgaagttctctgacatgctctagagacattttctccattgtcttggccattaaatttggctccttattacttacacacgtttctgcagctggcttgaattcctccccagaaaatgactttttcttttctaccacaagtcaggctgcagattttccaaacctttagactctgcttcccttttaaacaaaagttgcaatttcaatttctttgtgaacaatatgactgaacgctttcagaaaaagccatgtcaccccatttttgttttttttgagatggagtcttgctgtgtcgcccaggctggagtgcagtggcgccatctcagctcactgcaagctctgcctcccaggttcacgccattctcctgcctcagcctcccgagtagctgggactacaagcgcccaccaccacgcccggctaattttttgtatttttgttagagatgggatttcaccgtgttagccaggatggtctcaatctcctgacctcgtgatcctcccacctcggcctcccaaagtgctgggattacaggcttgagccactgcgcctggccgccatgtcacctcttgaatgctttgctgcttagaaatttattctgtcagataacctaaatcgtctctctcaagttcaaagttctgcagatctctagggcagaggaaaatgccaccagtctctttgctaaagcatagcaagagggacctttgcttcaatatccaataaattactcgtctgcatctgagaccacctcagcctggaccccattgtccatatcacaatcagccttttggtcacagccattcaacaagtctctaggaggttccaaactttccctctttctgtcttttcctgagccctccaaactgtcccggcctctgtctgttacccagttccaacatcacttccacattttcaggaagcaaaaatgatttcactttcacatgatctctatagcagtgccctactcctggtaacaattttctgtatcagtctgtttttacactgctgtaaagaatacctgagactgggtaatttataaaagaaagagggttaattgtctctcagttccacatggcgggggagatctcaggaaaattaaaatcatggcagaaggtgaagggaaaacaaggcatgtcttacatggtggtaggagagagagtgcaggggaaactgccactttttaactatcagatcttgcgagaactcactcactatcacgagaacagcatggggtaaaccacccttatgatccaatcacctccctccctcgacacatgggattacaatttgagatgagatttgggtggggacacaaagccaaaccatattaaaatagtactgaattttgaataactgtaattgtgaattgatgttaaaatctgattgaaagagtacatcttagcacaacaatacggtatattgcctagtaatagaataatgcttcaagaaggagctctggagaggggacggggtgcttatttaaaaaaaaaaaaaatttggcaaggcaaggcacggtggctcacgcctgtaatcccagccctttgggaggccgaggcgggtggatcacaaggtcaggagttcaagaccagctggccaaggtggtgaaactccgactctactaaaaatacaaaaattagctgggcgcggtggcgggcgcctctaatcccagctacttgggatgctgaggcaggagaattgcttgaacccaggaggcaaaggttgtggtgagctgagatcgcgccattgaactctagcctgggtgacagagcaaggctccatctcaaaaaaaaaaaaaatttcaacttagtaataaccatttattagatgcctgatatttatcatacattgcatgaggcattagcatgcagtatttctaaccttgtaaaagtaggtagtatagatgagaaaattgaagcccaggagagtcagttaatttttccaaagtcacaaattaatatgtatatttggagtgaaaaacagttattaagagagaagctgaaggtgatttccaataagccctagaaatggatgtttccgtaggattctgatgtctgattcagaattactagctacatagtaatctgacctgcccagtttacaagataactagcttggaattcatttggtttcctcgacgctttctagcaggaagcttttctcaagaagcaatccctgcattgaagtgagagaaaatggaggtcaggtgactaattagagtttggatgtataagaattcaataaaaggaaggaaaagtagatattatttaagatatgctgagcttaatcgtgttttcttatgggatttaagtagcttcttgtgatttaaatgtttaaaagaaatgtaaggctggatgcagtggttcgcgcctgtaatcccagcactttgggaggccagaggtgggcagatcacctgaggtcaggagttggagaccagcttggccaacacagtgaaaccccatctctactaataaaatactaaataaaaaactaaaatactaaaataaaaaattagctgggtgtggtggcatgcacctgtaatcccaggtactagggaggctgaggcgggagaacctgggaggcagaggttgcagtgagttcagatcacgccactgcactccagcctgggtgacaagaagaaatctccgtctcaaaaaaaaaaaaaaaaaagttatgccgtttcttacagataggagttgagtctaattgaatagaagaattattcattaaaaagtatcctgttagcatttataggaaattaaaaagatatatcagactcccatagtaccctaaacgtttatatccatttattctgttttggccaggcgcggtggctcatgcctgtaatcccaacactttgggaggctgaggtgggcggatcacgaggtcaggagatcgacaccatcctggctaacacggtgaaaccccgtctctactaaaaatacaaaaaattagctgggcgtggtggcaggcgcctgtagtcccagctactcgggaggctgaggcaggagaatggcgtgaacccaggaggtggagcttgcagtgagccgagatcgtgccactgcactccagcctgggagacagcgagacttgtatcaaaaaaaaaaaaaaaagtatatatatatatatacacacacacacacacatatatatacacatatatatacacatatatacacacatatatacacatatatacacacatatatacacatatatacacatatatacacatatatatacacatatatacacatatatatacacatatatatacatatatatacacacatatatatacacacacacacacatttctaacagaatcccaatttcaatcttggtatacatttaaaatagatttttggaatacatttgaggttaaatttccttaaaaaataacaacaacctatgttgtttgcttgaaaaatacctggcaggagcataaatggcaatcttactctccttagtttagagagatttcatctgtaagaaaaaattttcaaaggccaaaacttctaaaccttttatgatatttttactacatgcttgttcccccttactgtaccttaattcatggtacttaaaattttaatctacagcaaccagccaaagaaaccaacaatttctgttcaactagaaggtaggaattgacacctgtgtttttgttttttgaaaaaacacaaattattcttcttttataaaatcacctaaattgtgtgagctttgcttgacatgttaatgtgatcattacctgttagtaatacactaatgagcttggcctctttttttttttttttttaatctcccacattttccagaacagccccaatttgttacaatcaggattattttatctgctgtatttgctaagtattattttactctccttcttaatttattttattaaaagtgattttcttaagtatgtgatttaaggtttatcagtgggttttattttcaagtaacttcttatataaatatttatctatgtaaatttataacagaaaaggccttttctggactgtgttttgttacagttttcttagttatactttgtcagcttcagggctgcattaagttccactaggttggtatcttattgcttgaaaattgttctatcgaaacgtgctattaaccagccagtcttccgattctctcacttgtagtaggcagaataatccgcctccctgcaagatgtctgtgtcctaatacctggaatttgtggatatattaatttacgtgccaaaggagaattaaaataacaaatgacattaaggttgttaattaggtatctttaaaataagattattttggattatctacattgcccagtggtaatcactagcatccttaaattgtggaagagggacccaaaagtgctatttgagaaagactttattagccattgctggtgttgaggatggaggagtgggaagcatgaacaaaggaattagggcaacatttaaaagctggttaaggcaagaaaatggattctccctctagagattccagaatgaaacagccctgctgacatcttgatttttgcctagtgggactcgttttagttttctcatccccagaacagtaacataataaatttgttttcctttaagccaccaaattatggtaatttgttatgacagtcatagaaaaataataacaccacctaactgtcatgacctttgcattttgtcactcaccataggcctgggtagatactccctgttctgcctgggactgcttttttccctccctgatttcagagctactgttacacgctttccaccactattaaggttgtgatagccaggtttttttttttttttttttgagatagagtctcactctattgcccaggctggagtgcagtggcatgatcttgactcactgcaacctccacctcccaggttaaagtgattctcctgcctcagccctccaagtagctggaattacaggtgcccactgcctgccgccacgccgggctaatttttgtattttagtagagacagggttttaccatgtcatccaggctggtctcgaactcccgacttcgtgatccgtatgcctcggccccccaaagtgctgggattacaggtgtgagccaccatgcctggcccaactagggttcttatttgcaggcaaaagaatttactgtagctagtttcagcaagattttaaagcatagagaattgttaggagggctaaaggagcaggttgagcttccaggaaaggttctcaaaaccatactgcagaatcagcctaaggaggtgataataatgctttgttctgaaagccacagagtcaggtagctcctaccccaggttccagatcattttggagatctggctgcagattatcttgcctcttccttgacctaaatcttcagtggtccacactgcaatagactgtctgactctgccattacctttctgatcttatctcctgttagtctgtctctattcactttgttctaggaacatcattgtcttgctgtttacaagtcaaatggccctgtagcaggaacatgcctgtaattcatgacacttaaaattttaatctacagcaaccattcaaagaaaccaaccatttctattcaactagaaggtaagaactgacaccagatattgtaagaaattggggctgttttggaaaatcttccctttttaccttttttgtctgtggccactgaatcaccattcattttttcaattacaattcatatgtccaggatgagagagactcctcgtccatgctgatccaaataaaggttgctggtctctctcacctcagctccatttgcagtggggatgaagatctgtgggaaaatgaaagggttttctttttcagttacatcaagaagatggaaagtaagtttttttaaaaatagccttttctaaactttctgatgactgatggagccatcatttgctcaaacaaggaaagatgtagcaaagggaagacttgttatgtaaatttaagccaccactgagcccagaacacccagaactttggaaattggctattgccatgtctggactgcgagtatgggaaggggacactgttctgtctgttgtccccgctaccgtccctctctctcagtatcaacgtagatccagacattctgctttgcttacctccaacctgactgttcccatacagagttgtgttaagcctccttacatgctgttagtgggaaataccaaaattttgacaaactgtccagtgcattaattgtcatttatacacttgtattaactctcattttgactccacaaaaagtgtaatgttggttcgagctcgagaaggaatctggattctggtagctttgcccagaccttgggaatcctcctcctcaatacatttaattaatgaaatgttacagcgaattctaaaaagagctaagagatttgttttcactttaatcgctgtgatcattggcctaattacagtcactgcactggccactactgccggaatggcgttacatcaatctattcaaacgggtcattttgttaatgattggcaagccaattccacccaaatgtggaattctcaacaaggcattgatcaaaaattggctaatcaaattaatgatttaagacagtctgttatttggcttggagattgggtagtgagtctcgaacattacatgcaaatgcagtgcgattggaatacttcggatttctgtatcaccccgtattcctataacgagactgatcattcatgggaaacggtcaaagacaccttctgggcatgtgatcttaatggtaagagtttcactactcagtcctccctttctttctggtgcggaggcagacacccttaaaaatggagatttcctttatagatgtagatttcttttataaacatgtttcaaaatagccagctaaaagacagaaaggtgtattttagagaccaatttagttcagtagacagtctttataacttagctatggttttttaactaaaatgactgagcttagggctaagcccattaactaatagggcaaagaaagtattctctctacctggactccacaaggatagctcttataaagaagcaagcctattttacctgagggcttaccttctattagcaaacactttatccacctttattttcacattcaggacagtatagtaatttagccaaaagatttgcagattcaatttttttaaatcaactagttccttaagctttttatttgctttttataaagaggctttcaaaagaagcaataaaaatattgcaacatttttagaagcttctgcacatcaataggcatccttgggtcagccaaattcaggagaacttatttatttattattatactttaagttctgggatacatgtgcagaacatacaggttcgttacataggtatacacgtgccatggtggtttgcagcacccatcaacctgtcatctacattaggtatttctcctaatgctatcccttgcctagccccctagcccccagcaggccccagtgtgtgatattcccctccctgtgtccatgtgttctcattgttcagcttccacctatgagtgagaacatgtgatgtttggttttctgtttttgtgttagtttgctgagaatgatggtttccagcttcatccatgtccctgcaaaggacgtgaactcatcctttttatggctgcataatattccatggtgtatgtgccacattttctttatctagtctgtcgttgatgggcatttgggtgggttccaagtctttgctattgtgaacagtgccgcagtaaacatgtgtgtgcatgtgtctttatagtagaatgaattataatcctttgagtatatacccagtaatgggattgctgggtcaaatgatatttctggttctagatccttcaggaattgccacactgtcttccacaatggttgaactaatttacactcccataaacagtgtaaaagcattcggagaacttatttttaaatgcagttcttaaaatgcaatgttgtttatttggaacattccacagtaatttaagattgttgtttgtatgactttgccattttttgtgaacatttgctgcttctggggcctaaacgttctatgtgtaaatgtagatgtagctagaaggtagagtactcagttcttcagaaattaagcatcacatttttacgttgaatcttggttttgcctctcagatttctttgatcagcttagccagtgatttttcctacctaagcatgcaagaaaaaggatcaaaggggatagaataaataaatccctgtgaattttcaaaagctagagtttgtaacccctgtagtattgccatttatcgccagtttttgtttgacccagtcagatatttaaggcctctagccagattcaatccagataattattggatcctgtccagtttctttttttttgaaacggagttttgctcttgttgccaaggctagagtgcaatggcatgatcttggttcatcgcaacctccacctcccaggttcaagcgattctcctgcctcacctcccgagtaactgggattacaggcatatgccaccatgcctggctaattttatatatatatatatatatatatatttttttttttttttttttttttagtagagatggggtttctccatgttggtcaggctgatctcaaactcctgacctcaggggatccgcctgcctgggcctcccaaagtgctgggattataggcctgagtgcccagctggaccctgtccagtttctgttgtgacttctgaaccaagttcagataaaaaatttactcaaacctgtatagctcaaaaccgcaaaatcttggattctgaagctccactgagagaacttacccacagtctctggttgttgtgagagaggaatggacagaatgggcccagtgggtatttctcttggtcactggctgctcttggggcttgctagatgctccacttcatgtcccactctgatgccatctgttacaaaaaaagactttagacgaatttaacagagtttaattgagcaaggaatgatttgcaaatctggtagcccccctgaacatgaaacatgataggttcagggtgactctagggttcccacatggtcagataatatttaaggacagaaaaaggaaaatgcgtacagaaaacagaagtgaggtacagaaagtgctgtattggttacaggttggtgtttgccttatgtgaacagggattgaataggtagcctcctgtgattggccaagccttgtaattggtacaatagtaggttataatgtatttacacatctacttaggttatagttcactatatccagaaacctttaggctgaacctaaaataggtgaggaggcagcttcaggctatgcttaatttaacaacataaagagcttatatttgagttaaacatactaagcttatatctcaagtatgccacttcctttggtaagaagcttaaactttccaaggctctgttttctcatctgcaaaatggagataagacttgtacctcacagagttgctgtgtggattaagtgagaaaatgtatgcttagtgtagtttggctctttactactcacattaacatattaatagaagaggataaagtatgtacaaaatgctctttctaagaaagaagacacattttagtaatcagaatggcttaaatatactttaagccaagggtccccaaccccagcgccacggactggtactggtttgtggtctgttaggaaccgggctgcacagcaggaggtgagtggcattatcgcctgagctctgcctcccgtcagatcagtggcagcactagattctcacaggagctgttaaccctattgtgaactgcgcatctaagggatctaggttccactctttaagaaaatctaatctgaggtagaacagtttcatcccaaaaccactcctcccactccccattccaccactacccccacccccaaattcccccactcctccacccctgttctgtgaaaaaattgtcttcctcaaaactggtcctgctgatttaagccttaaaaagagtaggttttaacattctcatcttgaataactcatgcgctgaaaatttgggttacttggagtttgtaacactttaattttctctttcttttttttttttgtgtgtgtgagatggagtttcgctcttgctgcccaggcctggagtgcaatggcatgatctcggctcaccgcagcctccacctcccgggtccaagagattctcctgcctcagcctcccgagtagctgggattacaggcatgcgccaccacgcctggctaattttgtattttagagacggggtttctccatgttgatcaggctggtctctaactcctgacctctggtgatctgcacgcctcggcctcccaaattgctgggattacaggcatgagccaccgcacctggcaaattttttgtttcttttatgcaccgtataggggaagaaaaatatctttttcttttaccagtcttggattcattggctggggccctttacaagacagatgcacaagacaaaaccgtacaaatttagttaacgtaagttttatttgacacaggagccttcataaggaaatgaagacctgaagtagctgaacctgagtgtttttattctagttttgatgaaggggaagattgtagaagaatttaataagataaaaagtatgagctaactgtaataaactgggggaaacttagcaaggcctgtttgttcacattcttcttggcgtctgtgtctatgttcctttcctcccagtgtggggagggtacctctcacagaagagtcttatgactggcatcaggggaaggtcaccaagtctttcctgtacatgctgtttatcaaattcattcatctcgaagtattcagtatgccaggtactgtattttggggtagcatgtcctaaaccctcatcaactgactttcatttcaaaagcttttaaatcccctgtgataaaaggtacagtttgtaatgtatgcaaccatacttagaaatctaaaaactgataataggatttggcaggggggtaccccatattgattacatatgtttatctagtgctttgatcaaaattgtttccctttgaaaaatacagcagtgttgactttggtggggcggtgggcggggggttgttcctgcttacatgtctgctgaagcatagtattttaaggttttgttttctttatttatagataatttaaaagctgactagttaccctctccttagaggctttgtaagtgcattcttatcagtaagatacatgtttactatatgactcagctagattctatatagatagtgtccttgtatcattaccagtaccatataaaaatactatatggatatatagggttgaaaacataatttattttctttccatttttagatttttagttgagacattctcttgaaaacaaaagtcagattaacaaaagaaaaagaagtttattaaagtgtgctgtacctatcacttgggagaggcctcagttcaaaagtgtatctctttcaaggcagtggcatgggggacttgcttaaatagtatcttaacaaaaagccagaaattctatatagtgacaagacaaaaaagatttatcttcaggcttccaaaaggtggggtaatatgggaacacatatttactactgctgtctctgagctgataagcagtgttgcaaaaggggcctagctttaggtgagaaaggcagcgagaaggggtgggcaaagtgtgcccgttttgttaagcttttaacttaaactaaaatccccagtattttagagaggaaaattttgttttcctccagatacttaacagtttataaatctagtgttctaagaagtatgttaaaaaaaacaccttattcctgcttccatgtgaattatattacctatgaagcatcattgtacatttatgtaaattcacatttgctaaatcacactgagggaaagcttaatataatcatttcatcattatataatccattcagtatgattgcatttcctcctgatgcaatttgataaacttgtgtttgtatagctgcaagataatgttccacagataatgcagttttatacattttattttcaatgctttttagtgggtgtatgtgtatgctatgtagagaaattagatgaagtttctcttaacttcattatgggcaacaaaattccttggctttgttacagtttactaggccccatagtgaaaacacctctgagtgtaggccaattctagaatacaaaattacttgtgatcagagctgtaatatgagattgaaatttgttacacaaagaggttactatcctttttttgaggataattaaacaatttgtttctttaaaacaaattaatagtgattgtttcaggatagtataaagtacaatttaatctttaacagtgagagaggctttgtagtggggtctcagtggttaagtccaattctgggacaagtaaaaatgttttagggtcttattacagaatgaaaactatattgtttcttaaggaatttaatgaactaaaaaacatttttgcttaacactcttgatttgtagtacatcgaccaagtatcttcatttaacagaaagtacatacttttgttaaataatgaagttttctggaaatctgttaactaagggtacttagagtaggaatgtgaatatttcaaatttcaaatcatccttttcttatgacaaaactctttttgtggcattacactgctttagaataaagttcattaatgcttgcttaaaaaaacataaggggtactgtatgtgtcaaaaataaaaagttggaacttcataaaattataggatttttttcttcctttcccacctctactgttttgtcattgctctttgagatgaaagagtctaaacctgtatgtttatttaactgttggatttcttgtttctcaattaggaaatgaaagcaaaaatctacacttgattttataattgacctatttgttttcaaaagtatgcacataaatgtcaaaatttaagtctaatgtaagctatttaccctaagcattaacatatctgtgtaaaaatggttacccatattgcatgtttaattaccttggtgtttaagagctctgatgaatattaataatttaccaggatttgatctggaattattttcactctgtgatattagaaaactcttaaaaacaccaacattatgttttatttctgtcactacatagcaattcctgggcaacatagaggtgacatgaagagtaagagagaaaggggattagatgtcgacacttgggattgagctgttagaaatagtatgtttgtctaaagagaggaaatgaaattttttttcttttttctatgcataagaaatgaaattttgtggggtaggtgaggagatctctggtttgtgatcttctttattgacttaatgcattctttcaatatctataggaagttatgtcagtaactggtagataaattctggcattacataccaaacaggagagacaagcttctgccttcattggagcttatattctctttagggatagcaaaaaaaaataagtaaataagacaatttcattgactagtaagtgctatgccagaaataacagagggtagagtgataaagaatgattggtggagtgattttagattcagtgctctggtaaggtctctgaaaaggtgataattaagatgatgagaaagcaccaagtggtggctggtttcttaaaatgaggtattaaattacctagatcaacatattggataaaatatataatatttaaatgctttaaactcttaagctctaaaaagatagccatttttttaatgatagcctgtaactaggtagggacagtagataaggatggtttaatgctgtgcagaaaaggaaaacgaaatggaaagagatttttaaaagaagtaccaaaggccaggtacagtggctcatgcctgtaatcccagcactttgggaggccgaggcgggcggatcacttgagattgggagttcgagaccagcctgatcaacatggaaaaaccccgtctctactaaaaatacaaaattagctggtcatggtggcacatcccggtaatcccagctactcgggaggctgaggcaggagaatcgcttgaacccgggaggcagaggttgtggtgaattgagatcgtgccattgcactccagcctgggcaacaagagtgaaactctgtctcaaaaaaaaaaaaaaaaaaaaagtaacagaagtatggccatagactgcctttcataagtatttgtgttgcaggtacatgtagcccatcttggctggagatggtccagtctcatactgtcccccaaagcaaatgtaagcctctacagatgagacatattatcctagacctcagtgaacccctacaattacattttccagcaagtagtcaaagataacaaagcatatggagaaacagacaactgaaggagaaccagcaaaaagagacagcagaattggaattccatagacttgggatattaaaaatattagacacatatttaaaataactatgcttatgaattataatacatatgaagatatctccaaggaaatcacaaaaagcagcatagcagatttgaaaaggaaccagacaaaacttttggaaatgaaaatcccagtaactgaaatttaataagcctggttttgtgttgagtactttgtatcaaatgaattctcctactgaaaccttataaacgttaggccatatatatatatacaacagctatttgaaagccttggagagcagccggtgtaggttcgacttgagggtctgtgattcttgagaaaagagaagctcatgaagtgatctccatatttattctggtcttttccttgagggaattttctaattctcagtgccagatggagatcaagcaaaaagaaggagttttacatggctaaggagcccagagaggctggtaacggaggcctaatcgtgggggttgggggtgagaggagaactgcagagaactgaatattctgcacataatatctgcatataagttctccttcaagtatggtagtttaatcactacccaggcccagggcaggatttctggaaacccatctgataacagtgactttgaggcttaagagctgagcagaaatttcagcaactttgaaatacagattgagttcgaatgcataagataactagtaattggtacactgaagccattatctaaaaagtatatcctttatgatatattcacctgtgtaaattgtgttcttaaaagctaaagatgagagaatttgtttaaagaaatacagtaataggctaagttctgtgatctttatcttatatggaggagtaaggctgtgtcccaaatgcaaatacagcttcaggtatttgagattaaattaagaaaatacagtagtcccctccttatccatggggaatatgttctaagaccccccagtagatgcctgaaaccacagctagtactgaactctatgtgcagtgtcagttaatctgataaaagtgactgtgtgggtggggagggaagggtagcacatacagcatgaatgcactggcaaaggaacaataatgtcctgagtgggacagggtggtgtacgatttcatcacactactcaaaatagtgtgcaatttaaaacttttgaattctttatttctggaatttttcacttaatattttcagactgtggttgactgtgaataattaaaaccatgggtcgtgaaactgcagatgaaggaggcctactgtattacacctttgatcataattgtccactatctgaatgaagcaatatatgattcttactaacttttcacttgctgtaccagattgctacagaaggtaagacctacttagaggtcaaggatatccttgtgttggtccatacataattctttaagtcatctttgtttttatcttgctaagggtttccaatatatctttgttcttatatataaacagcttttaaatgcttaggaaaatttgatgtaagtactaaaatgtcctcaggattgaccagtacatttaatgcatgaccaaatacattcaacatccacaggaacatacagcattcaggagcttgttttttataggtcattgaattttctacagagctactgctgagaattattttttaaagtaatatgcttgtctcaaatatgcttgtctaagtcaataagtccatttcactagaaagtttccaggcagtaaataaagcaatacactgagcgaatttttattgtctcgagtgacataatgtctctagttttcttacagttcacagtggttttactacagaagcacaacagtcattcctgttctcttagtggaattattcatggcttttaataaggtagattttattatgtttcaagatcttgaatttttttaggcttctgtttccatacacacacgtacacatttaatatggctttctgaagtacctttaaatcagaatttatcttacttttgctgtgtttaaagcattttctattgaacttttcaatgaaattcaataaatgtaatatttttcaactttcccaaaaatttaatattaaggctgatttatagaaattcatctaaaactttgctactcaaactgtggttcatggactagcactctttggccatcacatgggagcttattagaaatgcagaatcctcctcctcccccatgctgtcacttactgactcataatctgcattttaataagctcaggtgattcatatacacatttaagtttgagaagtgtagatctacagatctaaaagcttatttactagtgcttatacttcatctagttaaccctcaaagggaaagagccctgtgttttagaaaatgtataccacagcatgaaagatcaaggtattttaaaaggtttctaggaatatcttagaggctgatataatctgttctttttggaaacaataatttttattttctttttcttttttttttgagatggagtttcactgttgttgcccaggccagagtgcaatggtgcgatctcggctcaccgcggtctctgccttctgggttcaagcgattctcctgcctcagcctcccaagtagctgggattacaggcatgcaccgccatgcccagctaattttgtattttcagtagaggcagggtttctccatgttggtcaggctggtctcgaactcccgacttcagatgatccacccacctcagcctcccaaagtgctgggattacaggcgtgagccaccacacctggccttttattttcttcttagtggttttaccatgtcatttgttatatccctttctttttgtttatctattaataatctaggtacacatcttcagtttcagctcttttctgtagacttttaaaaccaatgtctgttctctctcccatttgactcaatttatatttctgacattttccatatccaaaaagaatatatcgtcattcttttcaaattatgctttcccccccaacttacttttgttaatcatacatctgttttaggcctagtaaagtcaaatattctgcaagagtcttttcacagcttttctaatacacagtgatttttcctttctttgttcctgtaaccctagagtaggtatggaattcacgtcattaacccaactttctatttccacgttatttgtacttctgataataaagtttctgacaataaaatatgttcttggaatgcctctttgtaaatggcagtaatattccaaatgattagttatgccaaaaaaagggagaaaatagttatgccagcaagtacaccttgcctgttggttgaatgtaaacattaatttttttgtttctgtgttttcagttaacagggttggttatgtagtaaccaactcctagcaaatcttgactcattaaaaaaaaaaaaactaaatgaaaatcccaaaagtagtacagttcttataaagcaaataatgagtagtcttacctttaagtacataagaagtggacttaaaattgatgcttgagaccttatcaaatgtacaggtaatcatttcttaaagctgtattggattatacaaatgtaaactaatggaatactaacttaaaaaacacaattttaagactaaggaacattgaagattatcatccccttattttaatgtaatggaaactgacacagcaattaaatgcctgtttctagtatttcttaccaaaaagtatgtagaacatatctctcagcttttgagttttagtctaaagtccagaagctccaagatgataaatttccaaattatgcccacttcaaatagggaataaaacttggactaagtggcgtctggcatcagactgcatgtgaatagttttaacgcaaaagacttcctgttccaaaaaaatgatccaaagagtagaatgtagttggtagtttgccctaatcaattgttggggacatctagagttgtgcatttgaaagcttgtaagactttgcccagtttcactctatgcatgttttctactattgttttctttatagggcatgacagtcatttaccttttatagcttttgtatgcttcagctatgtagcacagtgggaacatacacaattttgcacttgggaaagtactaccctgttttctgggttataactactgaaacaattttaccagttctaccctcagtttctgttgaggagtagccaaacatgcctactgttctagagatatttaagataccagtccctcagaatcaaaattaatgcctgcagtatattggtttccagggtttgttgctttgtagtggtcaggtatccagaagcttcatcttaagtataatggaagaaagcttttgtttttatacaagtggatataaccctgataatgttgtatatcactttgagaaataggaaaaatagctgaaaaatgagagcaaaaatattttaaaatctttatttttccaaaatgccaaaatgttgtgtggagataatcaggagaagagaggtgctgtatgtgaatacctttggatttactgtacacaggctactcctcataatccattgcttatctttttgaaccaagttcctatctccccaaaataccatgtaatcttcgggttaaattttgttaatattataagtttcaaatctttatttacttttgggggataaaaaagtctgttgtagtggttgttttccaaattttccttgccctgtcattttttatgtgggctatctgcgaaggagaaaatttgtaatctaaatttaataaaacttcaaatatttaaatggtttctaaaagtccaagacagttttcctctgaaaattaaaagagccttctagaactttagagctcagaattaaagaactttaaaaataaagtattacttttaaaaagactgtttatgaaaagttgttattgtggtattactattgtagttttttttgagacgaagtttcactctttttgccgagtcgggagtgcaatggcacgatcttggctcaccacaatctccgcctctcgggttcaagtgattctcctccctcagcctcccgagtagctgggattacaggcatgtgccaccacacctggctaattttgtatatttagtagagaccaggtttctccatgttgatcaggctggtctcaaactcctgaactcatgtgatccgtccacatcggcctcccaaagtgctgggattacaggtgtgagccacccccatgccaggagtatttttttttttttgagatggaatcttgctgtgttgcccaggctgtagtgcagtggcgcgatctcggctcactgcaagatccgcctccagggttcacgccattctcctacctcagccacccgagtagctgggactgcaggtgcccgccaccaagcctggctaatgttttgtatgtttagtagagatggggtttcaccgtgttagccaggatggtctcaatctcctgacctcgtgatccacccgcttcagcctcccaaagtgctgggattacaggcgtgagccaccgtgcccggccggactattgtatttttaaaataacaactgcctctaaattttttggtaggtgagataactttgtatgtagctactatttagactgttaaatgttaaacctagccaggcgccatggctcacgcttgtagtcccatcactttgggaggccaaggcttgcagattgcttgagtccaggagttccagaccagcctgggcaatatggtgacaccctgtctttacaaaaattacaaaaaaattagcagggcatggtggtgtatgcctgtagtccctgttacttgggaggctgaggtgggaggatcacccaagcctgggaggttgaggctgcagtgagctgtgctgtgattgcaccactgtactcaagcctaggtgacaagagtgagaccctggagactttgtctcaaaaaaaaaaaaaagaaaaagaaaaaaaagagttaaacctctgtgtctcattcactatgtagtttgttttttttacacaaaagtctatttttttcattgcccttttgaccaaaaagttaaaaattttcccccccgctgactaccttgtataggtcccctttttggtcacctacaaccctgaaaatccttgactcctgatcggacgttttgggagtcatctaaagccatttgggaatcattgattagtctagaatgtagatatggaacaatggctcttgcaactttttagcagtggaactatttaattaaaatctgtcatagaaacttaggatgtataaatgtacaacacataagtgaactactcttctctcgaagcaataggtgcagaggttggatttgggccctatctacttgtataagcaaggggtgcgtgtggcccacgccctgatggctccacagatcccagtccagactagaagatggcgtctgtaataagtgatgaatcaggtgaagaaggatctttgaacagggaaagcaaagtattggtgcctcataagttttgaagaaacccttgactggctgtgattaaagtagaacataagattaagtcaaaagctctttaagatgcattttatctgttttgtgttaggtatgaaattagtttaggctaagattcaggagaaaaaaatagaataatgtttacacattgttaaacattagtattcatactaaatgggattttatgtgcagttaactaaagctaaaaaataatttttgaatgtatacagtattcatgaacaaaaaccagttagtttttgtttttatgaatagcattgtaaagttcagtgcttacgttaccattaacctatttaatcagatgcacttagagttgcatattctgggtttgtgttagaacaaaaagcgtcaatttttgtaatttcttttatgcttctctcttgaattttgtttgatgctctttatagaccctgtcaaatacagtcagctccctgtacccattggttccgtacctggattcaactaatcacaataaaaaatattcagagaaaggatggttgcttctgtactgaagatgtacagacttttttttttcttgtcattattccctgaacaatacagtataacaaccatttacataaaattttcattgtattaggtgtaataagcaacctagagatgatataagtatacaggaggatgtgtgtaggttatatgcagatattatacaatttaatataagggacttgagcatctcctctgaagtttggtatttgccagagttcctaaaaccaatcttctgtggatactgagggacagacaactctatgtaattgtttgttttttagtcctcagctaacttgttacattttttaacaataggattctcaatatgtggctaaggaaaatgtttatgccaccaaacagcttctgaatcttttttgttgttcatttattgattcaaaaaatatttactgaatactggccgggcgtggtggctgacacctgtaatcccaccactttgggaggctgagatgggcggatcacctgaggtcagaagttcgagaccagcctggccaacgtggtgaaaccccatctctactacaagtagaaaaattaggtgggcatggtggcaggcacctgtaatcccagctacttgggaggctgaggcagtagaagtgtttgaacctgggaggtggaggttgcagcgagccgagatcacgccactgtgctccagcctgggcgatggagggagactctgtctcaaaacaaatgaacaaatatatatataagcctgcgtatctcaatcactatgtagtttggtttttttacacaaaagtctatttttttccttacccttttgacatatatatttatatataacattgttaaggggctgttagaggaatgcatcatacagcaagtactgtttataagcagagaaatatttactctgtattagagtcactgtcatctgaagaatgacaaagtaaaattttttgtgccagtttgagtgtattccctgaactaattccatccatagtttgatacgagaatataaaagacaaaatatcctttctagaaatattcacagtgcactcatggtgaacactaacactaaaggtgctatagagcttcaagttttttgaagaatattaagagtgacaaggaggcttaggagtcatatagtgcatattctcaaccaatatagaaatccaggccatatcgtttttgatatcagtcccctgcttaaaatttctacaaatggtaacattagtaaaggacaatctatttcatttttaattaggtcatccttggaaataatagtttgaataattaattgaacaaaaagtgcctgttattttccattccatggtcccagttttgacctctgcagttaaaagtttaagcctaatcagctttccacaggatggcagttgcatgtttaaagatagttatcatgtccctctggtaagatttttttttctttgtatcaatatcttttaaagttgatatcttttgctatgaatctcaaattgagaagggttgcttatcatagtgtgaatacccttttgcccacgcagaggcagaatcctcttctgtacatgttggttttgttatttttcttgagctttcaatattttgtcttgttagctcaaggttggtgtaccttatcctccaattttcctaaattttcaaataaatcaatcctggtacctttttaagcaaataaaatatttaatctatttttgttattttaactaattgactcttaaatcattatattaaattataaagtaaataaaggtatagccagtgaaaaaattaactacaataaaagacaaaattgagtgacattaaacatttagtgtataaataaacatcagtgatttacattgttggcaaaataataacactgtaaacatctctgtagcaattgtggattcaataattaatgattaaatgaatgtatacattttgaatgctcttcctttatatatcatcacttgttggatacctaagtattcagttggccttcgtggcatgtttaagagattctcttttactaggtgaactgagatgctcctaaattataattacatagtgaaagacctcacatgccaatccttgttctcctcagtcatattaccaaaatttggtgtactttgaaggattcgcctatgataaaataactttttagaatttttttaagaatcagtgtgatggaagaaaacagtggatttctgttagtattttgtgagaaatggaagattacgttactgttgtctctacttcttccatgtaaagaaaatatcctcattacatttttgagtgaaaagaaagatttatttctagagccatatttttgtataaaattagggttttcataactttctaaatattaggtagaataagagaaattcttgtctaatctgttatgaaaacaaaactttaattaaaaaatttttgtgaaaatcttgaaatacactggtaagttttgtataggctgtttagcattccagtgcaatttggggaaatgcttactgttttccttgtaatgttttccattaccttaaaatgcagtagtattgcccaaggatagtagtgaattaatgaaacaatttagcattgacatgacccactcagcttattttttgttgccaaaaggttcaaaagaagacatttagtaatgctgtgagccatgggagttgctgtgctagtttattattacagcacaacccagacatgcaagatatccttaaataaagggcattgaggtagataatgcacacagagcacttactagtcaacaggacttggtttgcatatataggcaatgcctgtctactgattgatgaagcctattatcatgagattgtatttttattaaaggcaacacttagtaattctgtgcacagatgattaatagccaaatggttatagattttagttaattagaatggttaagatgaaaattctgaatgaaataaattgaatcatttctttatattgatccattatacatgaaattattaaagcttaagattgccatgtaaaggtaaatcatgctatgagtattctaactaaagtttgaatcattttagtcatttcttctcataatataaacatgctatgattaatctaaaatttatttctaaatatttgctaacataagataatagcttaatccctttattagcaataatttttgttcactagcagctgctgagttagagcgataaggacaagtcactgttaactttctgttgtagaattcttctagtcctttcattatacggctgctagtactttttttctctacagaatggagtgagtgaaatagcagtcttataaaagagaagatattttagactaagtgagtaatgctgtccattgcagtaggaagaagggtcaattttttttcttacaatagcataaagattttttggtcaacaagttctgtatagattatacctaaataacctcttaatttcttttcttaagccctgcagtcataccagaagcaaatgaaaatcatttagaaactcagatttatcagtttatgatactacttgttctagttttttttaaaaagtttatattcaagaatatagttcatacacgtactttcacacacacatattcatataacatcctaagagatccatgtatatgtgtacatgcattttctatttatctttatattttgtgatgcttggcttcctaacatatgattaaaaatatctaccaaatatttaatttgtagctcctgccaccatttctacaatggtgggaatacctagaggcatggcccctaagttattatagaggatgcatagaaggacatacactcaagcactgtgagagcattatattggtaattatacactcccagcatagcaaggctggttaaaatgtgataggagaaaccacctcctgtttcacttcatacctgttactttctactcattttttttcctctcaaaatactttgcactcctctgacatttctccagtaattcacatctttacggtatttttttcattctaaggctacttcatgacacttgactttacagtatttgcagtgtgacatagtttatcatttatgcacaatgctaatgcagaataccatttcaatgcttgtgtccttgtctgtctttcattaaaaataatagcatcaaattctccttgaagtgctgtgtttattattttctgtatattcctgtgcatctatttttaaatctgtcaacagtctcaactgtgtaatcttagttttcagtaaaataaaatggtaaaaatctatcttcttatttgcaaattaaagtaaaagttatttttttaaaaaattttatttgtaatttttgtgggtatatagtgggtataaaataattttaaattgtagcatataactaagaaaggtactcagatttcggaattgtgaggaaagaaataatattttaatagaaaattacttacattgggcatcttggacactgcttttggtctagtcttcctgacaaataatttaagtagaatgtttcctgtattaaatctcaagagaagcaaagtcaatttacctgaaattatattgagatataatcaatatgtagagtgacttaaaaataagaaaagtccagtaggttatacagaaattagtctcattacttttcacaactcgttcttagggcaaaataatgtataacatataccatcagttaatgactcatatttagagtttgataattaaattatatctaacactgaagcagaaatgaagactgattgcttgtgtcatgtattgacaaaacatttatacactgtaatattttgaaacataattactgagcaacaatgacatgaatgttttacttaattgcatttgcttcagtatcagttatccagaaactccaaggcagttcttaagcgaactttctaaattcagtagcaagtaaccttttagtccagctcataaattaatgttttgacagccatttaaaatggcaagtaggtaaatttattaggaaacaatgcaggataaaattgaaaagacttggagtgggtacaactgtttgtgtttgactggctcaagaaggtttcacaagccccattacagtaaaaattcctcataagcagtattttaaaatattaaaatctacttgctaattctctagctaccaagctacgaaattcagaaggagttgtgttgtgttgttttgttttatttatttattcgagacagggtctcagtctgtcacccaggctagagtgcagtggtgcaatcatggctcactgcagcctcgacctcctggactcaagtgatccgcctgcctcagcctcccaagtagctgggaccacaggtgcatgccaccacaccctgctgatttttgtagtttctctagagatgagattttaccatgttgtccaagctggtctcaaactcctgagctcaagcgatcgcccacctcggcctcccagattgtaggcatgagccaccccatactggcccagaaggagtttgaaattagaaaattactgtggacaatattgcgaattcctagcttgtcactattacctctgttatgtacaatgtgtattatgtgtttacctttctccatccctttaaactgtgtataaaacagtaagtgtgataattaaccttctttccagtaatctttggaaagaagtaggaaaggtgaacaggctcaaattaaatgcaatctcagacattgaagagatttccaagaaaatgggagcaactggtcttgttatttatggtagttccctgacatacaactagccagttagccagtactaacaaacacagaaatggacttcatgttgagtagttgccataggtatataccatttgactgtttttaacatctgtattgcttacgatattggacatctctctcactccccacatatcatggtttattagtcagcttttggtaaaccgtgatagcaaacaactccaaaattttagtggcttatttgttctcgtttactgtgtgaatctgctgtgttctgctctgtacccgcttattctgataacctaggctaaaggagagaggaaggtgtgatagcaggacctgtgtcatggctcttaaaacttctgcttgaggccaggtgcggtggcttatgcctgtaatctcagcactttgggaggccgaggcgggtggatcacgaggtcaggagatcgagaccatcctggctaacacggtgaaaccccgtctctactaaaaatacaaaaaaattagctgggcctggtggcgggcacctgtagtcccagctactcgggaggctgaggcaggagaatggcgtgaaccagggaggcagagcttgcagtgagccaagatcacgccactgcactccagcctgggcgacaaagggagactctgtctcaaaaacaaaacaaaacaaaacaaaaaaaaaaacaaaaacaaacttctgctagaaactggcacatagcactttcacatttcattagtaaagcaggtcaaatgaaagcaagaaatgtaagccttctataggaacaggctcagtaagggaaaggcagctcatattaggactgtaatactgtttgtcacataggagttaatatttatatctcccaactgcaccaaccactgctccatccctactgtttatggcagagaagcacaatttttttttttttagcttttacatgattcttgattttcttcttaattactatttacatattatagaatgtaattaggaaataacagtaaaatcagtgacactggtgaatgtagagagattagtttacaaaacgtattatgtcatttatatccatactggtaacttcttactgcaaaaataaattggcaataatgtaggaaaaaaatattattccctccttgttttttttgtatagagtaccattctggtaaaggagccagtagagaaatttggagtaacaaattaaacatttttatttttcatgttagatattttcatatgtagactaatactagatgttctgctcttatattcatttggctataaatttgaaatattttgaagtaccaaaggttttaaagtaatatttcttatttatttaaaacacaataaaagcatataaagacacaaatagattttactgttttgttttgttttgttttgttttgttttgttttgttttgttttgttttgagacagagtctctgttgttcaggctggagtgcagtggcatgatctcggctcactgcagcttccacttcccgggttcaagcgattctcctgcctcagcctcctgagtagctgggactacaggtgtgtgctgccatgcccagctaacttttgtatttttagtagagatggggtttcaccatgttggccaggctggtcttgaactactggcctcaggtgatcggcctacctcagcctcccaaagtgctgggattataggcatgagccactgtgcctggcctcttcacatttcttatagaaaaatattcctatgaatgagtagcaaataattctgaacataaaaattgagattctgaatttccttcctgtcaaatcaaaaagccgtcagttccattatgtttttgttcagttataattccttttactttttaccaaaattttttcctctggcattctttttattattattttttaaattttgcccagggtggagtgcagtggcatgatcatagctcactgcagccttgaactcttgggctcaagcaattctgcctctgcctcccaacagctgggaccacaggtgcacaccaccacacccagctaattttttaatttttttgtagtgacagggtctcactatgttttccaaggtggtctggaactcctgggctcaagtgatcttgagcctcagcctcccaaagtgctgagattacaggcatgagccactgtgcccagctgttccccagtattcttaatgccacttgaatgattgattttataaatgggttcacttttcttttcattctttaattaactcatcaataatagaattagggcattgtatattgttattttataggacagccatctgtcttacctaacaaaatcagcataatttaaatcttaatttcatattgagcacctctattagggtaggcaagaatttttcttatttggtagcactacagtccaaagccaaaagtactttgtcaaagtgacagatttaggtctaagatatgtaccttgaggaattgatattgtaactttcttctttatgcatgattttggagatggaagtagcatagctaggacatacggttttatttatattgtttagtggctaaggaaggttaacatgaaatcttgttcaatttattttttgtatttgcatagtaacgtaattatcaattctccttcagtatgcatgcaatgcattgattcataattaattgattcccctttccacaatatcatcttccagtgctttcagaggatagaaatgtccactaatgcttaaggtgttctacttttttttccttcattttacggttacttccccatcagcatttcacctttttctagcacttttatccaaatcatagattttctatcactgtcaatatttgtattagtctgttctcacactgctaataaagacatacccgagactggtaatttataaaggaaagaggtttaatgaacccacagttacacgtagctggggaggcctgacaattatgggggaaggtgaaggggaagcaagacacgtcttacatggtagcaagcaagagagcttgtgcaggggacaagctctcatgagacttattcactatcatgaataaaacaatcagatctcgtgagacttatacactatcatgagaacagcagaggaaagatccacccccatgattcagttgcctcccactgtgtccctttcacaacacatgggaattatgggagctacaattcaagatgagatttgggtgaggacacagccaaaccatatcattctgcccctggcccctcccaaatctcatgtcctcacattccaaaatgaatcatgccttcccaaagtcttaactcattcagcattaactcagaagtctacagttcaatgtctcatctgggacaaggcaagtcccctctgcctatgagcctgaaaaatcaaaagcaagttagttacttcctagatacagtggcagtataggcattgggcaaatacagccattccaaatgggagaaataggccaaaacaaaggggctacaggccccatgcaagtccgaaatccagtggggcagtcaaatcttaaagctccaaaatgatcttttttgactccctatcttacatccaggtcacgctgatgcaggaggtgggcttccccatggtcttggacagctctgcctctgtggcttcgcagggtacagcctcccttgtgactgtgttcatgggctagctttgagcatctgcagcttttccaggtgcacaatgcaagctgtctaccattctagggtctggagtacagtgcccctcttctcacagctccagtaggtagttccccagtggggactctgtataggggctcccacagagcatttcccttccacagtgccctagcagaggttctctatgagggccccacgactgtagcacacctctgcctggagatatccaggcatttccatacaacctctgaaatctaggtggaggttcccaaacctcagtttctgacttctgtgcacccacaggcccaacatcacttgtaagccaccaaggcttggtgcttgcaccctttgaagccactgcatgagctgtaccttggccccttttagccatggctaggaagcagggcaccaagtcctgagactacataaaacagcaaggctctgggcctggcccaggaaaccattttttcctcctaggcctctgggcctgtgatgggaggggctgccatgaagacatgtcatgccctggagacattttcctcattgtcttggtgattaacatttggctccttgttacttatgcaaatttctacagctggcttgaatttctcctcaggaaatgggtttttcttttctattgcattgtcaggctgctgattttctgaacttttatgctctgctgcttttttaaacttaagttctgattccaaaccatatttttgtaagtacataaagctgaatgcatttaacagcacccaagtcacctcttgaacactttgctgcttggaaatttcttccaccagataccctaagttatttctctcaagttcaaagttccacaggtctccagggcaggggcacaatgccaccagtttctttgctaaaacatagtaagagtcacctttattttagttcccagaagtttctcatctctatctgagatgagcagcatttgaacaaagccattcaacaagtctccaggaagttccaaactttcccacatctttctgtcttctgagccctccaaactgttccaacctctgcctattacccactttcaaagtagcttccacatttgtgggtatctttacaacagcaccccactacctcagtaacaatttactgtattagtctgttctcatgctgctaataaagacatacccgagactggtcatttataaaggaaagaggtttaatggacccacagttccacatggctggggaggcctcacaatcatggtggaaggtgaaggtgaagcaagacatgtattacttggcggcaaacaagacagctagtgcaggggaactcccctttataaaaccattagatcttgtgggacttatttaatagtacaagaacagcatgggaaagacctgcccccatgattcagttacctcccactggttccctcccatgacacatgggaattatgggagctgcaatttgagatgtgattggcacacagccaaaccatatcagtattcattttgcaaaatgaaattttagaacagctatatagtgtaaaagttgtcaaagtcaaaatggaatcactaatgttaaacaaacaaacaaaaaaccctgacaaatagagctggaggaggctgtgaagagagggttctcatgcttgcacgcttgataaaaactatcataaaagactccacaaaaaccacaaccatgtacaaaggccatcacaactttactcaataaatacttctacccaacacatctgcccagcaactggctgtccaacctttgactcgtgtcactcttgttattgatctttatagccaaggataatcattttaaaacatttatcttatcctcctcacttttcctttaaaaactattgtcttcctaacttctataaatacacacattgtttactatgacacaggtattctcatgaaaatgctctttccaaataaatatctttcttttagagaacctttctcagtttgttattaaggttgacagtaacatgcctttacttagcagtaactttgtggggttttttagttttttgtttgtttgtttgtttgagacagagtgtcgctctgtcaccaagctggagtgcagtggcgtgatctcagctcactgcaacctccgacttctgagttcaagtgattctcctgcttcagcctcccgagtagctgggactacagacacgccccactaagctcagctattgtttatatttttaatagagacgggtttcaccatgtcagccaggatggtctcgatctcttgacctcatgatctgctcgccttggcctcccaaagtgctgggattacaggcgtgaaccaacgtgcctggccctgtttttttttttttttttgagacagagtctcgttccgtggcccaggctggaatgcggtggcgcaatctcggctcactgcaagctctgcttcccaggttcacaccattatcctgcctcagcctcctagtagctgggactacaggtgccccaccacgcccagctaatttttcgtatttttagtggagacagggtttcaccgtgttagccaagatcgtcttgatttcctgacctcgtgatctgcccgcctcagcctcccaaagtgctgggattacaggcatgagccactgtgcccagcaagccctgttattttttatgttgagtgtttccttgaagggcatgtggaagaaaatgccataaggtggcccatcttactttacatttctggtttagagtgatattattttgaatttctaccatagaattgaaaattatagccaatgaaaagcaatgtagctctttttctttctttttttttatttttattttttgagatggagtctatctctgtcaccaggctagagtacagtggtgccatctaggctcactgcaacctccaactcctgggtttaatcgattctcctgcctcagcctcctgggtagctgggattacaggcatgcaccaccacgccctgataatttttatatttttagtagagacggggtttcaccatgttggccaggatgatcccgatctcctgacctcatgatccgccaacctcggcctcccaaagtgctgggattacaggtgtgagccgctgtgcccggccttagctctttttcttaatgagaatgaaggggttttcgtgttgttgtgtgtttgcttgtttggttttggttattatatctttatttaactcagaatttaaagtcaaaggtgctaatccaccctggatagacccagttaaaagcagagtgacttatcttccatgaatcttggtttatcatcaggatatttaaccttgagctcattacctcttcacctcccattagaaacctggatgggagacatcagttttggagaagatagtctaatgcagtttttttccaggttaatcaatcagtcagtgaattaattaattctttaccctttcttgctttctttcttttctctcttcctccattcctttctctctctctcctggcttccctcctttcagtagaattctttctctaataaaattacacagaaataacacaatctattttattacattgtttatttcagaaaataatttgggttatatgtaactggtaaataagggaatagcatcaatataatatagaagtgaagttggtttataataataattcccaggacttccaagttgcagcagctatacataaaacacactaaattgaatgtagcaaccaagtgcctgtgtcccattcacccgtgcccccattctaccttttggctctgttcagccgtatcctctggacctgatacctgttggaacagagagttgctataggatggtggagatttttgaccgtcagtttctttaatggttattgggtttttttttttcaggttttcactttctttttggggtcaatttttatgacattttaaaaggaacttggttgttacatatgatatgttatctttagggtgccttaggcaccttaaagcttgaaaattccaagctaatttccaagattagcttggaaatgaagatttaggtgttaacatgggactgaatgaggtttctaggctgaggctgtaaaattaagagtgcagggaatgaagaacaaaatttgtgtctagtgtagcagcctttctctctctctctctcctttcttttttgcgacggaatctcactctgtcacccaggctgtagtgcagtggtgccatctcggctcactgcaacctccgcctcccaggttcaagcgattctcctgtctcaacctcccgagtagctgggactacagggattcaccaccatgtccagctaatttttgtatttttagtagagagggggtttcaccgtgttgaccaggctggtcttgaactcctgacctcaggtgatctgcctgcctcggcctcccaaagtgctgggattacaggcataagccaccacacccggcctctctctttttaaaattaccattttcttcatatttatcatatgccatagtctagccattataaccatatgttatatatacatagcaaggagaaatgttctaagtattagctaatcatgcttgataggcatagtaagagaagacagcgggcacagtcattcgtcttttgtttcaacaagagtaaacttgttaaaaacaattggctgaaaaccccccagttatttacatatttgatgcttttttatttttgatttttgatatatgtgtcctttcttctggtttaggcctatgtttgcttttttatttttgatttttgatatatgtgtcctttcttctggcttagcctatgtttgcttttttatttttgatttttgatatatgtgtcctttcttctggcttagcctatgtttccgagggaaaacaggccccaaatcagaatattcaaattttgtattttatccatctatcccccacaaaagtgtcttgaatatgaatggttgttccccttttttaaaattaggaaaacaggtttaaggaattgattttacctaaggttttctcatccttgactcattggcttacatctttattttccatttcccaaggtaaaacatagcagtttggaattctagctgagtgtcctactcatcaatgtaactctcacctctttatttacccttcaaagataaataaaagccacacacacacacacacacacacacacacacagacacacacacacacaaagaaaaaacatatttacccttcgtttactgccctgggaaaatggagatgaatcctttaaatatttttcctttgccagctggcacagtattaacttttgtcagttaagggtactgacacaatgccattaaaggaggaagggagcttctttactagtttttgagtgcttgcagcttccctggctcctaaagtgcaaaatggtcatctgcactcaatggcctgtagcttcttgcagaaccctataccctatccacccacgaggcagttttgtagcagagtaactctgctgcttttgctgcttgtagcaatagcgtttggctcctgcagtgcatggaaaccagcagcacctagcagccaacatcttctgggtggttttatagtggagtgcttccagtgagacaccacccatgaatagcttttcatgacgctctaaaggacagatttccagcaagttctgcttatgtagcaccacagcatcttctgtgccatccagtgagccatagctgtgacctttccaacaaaatctggatcttagtctggggatatagtaggtattctttcttggccattccgttttagttctaagggtggtggttgcgccttatcatgttctagagttctccttacttcttagtagccaatctctggttattccagtactctgtttagttataataatgattctttatgttgaattttccctgttcaaactcctgtgtgatttctaatttctaattggaccttgactgatatattgtatgtttgtaaaatgcatggaatataaatggctaattatgatgtttctttagataggcattcttgagcacatgtgtctggaatatatttcactataatgttagttttgatgactgtattgattttcaaaactgtcagtttagaaactagaattttagatttatcaatcagcaatgtggtgttatgtggctaatagattagacattcatctgttgatgagttaaaaagctctccctggaattaaaattgcttatcactgtatagtactttgcatacatttattaatttccttagtaattttatgaagcaggttgcaggtatcacatttctgtaagaaggaattaagtctttaaagttcaaacggtattccttaatatccttggatatttcttaaccatcatatactgagtttactaggacatatagcacttgatccgttaaaactattacatgcaatgtcagagtttgtatgttgtagatgtctttcatgtcactccttctctgggccctgcccccatcataaacttgaataaatttgtgaaatatctttttaatatttacttttttccccaaaagtcacagtacattaaattgaatgcatttatattcttatgtcacattagcatcactttagcttactggatagtattttgtttttagttggttgcaagtgttgatttttcctctttcagtttgcaaaactatatgacaggaaatctgtagctaaatatcactttatgatttccatctgttcaagtacaatagtgtttatggcacagtccagattgcaatgtgatagaaatatcctattatagcagatagaattttaaatgatcattgtacattctaatgagaaaacatttttaaacaagtacttcacttaatttcaaagcagagtaactgaataatactacaatttgatgacagcatctgttctacagagtgtgtttgtgctgtcaacaataaaaactttttctgactcccatagaaatctatcagtttgctcaaatctgtactaataatggaagccaagtgggcagggagattattgtataagtcaatttgaataaccttaaaattttttgtttctattagcatggagagtatctctcattattttctgtgaaatgactttgggagtagagctggagatgttattttggcctttttattacgtgacagtaaaatttttgctaaattatattttgagagtattaacatttactaaataaaaacaaacccctttatcacaaggaactctggccatttcaaatcttgttggctctaaagttgagggatacaagaaagcagattaaaatgatggctcctggagtgtcaggtgttagtaattccaaggtttttagttctcacagtgtatatttgcctctattacactgatgcaaatgcatctttcatgtctgatcagctactatttggtcattcacttttatgcttcctattctagtacatgcagtgctgaaatgaatgggaaaaaccactttcccacatgaatgctctactgcacttttatctcaaaaggagcattgtatttcttgagtttccaaaggattttagataccattcttaatttaattattttatggccctttctctttaggtctgtattagtttgtgagggctgccataacaaagtatgacagactggatggcttaaacatctgacagttttggaggctaggagtttgagatcaaggagatcaaggtgttggcagggttgatttatttgaggccccttcccttggcttgtagatcatcttctcactgtgtcttcacatagtctctgtgcatgtctgtgttttaatctcctctcctgtgaggacataattacctctttaaagaccttgtctttaaatacagttacattcagaggtactgggggttaagacttcaacatatgaattgggggtcagggaaacaattcaggacataacaagatctttagccctcatctaaatgaaccatgaccataaacagttctgagcctcattctataggtacatcagttttcttctctacctttggttatcaaattccttagtaccccagctactcctcttttcccatttaagatgacctttctcctattccagacattggctgggaagttagtcaagaggtaacttaaggaatttagtgcagggtgtctaccttaagattttcactgatttgccttaaatcatgttcttccattacatataaaaaaaattaccagcaggccttgtccttcaggtgtgtttctcactcccagaatacatgttgactccacttgtccttcaggtgtgtttctcactcccagaatatattttgaatttgtaagaagtacgcagtttagaccttgttcagaatccatacagtattcattagttcccccctctagtcaatatttgtaggccctacaaacattccatgttcttccataaatcccttcttgagataataaagaagtatagccttttaaaccagctactcagcttgcttgtcaaattcatattttccaaacaaaaattaaataaggcttatctgatagttggtagttgacaatattattggtggtggtggtgttatttatttattttgagacaagatttcactctgtcatccagggtggagtacaatggcacaatcactactcactacaaccttgagtttccgggctcaagggatcctcccacctcagtctcctgagtagtcggaactacaaggtgcataccaccacacccagctaattgtttaattttttatggagacacagtctcactttgttgcatagtctggtctcaaactcctggcctcaagtgatccttctgccttggcctcccaaagtgctgagattataggcatgagccaccaagccaagctgacagtgttatttcataccaccgatgatacttcagagacccatcaactctgactatacatttcaaccaaaagttttgttctcatttattttatgccaaattagaaaattatttcctacttcttatgtagtttgcaagatcacagaagaatctgaaagtaacacagtattgtactttgagttaatttctatgtatggaggtatcaggtatactgttttgacccagaattcccaaaattcttttgagagattagaaaggaaaattagtagaatgggtgaagtcagcaggtctgtgttgacagagattattttaatttgaaaaaaacagtcggctggtattattaagtggaaaaaatgtggatcctttcattttttaaagataatttttcattacattaaaaaattcaagtaaaatgcaaggtgacccttaataaggtagctttcttacctgtcatattagtaagatttacaaagctgccaacacaccattttcacagttatgggaaacagacatactcatatattgttatgagcgaatacagtcagttctgccatagttcaacatatatgttccttggctgtgttaggcaaaattgcaccataaaaaacacagagcttgtgagaaaaatgagattaggagcacaacactcaaaaacttcatcagtgacacaaaatttaagaccctaataaaaattgtggcacagtttttaaaatacatgttaaatggctaagtacatgaatggctaaataaaataaacatggtactttaccttgaaaaagacctgaactttgcttgtggaagtgggccctagaagggttgcaccttgtgagttaataaggtacctttcttacctatcatattaataagatttaaaaagctgccaacacagtgttttcatagttatgggaaaacagacatattcatataccattataaaggaatagtcagttgtgctataataaagaagagatagttcttgtcctccaggaactcaaagtcaggcatatgcaactcaaaatcttccatattggaaagtggtagagaaaggttattcaaaatgggttggaaacttgtaacaatgaatgtgaatggttgtggcttgtgacacatgtgagctcatacctctgtaagctgaggtggatgtaggaggtacgtatgatttgtatatgcctaccctgctctgtttagctaggtacagttttctacatttatctgctttcttgaggataaaatcaagcataaacaaatacaaaatttgtgttatgtccaaattgttcccaatatgtcaattgtgttgtaacaaattcaaatttcaaagttagtgtaatagcagaactaatgagttggtataacttttatggagaataatttggaaaaaatatacaaaattttaaatgtacatgcccttttaaaaatctgcaaactctagttatcctaaagataaataacgacttatgcaaaatgatgtatttacaaggatattcattgcagcagttttttttgtcataaaaaaagatcataagcatcctaaatgtctattcatagatgagtggtaaaataagttctggttcatgcattctgagaattaccgtgctgctgttaaagaaaaccacttatacaaactgatgtgtaatgttcttcaagatatgttaaaaaaaaaaaaagtagggtttagaatagtatgtataacatgctatcactggcacaaaaatataatatatccttgtgtatctctatgaacagattaacactgaggcatatgctagtatcttgatatgccagactctgagttccttaaggacaagaactgtattttatttatcactctgtcttcaacaggtagcatagtgcctagctcatattaggtgcatgataaggatatattgaatgggatagatgaatgtgtcttaacattcatgtctcagaaaatatgataaacacaattctaaatgtaaaattgaggattattctaaggtatcgtttgtgttactattttttttcaagcaatgacttatgcttagaacattactgcattttcagattttgatttaaatatatctattgaggtcatgccgccactgggacatatccatagtagaaaacaactgatgaagagccattggagaaagggctaacaggacaaagagcagagttggcattaggaggcattatttaagttctgtgtttctccaaaggacaaaaatagaactaatggatgtagaagatatagggagacagatttcagcttaatataagagcataccaataggtattaacaatttaaagagcagtgtcttaaagacttttggtggtggttatgcagagattgctatcaggattaatggaaggaggaagcatggtgaaattgagagatcagtagtcatttttaagaatcaggcagatctggctgggcgcagtggctcacacctataatcccaggcactttgggaggccaaggcaggcagatcatgaggtcaggagttcaagaccagcctgataaatatggtgaaacccccgtctctactaaaaatacaaaaattagatggcgtggtggtgcacgactgtaatcccagctaatcaggaggctgaggcaggagaatctcttgaacccaggaggtggaggcttccgtgagccgagattgtgccattgcacttcagcctgggcgacagagtgagactccgtctcaaagaaaaaaaaaaaaaaaacaggaaaagaaagaatcaggcagattaggtttgagtgctctgccacttagggactattgtgaccttgagcaagaaacataaccttttaaatttccttaactatgaaatagggataattaaatgtatctcatgggattgctgtaaggattgagaaaaggtaaagtaccctacttcatgttatgttaagccctcaataaatggtgacaattgccattgaaataggaatacttttttaggtagaaggtatatggtatttggtttctaaggtcctttttcaacctgatatttcctaagttttattttacctattttaagtaagaaacatttatacatctgtgtttcaattgtattataccaaaaatataatttctgaattgtgagaaattgtttattaaatgcctatataacaatcatgcttaatgtatgttttaattattaagagatgatttgcatttaattatctaaggtcgactaccacagtagagactgtaacagccatgattccttcagtaaaacagaaattcactatgcatttcagtgagggactataacatagagaattggttacataggtgtcagaggattgaatgagcaaaagtgagagctctgaggtaactgagtgataataactgctgaaagcagctaacacttctggaactggagaagtgaagaacaggggacctgcagactgggactcaaagacctgaggagatggtcctgcctggcggctgttgctacctgtaaagaattagtatgaaacttgaacctggaacccaacagttgtggccaagggcaaagtattgttgcttgtaggacacctacagcaatatcaagtaaacagggaacacatttgtcatgctttctagtctccctctagtgttccttattggcagaacctagcaggaagccagatggcaaatgggaaatacagttttcagatcctcagccctaggatcacaaagcagagtataaaagggtaaatttggaattaagacacaatagcttgacaaatgcacagagacatctgtgtagaatatctcatattttaacaccaaatttatgtatttttcatatagaaaatttgcattttaaaatgtttttgtctagaaggaatttgcgtgtacatatactttccatcaataatttaagatgtgttcctttcagaaaggatgactgagttcactaagaattccacataatttgcttttctccccacaacccccaactcttgctgaaaatttgatataaaccctcatgaatctctaggaaaccttttccttctttattgcatgtgattcttccaggaattaagatttgcagaatgtaacatgaattaaaaattaaatttgaaatatttgcagtcatatgtttattgttactgagtaaaattgctagtgtggcttcagtttcttgcagttaaagcagggtggacttgtagagctgaggctgtttctatgatttaaaagatactgtgttaaaaaaatatattcttattcttctttgctaaagtgagccaatagattgcaactgtatttttgattaaatatagtttgatatttttgcaaattatttttttaaaagatactagtattcacagcaaatgtgcagacgtaactaagacatccccacacctctgttacaactagatatgttcattcgattttggtagttatacagttcccagtgaagtcaccaatgtttattggccccttccttcactgagatacgttcatgggttctgatgagaaatacttgtaattattctaagagcatgctttagcatgcaaccttggtaaaaatatggtaggatcatactcttaaaacatcttttcttttgtctgagtgcaggcattaggtaaattatgtcacacacagcactgcagtgatttatagaagttaaataaatgttcgtaagtaatcttaatacctttaaaatattttgggaggtaaggttttacattatgaaaatattctgagcattttataaaattattcaacatttatactttggttatagtttttgttaaataggaaatatctaattatataaaaaacgggatatattggcagagtttcttaataggagttctttttgatgtttcctttcatctcattagttacaaggtttaaattctatgccctaagttcattggcatttcacaggtagactttttgctgctattttccaactttagatgtgtgaagcctgtactacagcctctggatgaatggcaacataaaactagggtcttcaattaccagcttaaaaaaagaagatattaaatataaatatcagaaaacttgattataaacactattgatgggaagaaaaaaaaacttgattaaaatatcctgaattgtaaggggacccattcattaagatattgattataatagtgaaatttaaagtcaactggtttttctaatttatgttaatcataattaaccctccataacattgtaatacatgttggtaatagtctgaagcagactgttgtatgtatagaaacaatttcttcatatttttaactacctgaaaatatgagtaagttaacagtagttgagagtagtacagatttttggttttgaaataccattagaatagcagtgtcactttttaagcactgtgcagcttcctgtgttattcccttctttgtccaactgttactttttcttatgagaggcttccacaccctatttggtatccactttctttttatcaaataaagataattgcataatgaaactactgtgatttcatgccctaacttattcactgtctttgagtttcataagataagcactataattaaagtcattttaccaacaattagtgggaaggaagcatacagtggacaacatgttttaaaatcatagaaaggaggaatgcatgattttagaaatctgaatgagaactcatagcatgtagagctcaaattattcttcctcaactagcagcagatcaaaataggtggtggtatagtttgaaaaagcatatttaacattatcacataattttatactgggaaaatgaaaataaaaaagatgatgttttgtaatacagtccacatgagtaaggtttgataactggtgggagtgagtagttacagattctcaactgagaagggtggcaaaaaaaaggcttttatatttatcagaatgggacatagatgttttttctttttttgagacagggtctcactgtcacccagactggaatgcagtggcacgatcttggcttactgccaacctctgcctcctaagttcaagagattcttttgcctcagcctccctagtagctgggacaacaggaatgggccaccacacctggctgatttttgtattttttaatagagatggggtttcaccatgttggccaggctggtcttaaactcctgacctcaagtgatctgcccgcctcggcctcccgaagtgctgggattacaggcatgagccaccacgcccggctgggacatagagttttaaaatgttaagaaatgctaccttagattgtatctggatatcttctggtattaattgttgcctccctttcctgtctcacaggtctgtcataagatttattttaaagtttaaaccaagttctagcctaacaatagagggtaactactttaagtagacaatttcacgtacactactagacaagtgattttcatgtcaggagaactccaaactgagactcccatctaaggtacatctgggccacaatttctaaactgtgtgccaagaaactcaaatcctcacaaaggtgactcaaggccaactcagagccaggggagaagcctgctggtcttccaatcgcccttcaaataatttatgttttttacttagttttcaaaagactttactgggagaagaaaatagttttactgtcttaaaaaaaataatttgggtacccattgaagagtatcccaacaaatagcaccattttctttcttgtggctggcatagccagttgaggacattctgtttttttaaaagagcgtttctcactgttttcccacatgagactgacaacattgttttatttaccaggctgtgaataaactgtagaaaattagaaagtggattaaaaccttattttggatattttaacagtgggtatataccatatgttagatacatgtatacacacacgtttttgcaaactctaaattttgggagaatagcaacatattcctaaaggaatttctaaagagcaggtactggatagttgaaaagaattacaggaaatgactagtgtaaaaacggaaaagctgatatttttgaaatttactgccactgttctgttattatatttgtactaaaaataagtttcttctaaaaagtatagtttctgatttttgtttttaatctctactgaaatcagagcctactttatacaaaggtagtgaaacaaagtttgccctagtgttctattcctggttgaaataaccagatgcacttagttttagacatgaggaacaaactttcccaagtgttatctttttatcttaatattttaataaatagttatataaatattagcaaatctaatccagcagtgttttaaaataataaatctggaccaagtagcatttatccctggaatgcagggatggtttagtattaggaattatacctaatataatttagtagattagcagactaaagaaaatattatgtgagtcataaaccatgtatgggcacttttgccacataggtgcaatgttttaacagtcaaaaataaccaccttcttttaatagtgtcatgtgaattattctttttttgcattagaatttctacacatggtttctgttactattgtactgttattctaaacatttgtttgattttaagtctttatatcttttcttaatgtcattcagcagggcgtcaatagtaattctgaaaaatattgtcccagaaatcagtaactttggggaaaaagttaattatggtaaaatgtagtgaagaaaaccaaacaaattgatgttaaatgagagacaaaattgtacaaaatattagtgataaagctgagaaaaggcaacagtaaaacaaaaatgttgcagcgattatagatttttgtgctctcacaccatgtcatgtacagtttctttttcctatgggaaaattaatactcaatactgagttttgacttatgtgaaatctacaggaataaatacttttcatacaagaacaaaaagaagaggtacctaatttagctagagcaggacaggaggatgatggtagggaaaatgactagaaaaatttatccagatgaggaagtcaaagcttcagaaggtgaataaacatattcaaggacacttacaaatggataaagtcgaagtttaagtgtgttggtcttaggagtagaattgagtatgactctatagtatgcttactacttattttggtttcttgcccagaagaaaggtatttcggtaaaaaggaaagcaaatttgtatacagttttcctttcaaatgcagaagaagcaaaacacgctagcacttacaaatattaatttcagcttgctcttatctgtgtttttgccagtttgtaggacttgctaaaaaaaattacacagccctggggtccttagctaaccaacacattcttgttactgaccaggatatgctggttgactgttttaccatgtgcgttaaattaggagaaaaagatatacaagttcatttggcttttatgtgcacagaatcttttcaaattgtaaaaataaaattacctatccactggaggatatcttgggccaggagttcaagaccagcctgggcaacataggagaccctatctctacaaaaagtgtaaaaattagtcaggtgtggtggtgtgtgcttgtagtcctagatacttgggaggctgaagcaggaggatcgcttgagcccaagagttcaaggttacagtgagatatgatcatgcctctgcactccaacctgggtgacagagtgagaccctgtctcattcattcatatacacagacatgcatgcacacgcacacacgcacacacacatgcctctccacttgaaataaaaataagttaattcagtattttgaagaaatcagagtatttgacttagtaatatttctttccagattttttctaagtaacaaagaaatttatttgtatattgtgatatgattaatccttcagttaatctaagtttagccatataatgctttctttctactttgtctcttactcgaataataagaaagaaaaaatttcacagacaaatatttctgttcttccagtgtcctgaatacagagtaggactgtaagaattttaactaattcttattatggggtattatgcaaagcaaaactatactgagagtcagttgttttattctcaggttctgtaaactgagactaagttgtttggttctttaagtctcagtattgttttgtgtttcgttttgagatggagtcttgctctgttgcccaggctggagtacagtggcctgatctcagctcactgaagccttgatctcctgaggttaagcgatcctttcacctcagcctcctgagtagctggggccatagactcacgcccccacacccagctaatttttgtatttttttgtggtgacagggttttgccatgtttcccaggctagtcttgagctcctggcctcaagcaatctgcccgcctcagcctcccaaagtgctgggatttcaggcatgtgccacgtcacctggctaagtctcagtgttcttatctccaaaatgggataggcctatatccgtggaaatactgctgctgcagccctattccagaccaactaaatcagagtctctagaggcaaaactcagatatacatgttttctaaagttttctggatgattctcatgttgggagtcatcgttgagaaccactgaactagattatttataagattcattctactcagagtgtggtccacggactggctgccaatataccaactgtttattgccagtcctcaagtacatgtgcagctagcttgtgccaaaatgtaaatcagctaaagcactagtgtgctatttagtttggttgcattctttttttggtagcaagactattgattaaggaaatagtaaatttaatttacactttggtacaagctccttatttggtttcagaccagcagttggagtagcacttctttgagttctttcctagttcttaaattctgcgactgaatatataatatatggttgtttaaaatctgctgatctacaatgttattgcaatactactgaacattataataaacagaaggttgttatttagataatggaaatggaagaatttggaaggttaaaaatgttggtgacaattttttaaagaaaaaatgaaatgtttaggtgccagtcttctaaaatggaaaaatgtttcattcaaccaccatattatgactaatattttatggcataatttactggttcagtgcaccattctttctttattgttgcaagagataattgaattacacatggctaattattaaaaatgattgcagggcagttttaaaatgtaaaaaattccatgtgatatttaataggacttcaatagtggtagctgaagaaaattaagaaaataattgctcttaaatatatcagttaatcagtaaacactgttctgcaaataattcatatggaaaggattgtttatgagtagactgataataccaggctcacgagaaagttttgactattatagaaaaacatttaaaattcatggtatgatgtgaaacttttaacttgtaacctttatttttgaagacagtagtattaaaaacagtgttgggtgagaattaatctattttggatatgtgtttgtgtcaggtctctttcccagccttgtataactttatttgttaaaggacgaaaaagagacctgaatattatactgctgatttaatacaaagttcattctgaacccccactgtcaaaataaattaaggtcaattttgatttctctcaatacgtttgaaactcccttttttattattatgatttcatttatagaatattataggaaattatttgctttaaaaagtacctcaggacaagtattcacagattgttccagatcagcagttacagctctttactatcagagattaatttacaatgtaatcaggattctccttattcatagtcctgcttattatctaccttgagttcttgttcttagtaaaaatgcattgttcttttttcaattatttggacagtgaaggtaagcctaataacagatattgttggcctaaaaaaactatgaaatgtatatatggaaccccagtataattaaaagttttgaataggctatatgatgggttgactccacagattttctgggtaaacagctgactcagttagaccatgtgtgattactgtcctttgcaaaaaatagttttcttccctttcatctgactcattcttagtctttggtttttcctaattcatttagtgtgttgtaaaccccatcttccaatcatgatgaacctccagattaaaaaataataatgataaatgccattgtttaaatgttttaataaattgtagaacctgagattatatatatttatgaattgttatggatattttcaaaatatacataagtagaatagtaaaatatatccctacgtatttatcaccaggctacagaaattactgacccatgtctaatctttttccatctgtacctttccccactgcagtatattttagacatgattccattaattcataaatattcctcaagggaattatcaaaacatagttggtgaactagaatggatgagctccaagaaccccattaggtaatgaggaatctttgctagaaagaaatacggaatttctgttagagttcaaagaccatgtcacataataactacattacttagattctgtgcagtgtatgaaatgccttcacagcagctccatagtaagaacctgaaattatcttctttctctaattcttctatataaatttttaaagtagtgtttttttgtttttttgtttgtttgtttgttttttaaactgagtttcactcttgtcacccaggctggagtgcaatggcaagatcttagctcactgcaacctccgccttccgggttcaagcaattctcctgcttcagcctccccagtagttggattacaggcgcctgccaccacgtccagctgatttttgtatttttagtagagacagggttttcactatgttggccagactggtctcaaactcctgacctcaggtgatccaccagcctcggcctcccagagtgctgggattacaggcgtgagccaccgcccccggccttaaagtggtaaattttttagtttgcataatactttgacttttgttgacttaaaattccttatagtgaataacagtataccaccacagtgagcaatgatgagcttaatgagggacaggaatggaaaaattacagttttactggtttagaagttcagacacagtagctaacatattgtctaatgagtaatattttgcaaatattgaggattattaatttttaaatataaagatgtagtaatagttctttggtaagtctaaaaaataagtagaccatctacccttttatttgtttcaaagtgtcaaaacaaaaatagaatcaatggtgagaatggctttgatgaaataccagtgaggaaggtcacagtaaattattatttcatgacaaacaaaaatgtaaattcttttacattgcaaatataatattacaagagaatagcaaatttacagtatacacttggagaatcattctaaagcagttgaagtctccccaacaccacacttcaattttttgtgatctgtggtctccagagtaactattataagtggttttcccagattctggaggggagaaaataaattaacaatggattgataactttattgttcaagctatagtaattcttttcactgtgagattttacataattcactaaaattacccttgttttgtaaatatggaaccattcaacgaactacttttgaaaatgcaaatattgtactctagctagtacaatgagctctaggaaatcagaatcacattttgaaagaatcttgaggtttcaaagcctttcaaattctctcagttgagaaactgttacagtgtaaagtatatgtacgaagctttcccttttaaaagacaataaaaaatagttttgaattgaagagtaataggattagtaatctttataaaattaaagagccagatatgcccattgttttcagctaaataatggttccttaaatatgtccatatcttaatccccagaacctgtgattatgtcactttatatggcaaaaaggactttgtaggtgtgattaaattaaggatcttgagatggggcgattatcctggattatgtaggtagtctcaatgtaatttcaagtatccttataagagggaggcaagagaatcagagtcctaaagaaatgtaatgacagaagcaggagtcttagtcagtgagagagagattttaagatgctgtgcagctggaggatggaggctcagtccatgagccaaggaatgaatgcaggtggctcccaggagctagaaaaggattttagggaatgtattttcttctagatcctccagaaggaacataacctagctgacaccttgattttaggacttctgacctttagaactcttaagataataaatttgttttcctatcagctagtcattttgtcgtcatttgttacagcagcagtaggaactaattaacctatgaacaatttttaacctatcggtattgtaagtagtacttctaattattcttttaaatatatctttctttgaaaaacttattcttctttaggattcagacttttcatgtactcagggagaataaatgagtcctgttctaagttacttttttctcttggagatatcacatagttgagttcatggcctagaagattttctgatgtttgtacatgcccatgggagaatgtgttatcataataatttttagtatgcagcctcttgacttgatttttcacttatagtgtagaccataatatttgtcaatttcttatgcatctactgtgtatccagcattgatatagacatcttctgtacataatacattccacaataaccttgcaagtttggtattatttttattttataagaaagtatcctaagtatgacccattagtttgaaataaattagtatttgttgtgtaaatctttacctcccagtattgttgtttaagaattaaaacaggttgttcagagaagacgaaagacttttttttttttttaattattactatactctaagttctgggatacatgtgcaaaacctgcaggtttgttacgttaagtatacacgtgccatggtggtttgctgcatccatcaacccatcatctacaataggtatttctcctaatgctatcccttttctagtcttccaccccctgacaggccccgatgtgtgatgttcccctccctgtgtccatgtgttctcattgttcaactcccacttatgagtgaaaacattggttttctgttcttgttagtttgctgagaatggtttccagcttcatccatgtccctgcaaaagacatgaattcatcctgttttatggccacatcatggtgtatatgtgccacagtttctttatccagtctatcattgatgggcatttgggttggttccaagtctttgctattgtgagcagtgctgcagtaaacatacatgtgcatgtgtctttatagcacatgatttataatccgttgggtatatacccagtaatgggattgctgggtcaaatggtatttctgggtctagatccttgaggaattgccacactgggagaccaaaagactttaaagcactgttaatttaattgggaagataagaaatactattcatattatagttgagatttgagatgggctttgaaggatgaataggttttttgacagcaattggagggaggatattccaagtgaaatgaatactgagcaaagactcaaagatgagaaaacatggactaggttataggaatgtaacagtttggctagtatatttgtgtagggaaaaaataaaagatatgctggaatgaagtgaaaaggtgtttagatatttccaattttgtagaattttatttttaattcagttggtgtactaattgtaaaattaccttgaccaaactgatatcaggatgacaatgtcaacattgcacactctttgaagacagttctcatttgctgaatgaatgaatgaatgctgacccacacattttcaaggaaaaccttggttatgttcaatacatgtattttaaaactgagggaagtatgtcctttctgagagattgtcatcaacatggataactgaaaggttttgatgcttaaaaggataagctccaaatatctggaacattcacttgcatatatcactacatttcccaatagtatttgttaaattaaaccttaggtaataaagtgctagggttctttttcctgttctaacgaagtgaatatcataaatcaattcatttgttttgctgatttatcacattcatgggtgctgacttttttttttaatctgctcccaacttttgctttatcgtcattgaaatatgcttttcttctggtggtgaaagtagtatgtgaatgtttaatatgtaattctataatactgtgaattctgcatatcttgttctgttttgctaaaaaagtgaaaaaatatttccctgtgatgtgaaacagccattgaagtttggtgagtttatgagttggataactattataattactcagtgtatcttgctgttgaaaagcataagttaaaatgttttcatttattctacttggttgtagttataaaattatatggcccaataaatctgtacaataaatggccttttaatatatatattttaatttttagaaattaaaagattacagaaaagtccaaaggttatgtcagaattatcaaacattaatatttttgcatatttagctatccttctaaaattacatcaataatatgtctttaaaaatagaatatttcaaataaagttgaattttttttttttttaccaccatctccaattctgatcctctgtcttgtataaagtaacctattataaattgggtatgtatgttcctagtacttttttggtatttttactcatttgtgtaaccatacatttttaaattttttatttgaagagatggttatcatagtgaatgtattctacaacttgcattttttcactcaataattctgatatctagccatcttgatacttccagacgtagttcattcttttaactgctatgtagcatatatctataatatatctctaacagattttagattgtctgcagttatgagcagttcatctgtgaacatttttcttcatattttcttatacattcaagcaaatgtttttctagtaggtgcctagaaataaaattgcatggcatatgacagtgaaaatctttatattgttaatgattaatgtactttaaccaatagttttttagtcataaatgactgtagactcttacttaatattatagtttttaaaacttgtcaaattttatttagttaggtcacaaccatctgttttatcaaggtggatttggtctgttctatgacaatatgctgtgttcttaacaatcagcagttatctcataatcttataactactgaggaaagcagtgaaataaatggatggatgcacagatgggcaaagtctatcactaccactgaaataattattttaagtacatgccatatttaactgtgtcaatacattttattttgagtttggggatgccatcctagaaactgaatatacatgtaaataattaaactgttgtatattattccaacaagtacatttagggtactgttgtaaaacattttcaaaattaaatgtcaaatggaaattcaaattcaataaaattaaggattataaaactaaagctaagcatgttgtatgtaacagaagttattctggaaagtcctgcaaaaattagaatttgcattcatattgtgaattactgtactgctttaaaaaggaacaaggaaggtatttatgttttgatgtagaaagatcttgaagatctatttaagttacataaaggcaagacaaagcaaagtacatattgtcctaatatttgtgtaaaaatgaagtatttgttttaacttacatatacgtgaagtgatctctgaaccaaaaactaataatagtgattatgtgttgtgaaggttgggaattgggcagatagatacagaacaagagagaaactaaaaaaaaaatggattctgacagagaaactttttacatacctttttaaaaataccttttcacatttgaagctttgagtatattgccgtttttttaaaaaagtaatctataattttaatatttctattgtatacaattgaaaagtatttttaaatttcccatgtatatggaaaaaataaattagtaaaaacaatcatgagccaaatgacaactttggctgaaccctgtactgatatggaaggtaataatgatacgtgggttagtaataaagcacctctcctttggtaattgtaagggttctagttttcaaaatggcagttcatgactttccacagcctcttcctgtggtgaatttctggccagttggatgacagaaatacagggcttgctaaaagttaaagtatcttggcagttctggaaagagaccatctaaaccaccagccaatgctacctcagcaatattaccaataaccagttgttcactaagaaccggtcagggcgcggtgtggaccataggtatctttgctattctggactgttagtttgcttcctgatgtgcctctgcttatcttttcttcctctcagtttcattgggatcctcagctattgagttctgtcctggtgcattccagccccactgcaaaagaataggaatgagcatctaacacatccatctctgaatgcagaagaggttgaagtataacaaccttattcattattattacttgcttaatgaatttctggatttttattatctgtcattaaatatccaggacaggtgtcatccatttatccttatatcagttcagtaatctattcagtgaatatcagaactgggtgacatcctgattttaccacttactggctctgtggcactggctatggttttatcctcacagagcttcagttgcttcatctttaaagtttgaccaatagtaactaattaaacaggtaggtggaagataccatacgtaaagtttctagactaggtgccaaagcataggagtcgctcaagagatggtagctgaaaaaggaagtttcttacagtttttgatggtgtatggagtgacagtattcaatgcaagtagtgtctaatttgtgtagtctaattagtggcattttaaaatcccattgtaggctttaaaaaaatctgagggattgaatgttgttcttcttactatattagaaaagaagattaagaaggaacaaaagtagtttccttttaatagatccattaatggaaaacaagcagatttctttggaatgaaaaataatggaaagttcataggcaaatgcttgaaaagcatttttccccacagaggacagtttagagattttaagaaataagagtctcatgtttgtggaaaattagaaataatacctccttattctgatataattgagcaagaattgaggactgaatttccatctctgtctccccctccccgctccctgaacagagagattttgcctttcaaggtctcagtctgaggatttttgcttgatataggacctgtattcttttctcattctgttactgtgatatttttagaagtatccattttccttctaatatgcccattctgcccgtctttgaagtacctatatctttaaatgatgcctgtattcaccagtctgaagactcttctgactgggttttgcagggagcttgtggtgcatggggcatggggcattgactccgccaaggtgctttgcaggctaggcataacttatccaggtgaggacaggtactagaaggaagtgagaagaataatgttctgtggccctttcagaacctcaagaataccttggcagatccaagcgttctgcttatagaatgttagcagtagtagagcattatttctgtaattaggcacataggcaagagttaagtaaaaagtccggaatattaaccttaaaaaggaagacttggtagcacagaatatctgtgtctcagggggaaaaaagccagtaggcatgttctgtgacacctcaaaaaactgtaaaaggtggaaagtagtacaatttccaagaattagttagctcttcaaggagagtgagttccccaccattggtgttactgaaggaaaaagaagggcaaccacttttcagggttattgaaggaatttacccatcagattcattttgatgtcaataaccactaagctctcctctgtcttaaagattaaataatttttcaaattagattcattttttaccttttatccattggacagtttttacatcagtgttttatttagcatcattctgattgttgtttactttttaaaggggagaaggagaaaaggggagaggaaaggaagaccacattaaattcccaaataaaagaagcaatacaatctgggaaaaatagcgagaccttgtctctactaaaaaaaaaaaaaaacaaaaaaaaaaaaagtgtgcacctgtactcctagctactccagaggatgaggtgggaggattgcttgagccaggtttttgatgctgcagtgagctctgatcatgccactgcactccagtgtgggttacagaatgagatcctgtctcaaaaagtatatataaatttaaaaaaagaagaaataaattaaattttaaaaattaaatgtaaaatgttatgaaccttcccccgcccttaacaaaattttaagtgtataggacattattgttaacacaactttaagcacagtgttgtacagcagacctctggaacttcatcttgcataactgacactttatacacattaacagcaactgcttccccacctcagttcctggcaaccatcattctactttctgcatctatgagtttgactactttagacacttcatcagtggaggcatgcagtatttgtccttctgtgactggcttatttcacttggcataatgttctcaaggttaatctgtgttgttgcatacgatggaatttcattcttttaaaaggctgaataatattttactgtgtgtatatcacacagtaaatccattttatccattcatctgttgatggacattaaagttgtttttacatattggctgttgtgtacaatgcttcattgtacatatgggagtgccactatctcttaaagattctgacttcagttcttttaaaaaattaaacacagaactaccatatcccagaagtgggattggtagatcatatgttagttttgtgtttaattttttttaaaagcattttccttattattgtttggatatgcatttccctgatggttagtgatgtccagcatcttcctatacctgttagtcatttgtgtgtcttctttggagaagtgtcaattcaagtcctttgcccattttttaattgagatatttggagttttttgctattgagttatagcagtttcttatatgttacagctgttaaccccttatcagatatgtggttagcaaatatattctccgatcttgtaggttgccatttcattgtttcctttgctatgcagaaactttttagtttgatacagtcatgctccttgtctgttttttcttcttttgactgtgcttttgatgtcatagccaacaaatcgttgccaagacccatgtaataaaaatttccccctatgttctaggaattttacagttctgggtcctttgtttcagtccttaatccatttttagttggtattgctttttaaggaagccattattttaaaaataaaaatgaaaaacccatctcctttttatatatacctcctcttgatattttttggatagatataccttcactgtgctaactagagagaggaagtactcttttgcaatgcctgcgaggcataactaaacataaaggcccttttctttcagaaaaaattgacttcctgatgaaaagatcctgtattatttagtgtttccagaatatcaagatgataaattatcactggaaattatacatttccacagtcatcattggatagattataattggcgatattttgtaattctgtatgtctgggaatatgttaactgaaatactttgtaaaaagtataagactcataggaatttacttttctgactttttgtttacgagctttacaccacataaaattaagttaaatgactacatgcttcctataaagcatgtctgaaacccagccctctctaatcatggtagccatttaaagtgaagctgaagaggagccatgctattattcttcctttcccccagccgtttcaagattagattttgccagagaaataacagacacatctggtataggagacacttataacaaatctttctatgtagagaaccgttttattaattgtgccttctaattcaaaatatactacaaagttaaataaatgtgattagaaaggttctttgtgataattttaagtactgtttgattgggagatgggctgatggagaggggaaataatctagatttatttcatcagaattagtcctacattgattattctgggtaaaaaataataaattatgtaagtttaagaactattaaacttttaagattaacaatgtagaatacaggatcattttgtaggtggctctaaattaagcctttagattgaatcattttatgagaccaaataatcagtttaaagtaccttatgctttacctgatttaataatcaacaaaacattttattctaaatttattgtaaagcaagatagtaattggattttttatccccaagaatcaactgctggaggtatcttgtttactatattcatgtagccagaagtgaaaagtaactgaagactttattgttacagtcctgtcttatattctatgtatgtctgcaccctgccttaagtgtggttgtttggaaccgaaataacatctttcttgttggaaaatatggatgtatatgtcttatgtgcattaacaatgcttctgaaacatgaccttactaaatatatcaagcctttccatatatcagctttagtatttatcaataaatatatacaggaagctatgaaatatatgtatagaaataaatatttaatatttagttgggtgactatatttgtaccatattttgtgagaataaattttctttggattataatagtaatgtttattttagaaaatttagaaaaatgcttttgtatttgaagtctcagagcaagtaaggtaaaatgctgtaaaatttatataaccattgaaatgttaggctcacaacaaatctttgataatctatattcagttcagcaggccaagacactggggaggagaaagggtctgtggtagtaaatactagcactatttagtcacataattttgaaatgcggcattatttttgttatgtagatctagaaaataggaaaataaaaatcattaaataaatagcagtaacagtaccgacatttttggacattacagctctaccagttcttagctttctagttgacaccattactatttatttatttatttaattttgtaacaagaatgcagatgccatttatttggtccataagtatagccattgagttttacaaaacatcaactataaataacctgaaactataacaatacacaaaaattggcttcatacacagacataccaggcagtacaaactgaaaacgtgagtaaattaacattgttttacattaatatacatagtgccatttaacatttaaaaacaagtttcaatacatagcatttgatacttctttgaatctgtttcagtcagagtatgaaaatggttagagctaggctaaaattaatttttctagccaaaaataaaggcatgatatttataaccaggtatcaacttaaccacaatattttgaaactgttaatgatacctaagggtatttacattaaaaaggcaacatgcattgtgttgttttatctcatgactggttatgcacatactttgttcaaagggtttttaaagctatattcctactttcagtatagcatactgcagtgtgtctaacagttctagcaaaatgaatgctttcagagggagcagaatcattttcaagtcactggtgtccattttttcccctttggaacaaaggacataacaaataatctggttctgcctagataaactaagtagtaagagggctctgtttagaggcatttctgttcaatctaatgctatgacatcatccagctcttccttctgttctatacgtgacctctttgcactgagattctctttctcgtctgatttcctcttgcggcttctctcttcttcactgacgtcagcattctttgaagaatcttcttcatccgaatcaactgtgagaacatcatcttgctcttgagctgtggaggtggaaggctgacctccatcattactgccattggttatgcttttggcagcatcttcagcttgttttggccccactttttctggggcatcaccaacacttcaaattcaacatcctttcctaggtcttcactatgaaggatgttgatcaataaagtatagtcctggaggaagtaatctgcttgaagccagctgcaatttctcattccaaattctgacaacttcttgtgattattagcttctgtctctcccttttcagaagatattaggattgttcctttcccatcttcaatttggacatctggtgctaccatagcaaatttttgtttcactaccttgtctcgtaaggtgagaacagtcactttatggacattcagccgtacagtcacctggcttgctggcacatatgtaacaattggggttgggaggatccagtgcacaaggcacaagaaacttctttcttggatttgcttgtttattcaaaacaattgttctgcagtggtctatttttcctgataagatcttcaatctttccaatactgtcaacccagcaatcactgcattagtagtagcaatagcaggaataatattccctgccactgatttgatatcaaatctactcttcatattcatactgaaaatatgcatcctgaggtttgtagcagaggtaacaaaatccattgcatatgggtcatccttatcccatgtgagctcagctccatcccccttttctgctaaatgaactctcagagtctcagtgctgtgagctccttaagaaccttgtgctcaccggcttctcccacgtcgacctgattgatctggttactattgatgtcagcaacctcaacagtttttgtttcaaaagaaacatgttggaagatcaaaggcacaggttgccagggaaagtgcactgcagttttacctgaaagctaatatggttgcctaccatgacagcatcatgaaccctgactataatgtggcatatttttgacagtttatattggttatgaatgctttagataacagagctgcccaaaaccgtgttaatagagtgtgcctggcagctgttgttcctcttattgaaagtggaactgctgggtatcttggacaagtaactactatcaaagagggtgtgaccaagtgttacgaatgtcatcctaagccaacccagagaacctctcctgactgtacaatttgtaacacaccttcagaacctatacattgcatcttttgggcaaagtacttaagaagtatctcctgacagagctgaccctgaagctgcctgggaaccaacagaagccaaagccagagctagaacattctaataaagaaggtgacattaaacgtatttccactaaggaatgggctaaatcaactggatataatccagttaaactttttaccaagctttttaaagatgacatcaggtatctgttgataatggacaaactatggcggaaaaggaaacctccagttctgttggactgggctgaagtacaaagtcaaggagaagaaacgaatgcatcagatcaacagaatgaaccccagttaggcctgaaagaccggcaggttctagatgtaaaaagctgtgcatgtcgattttatttatttttgagatggagtgtagctctgttgcccaggctagagtgcaatggtgcgatcttggctcactgcaacctccgcctcctgggttcaagcaattctcctgactccgcctcccaagtagctgggattataggcacccaccacgcccagctgatttttgtatttttagtagagacgggctttcaccatattgtccaggctggtctcgaactcctgaccgcaggtgatccacctgccttggcctcccaaagtgctgggattacaggcacaagccactgcgcccagcctatatgtttaactttttaagaaattgtccaactgttttccataatggttgtctcattttatattcccaccagcagttcatgagaattccagttactccacattcttgacaagtctcggtatgaccggtcttcagttttagccattcttacaaatttttgtgttatctcattgtagttttccttttattttctctaatgacaaacgtctttcatcttcttatctgcatatctcttttttggggaagtgtccaaatccttagttcatttaaaaaaatggactggctattttctcattaggttgtaagatacacattttttgttgatatgatacaaatcttttgttggctatacatttcacaaatttttttcctttatgtggctttccttttcatttctgtatcttttaatttcagtgaagtccactatattgatgtttgtttttgtagttcttgtttactgtgtcatatttaagaaatctttgccaaacctaaaattactaggattgtttcttctataagttttataattttagctcttatatttaggtctgtgattcattttaaattcatttttgtatatgatgtgaagaatgaagaaagaatgaagattcccttaaaaaaatggctatccagttgttcccatactatttgttgaagaggtgatcattttcttcattgaactatcctaccaagtttttctaaaatcaattgatcatatttgtatccaagtttttctaaaatcaattgatcatatttgtatagttatatttctggattcactattctgttccattgatctggatgtctgtcttcatgccagtactatactgtctggattactgtaacttgataacaagtcttgagataaagtggtgtaaatccttcaattttcttatttttcaatttgttttgcctattccaaattatttacatttccatattagttggtcaattcataccaaaaagtgtcctgggattttgattgggattgcatggcatctgtatataaatttttggagaattgacatcttaacagtagtctttcaatcatgaatgtggcatatctatttagatcttatttaatttttctcagcagagttttataatttttactgtatggtcttgtacatcttattgcaaatttatttatatttttgtgctattttacatggtattttttatgtgaatttctgattatctgttattagtaatatacaattgatttaggtatattgatttttatatcctgcaaccttgctaaactcattaattctcgtagcttttttattagattcttttggaatttctacgcattcagtcatgctgtctgtgacaaaagacagttttacttcttgctctctaatctgtgtgcctttctttttcttgccttattgcacaggctagagcctccaagacagtgttgtgtaaaactgatgagggtggacatccttgcctcattcatggttttagggtgaaagtatccagtctgtctttcagtaaagtatgataccagctgaacatttttacagatatccttttattagtttgaggaagttcccttctattcccagtttgccgagatttttatcatgcttctagtcccagtttgctgagatttttatcatgcttctagtcccagtttgctgagatttttatcatgcttctagtcccagtttgctgagatttttatcatgaattgatgttggattttgtttatgtgcatgtattaagatgaatacgtggtctttagcttatttaataaggtaagttacattgacttttgcatgttaaaccaatctgtatccttgggataaactacataggtatgataattgtcctttcatttcactaaatgttgttaatttttgcctctataagggatttcatgtctgattttggtatcaaaggctggcttcagagactcaactggaaagcgttttcttcaagagtttgtgttgatgttttcttatgttggtatttttggtattggtattttttttgtttggtagaattttctaaagccatttgggccttttgtttatctgtgagaaagatttgttttcattttttgtgcgaaggttttttatctatacatttaatagatttaaaaggttattctgtttagctatctgtgagcttcgttaatttttgtgtttcaaggaatttagcaatttatcaagtttattggctacagttgcttataatattcttttattgtctgtagtattctctcctttgtcatttctgatattaataatttgtatcttccctttttttttcttattagtctggctagaagtttatcagttttatttttatttatttatttatttttggcacaaagaactagctgtggtttaggtcactggtgttagaactgccttcttttctaatatgatcgtgtagtgctgtatgtttccctaaaagcactgcttcagttacatcttacaattttgatgtttttgttttattaggttcaaaatgcttttctactttcctttttgtttttttctttgtcctgtgggttacttgaagtgtgttatttagtccaagtatttgtggacatttcaaatgtcttttctgttattttaaatttaattctgttttagtcagagaatatattttgtatgatttgagtactttcaaatattttgaaccttgttttatgactgagaatatggtctgtcttatcaaatgttccatgtacacttgaaaagaatgtgtatctgcattctggatggagtggtctctaaatgccaattggctaattagttgatgatattgttcaaatttgctgtatcttagtgattttctgtttactatcaattgttgtgagcatgatggtgaaatctttaattatacttgcagatttgtctgtttttcctgtgagcttttaattcatatgtttttaaaactctcttataaaggtacaaaattgtttaggattgttatgtctttttgataaattgacccctttatcattatgaaatgatcctttttatctttgccagtattctttactctgaaatccatttgtcatgaatatggctacaccagctttttttgatttgtgataatgtgatatatcttttctcatccttttgcttttaagttatttaatgtttctctcatttaaagtggttttcttgtggtcagaatatagttgaatcttgcttttttatctagtctgacaatctcagccttttctatggtgtgtatggatcctgataattagtacattatcttttaatgtgcaaatataaatgttagtaattataaattaagatttaagaatttgaataatttgatagatcccatcaagtaatcttattcctaaaatttctattttctttatttttcgaactttgttttatttagacttattatttctaggttatcttaggccaccaagaaaaagccaaaattgggaagtaaactgggactacattagaaataaaatggcctccaaatatgagagattatgctacagagactcctgtaaaattttagctataaaagggtaaaatggagaatggtacccacagggtcacaaaccagagtcaacaaatgttgactccagtgttgctttctaatatcttctgtttgttattgattttagactacttgctcttatatcaccttgggagcttttaagaaatacagattccccagtcccatggaatttgttataccctgtaatctattttaaggtaatgtaactttccatgtgattcttagattactctagggtcagaaatcatggtcctgccctacttatctgaccactttaatctctgacttttctgccactatcactttctcctacagagtcttggcaccattacaggaaaaaacctctgaggattagtcaggtgtgatatacctagaatattatactaaacagtcttgacatgtatggagctttagctttgactgtgctatatgtaacattaggttagtagagatcaaatcacctcaaaccttcacttttaacattatccttcacttccttttaatatttcttagattgtggagtgaagaactctgtctcccatatggtttaatttagtatgctatattatttttattaagcaaatttgtgtgtctgctgtatactgggtaataatggtcatcacctttctttcagagaaagaagtagcttttaaacaagttatgctctcctcccccaaaaagtcacgttaattctacatgatttttttttttcagttttcgtggtttgattggttccagtgttcaattagaatgtacttaaatttatgttgcctaattcaaatagattaatggggatgaggcagagtaactcacaatagaacaaacagttttgagttactttgccttatccccattaattttatcaacccataccttttcataatgatcataattttatttctggcataggaaaataagccaaaaatattaatggatttaaaaagctaatatatagggtatgtaaagatcaacaaattattttaaagtagatattaaaatgtctattgtatagtaaatgttcagtagtctgcaaaataaagaatattctacttgagaatttttttcttacacttgtttcatatgattaaaattcagtaaaacacaattaaaactcaaattatggtcaagcattagtttttgtcgattgataacaactgtccagcattttactggtcattattgagaatatcaattatcattgcattgtgggcatgttgaagtgtcactagtaaagaattgtagtttacaggatcctgaataatggttcttttttgttacacaagacaaatgcaaaggaagacagtttttggaaatcgatgtttaaaaaagaacatctttagaatattaatacctgtgactaatttttaaagattcatgaaaaatacaaattcaactgaaaagctataacagtttctcagaagatacaaagctgtaaaatataaaaagttttaggccaggtgcaatggtttacacctgtaatcccagcatcttgggaggctgaggtgggctaatcgcttgagcctaggagtttgagaccagcctgggcaacatgctgaaaccctgtatctacaaaaaatacaaaaattagccaggcatgatagcgcacacctgtagtcccagctactccggaagctgaggtgagaggatcacttgagcctgggaggtcgaggctgcagtgagccctaatcatgccactgcactgcaggctaggtgacagagcgagaccctgtctcaaaaaaaatttttttttaactcacttttttagtcttaacaatgggtagtgtacaatctacttgaacttcagtttttaactagtaagccaggactggaacttgtagtttaatcagaatttcttcatatatacgtgaatgttcctagatgaatatctttaacatggttcttgaattcttggttgtaccccaaaaatggtttcagtttaaaagggtgtggggcaatgaccatgattcagaattaattaatgttgcattttcacagggttttgtaacagtttatgctcaagaacaatgtaaacatttcacttgtgctttccataatgatggtacagcatgctttaaagaggaactgactagccttaggagacgtagtggttggtggcgagcagtgaggaagatgggaaatccagttagtccaatagaatcagtgccatgagttaaagggtaatggatgtgatgaccagaataccctcacaactagtttataccattacgttgtttttcacagatctaaggtacatctaaaattccaattaatggggtacaattaattagttacatggaaaagataatattctatatctgtcttcttaataagccaacagaaatgccctctagaacaccgattctcaaagtgttcctggaccatcatatcagcattgggaactggactggcaaattcttagtccttggaattagtagctagggaatgtgggaaggcaggaatttgtattttaacaaatgctccaagtaattctgatgcatgctcagtttgagaaccactgctttagaatatgatgcatatcaaactccagtaaaataatagcaagttttcagcattgctaattctaattttcaacagctgctgcattaggttttcgttaatgatacccaaacccagctggagttgaatcctagttacttcttattctttttacttactagtgagtggagcaccaggtgcagttgttgaagtgtgaaaataatttagctttgtagacagttctggcatttcttgattttgaaaatgctttaatcttcttggtatgatatttcaacaatcaaagcacatctattttaatggcagtatggacttgtgctaagaatttaaggaaatctctgaattattcctaccagtttaatatcaaaattaatattttagctgaattacaaagcttatatataatttactcctattttatttttccaccagtatgtgcattaaaaattttttaatgtcttcctgaataatttactttcaacctttttcacatcttctacaatattatgtttagttttactttggaaaaaaatgctagcagagattttagttaaatgcattcttagtagtaaggtccagctgcgtgctttgtgagttgcaaaactcatgagtccttcaaaaaacattttaaaggcatgtcagtaagacatgaaactagcatttatctgctgcagtatactttgagtatctacaagtggacaacatggtcaaaagcacttaaaatgtttaatagattagtacatgatcttgcagtgatagtgcagatttgtttttggttgtattgcacatatgttataggtaatgttggtaatacagatatttagaaccaaaagctgatgaattcaaaattctcttttgatgtttaaaaataaaaataaaattctcttttttttaactgtgtaccttcatgatctcatttactccttttacatcagctgatgcctttgtgttgtgactcttaatttctatctttagttcagaactttctcctgagatgtatatcttctgtaacctacatattactacctggatgttccatgggcacatgaaactcactgtgtctgaaactgataatccaaatctctccctcatactaaccctgtaaatacatatggaatcagagttacattaatagcctatttttcattattataataggtcaaatagcctattttggccattaccctagatgtttgcacagggcttcattctccattgaaattcctttctaatatttctgaaactcttctagagatatctcatgtgggtttttttgtttgttttttaaaaagcagactcccctctacccataagaatctgcttggttacttccttgtccatagaacaactatctctaatcaagcatcatcatctctgctgcttccccaagaggaaatgccagaaagtatgggagccttcatggtgctaagattgatgtcacatttcatgtagaaatggagaaagttctcttatgtcctcagtaatgtcatactttatcacttgtgaacctgctttatgtgcctgtgtgaagaaatggcaaactatataccagctattcatgcatttcttcctctagtatgtttttattgctaggaagcaactgcccaccaaggattaaatttctcaccacaacccctgcatctaggtagggccatatgactagtgtttgccaagataattaagaaatggttgtgctttctgcactctatcggccagctggatcaaaagacttcaaggtactgtggagaatggcaaagtcagaagaggaaaggagcataattccttgaattactgcataaaaggctgtctgccaaccagaaacactcatgttggtacttgagcaagaactaaacttcttgtgtagtaaacaatcgagatttcgttacaacagctgatgtttccctaattaatacagtgccccctttatattacaaagcccttctttgaaacagctccttaatcatttccctgcattccctttctctaaaaactcaaacacataaatatctggaaattcatggggctgggagggaacagatgccacattacattctaatccagaacttttctgccattgtgccctccccatcctattccctagacctgttaggcttggatattgttcttacacaagcttgaaataaagccttatgaaaatgggctcttccacagaccagctacatacttgatttctcagtttgaacttcagtgtagactacaaactatcctgaattcctttcttcatccccatttattcttccttccccaattctcaaattcactgaatggtaccatcttcctcctcagtaaagaagcctagagacagtaccttagccacttccaattccgtcttctactcttgtcacctaagcctctaacccattaacctatctccttccagtccccatgcttcttccttactgcagttgctttccttcaagtcttaatcctcactatgtcttcaggccattgatactcaactgtaagcgttatcactctataaaatcttgcattgtagaagtcccgcgtgggttacttaaaactctttaaaaaaatggctctttatcgcttatagaagttgttctgaaagtgcagtccatgtaccatagggatgcttaagactcctttagggctttcacaaaatagttcacaatcattttcataataattctaagatgttagttgcctttttcactagttgacatttgtccttatggtaaaaagcattggtggtaccaaactgtactagtaggcattgtgttttttgctgcctttctctaacagcccaaaccctcaaaagccattttcacataagaatgtccgtcagaaagcaataactttattaaatattgactattttgtgtatgtccttaatattctgtcacaatatataaagtacatcaagcacttctgcataccagagtacagaggttgtcttgaggtaaagcacttgtgtgattgagttgtgctgtggtttgaatatggtttgtctctaccaaaactcatgttgaggcttggtccccattgtaatggtgttgagaggtggtgggacctttaagaggcatttggatcatgaggaatctgctctcatgaaagaatcagtacagtcttgagggagttagtgagtcctcactctctgaggactacattagttacaatgagatcaggttgttatgaagcaagattgcctctcgtgtttgcgctattttctgcatatgtcagtttctcttctattcctccatcattttttgatacagcatgaagcccttaccagaagacaacagatgtggctgcccagtcttgaacttgccagcctaaagaaccagaagctaaagaaacttctttataaactacctggtctctgtcatagcaagagaaaatagattaagacaagttgcaagctcaacaaggcaatttttttcatagaacactgtttttacttgaaagaatgatcaacacacaaactatgtttattcagacttgtgtagttgggagatattttctcaaaaatgaatgaagtgaacttgtcgctgtaaggaaaatagttgacagtattagttgccaattataaaattcaaaaaaacttgtatctgccgctatgaacataacagtttcccaatacttagacttctctgagattggtggtgttataatgaatgtgattttttaaattgtataatttttattatacaattctaatgtattaatatttggaggatctgcataactccgtataccaatatttttcaaatgacagtgcaaagtatatcaatataacagtatatattcactgatatgaacttgaatagtgtatattcattaatatggttttctatcacattgcagttaacttttaagaaattaacactaggttttagtgtagaattgaaaaagaatatttccaattatttgaaaaggctactaaagtactccttttccaactgtatctatatgagtctgattttcttcattgactccaacccaaataatatatggtaatattttgaatggagaagcagatatgaaaatccagttgtcttctattaagccagacactttataagatttgcaaaaatatgttacactaaatttttttgcttttggaaaattttttcacaaaatcatgtcatttatgctgacatgtcatattgttattttaaagtgagttaataaatgtttctcaattttaattactaatgtgctgttgctagatgtaacccacataaaccaaagctctttggtgtccttaacaatctttaagtgtataaaaggttctgagaccagcaagtttcagaatgctggcttataggatatggttcatattcctaatatggtgattaagacactgtgatctggcttctgcccacttttctgccttatgttttaccttgcccttaatttttctcctatcttctaagcttattaagaaccacttttagggcctatatgcactctacagtgttgtgcctccaaggactttgctcatgcttcttccctttgcctggaaggtttctttgtcacccagaaggcacttttttttttttttttaaagacaaagtctcactcccagcactctgggaggccgaggcaggtggatcacgaggtcaggagatcgaaaccatcctggctaacacggtgaaaccccatctctactaaaaatacaaaaaattagccaggcgtggtggcaggtgcctgtagtcccagctactcaggaggctgaggcaggagaatggcgtgaacccgggaggcggagcttgcagtgagctgagatcatgccactgcactccagcctgggcgacagagcgagactctgtctcaaaaaaagaaaaagagagagaaaaaaaactgtattttttgtcttaagctaaacaaatacatctgggtgaaactgaataaaataggattgtgggagaataagtaggcatcctactcccttcctcccacccagttgttactggcctgcttctctctctatttctgcttctttcgattttgttttagcctcggggtgagtgggtggagggagtccaaaaacacatctgtactgtagaggagaaattgatagcatagctttatggaacttatctcagggttatgcaatccagaggtcccctgatttcagctctcatcagtgcaggaatcctttttccatcattctttgacaggtcctcatgcaacctctatatgagtatctccagagactaataacttaccaccccctaaactgcctgtgtctttactttgcactactaattatttgaaagcccgttctctcttgagccacagtcatatctttttttctggagtaatgctacaaaaaggattctgcctctttttcacaataacttttcaagtatttcaagagactgttagtcatttttatggattttctcttagctaagtgcactgttttgttttgtttttttttaagttttttatgtggcatgatccatccagctcattcccattctggagtactctagcttttaacgtgtgcctgaaatgacacataatagccctgtgtgactaaatacaaatttcttaggaactgttccttcctgtgacttgaaacattaattactgtgttttggttaggagtataagctttggtatcagacagatgagggtgtgaattctgacttttttcccctgtaattcatatctctgagtctaaattccgtaatgttaccatataggattattgcaagaattaggtgaagtaatgtacatttaaacatgaaccgttggctgggtgcggtggctcacgactgtaatcctggcactttgggaggccgaggcggggaatcatgaggtcaggagatcaaaccatcctggctaacatggtgaaactccatctctactaaaaatacaaaaaattagccaggcgtggtagcaggtgcctgtagtcccagctactcgggaggttgaggcaggagaatggcgtgaacccaggaggcagagcttgcagtgagccgagatcacaccactgcactccaacctgggcaacagagtgagactccgtctcaaaaaaataaaaaatgaataaaatatgaagcattgttcctggctcacagtaaaggctcaaagtagaagcacttgttacactgataattatatacctattggcacagcctaaaattgccatacgtttttttgcagctgcttcacattactgttaatattataatcattatgctagtatatttgttgtttatcagcttgtgctactactcaggcttttatgccttctccaattagccatccccacatcttgaaagccagctctgtccttttaaggctgaacttactcagtgtattttccagaaggtttttctccaattcttggatccagaagtattttgttcttacttatggcatttgttacagtggcatttgttcaattttgtacaagatagactatgaaaataggaacagttcacttgagaaatttataaagagatgagggatgatgagattaatgtcttaataaagctcaagaaaaaggaaaagcatgtatagttggactccccattttgtatcagcgtacttatttcaagtgactgaaatgagtaaagaaagaagccttgaagtcagctcacctatgatttttaactatgatattttgtattttaaaaatagatacttggtgcaggtgttattggcagacagaagtaagaggctagggtgaacaggctatgggcgtctggtaaaagaatttttttcccaaaaatgctctgggagtttcattcccaaaagatggatgcaggtaaatctgactctggtcagtacaatcaaggcaaattggtgtttttctaaactgtgaattgggagaggattctacttacaatttgaataataggtctcatctctatacttattctggtacatttaaagaaaaacttaggccctatattggacctacttcagaccttacaatccatatagtaacccataaataagtaaaacctttgtatgttgtgattttttttccctattcaagaatgatacctagaatattatacaattactaatttggggaatgatatcaagaattatgttgtttttggctttggttgtggttttttataactttaaattttgagataattatatattcacaggaagttgcaaagatagtacagcatgtttttcttttaagcacctggaagacaaccatcttctgtccctctgtttcacttatttaccatgcctatttcaaaggaatgttgcaggaaacaattgcaaaatgcttttgcaatcccaaaataaaatatatcaaataattttaaaaggcatttgcaaaaaaaaggtagttctataatattgtagtgctgtatttaactataaggctctacctcttcctataatagaaatagacaaaatctcagacaatcagtataatgtggaacatgagctctagagtcacattgacctgtaatggtatcctgacatcagtaaacagctggtgatcacttaaagagactcagttttcttatttaaatggggataataattctgcctctcatgatatgatgtatataaaccacaacacagcatgggtgtaacagatgatatacataaaacacttaaagcatagtgagaattcaatgttagctattaccaatactattttttcatgtaggtgattagtgtatttctcagattgataataaaagaaggttataacttataaggatttcacattgttaaattaatgtaataactgtagaaaagtatagccatagccaagcttggcaagtacatttagtaaaatataactcatattcctttaacgtagtaaccttagcaataacacaaaaagaaaagaattggtgttttttggattgatggggtatttaataattactttaatgtttttatctaatagatcatctcaggagcattaactccaatatatttttagtgagaaccttatcacagatgaagttgtgaaagaaaatttgatatttattttgtaatgtattttcagaatgttaaggattaacatatatttaatgtggaagcattatgtttgtttaaaagatgtgtctaataagggcctacaaaaatttattgtacatgaagatactcaataaatattgttaaattgagaataaatgactaatttataaacagttaaatattttataatttgtttttaatgttattattaaaatgaacctgtattataagatctcaatatttggtaatttttttgaagtgaaacaaacataagttagccattttacagggaacaattcactggcatttggaacattcacaatattgtacaagcaccatctctatctagttccaaaacattactccaaaggaaaccccatcaccgttaatcgggtgctttccatttctccctccccccattccctggcaaccaccaatatattaatatatactgtttcatttttacctattctggatatttcatattaatctaattatatatgaccttcggtatctggcttcttagcatatttttgatgttcatctatattgtattactaacatatatgagtacttcattcctttctatagttgcataatattctattgctctgtatatagtaccacaatttatttgttcattcatctgttgatggacatttggattgtttctaccttttggctatagtgagttagtgctttaaacatttataagtatttgagtacctgttttcagttctctggggtggtatataccttggagtagaattactgaggtatttggtaattctgtttaacttttttgagaaactgccaaactgtttttcatcatgacttcaccatgttacatcccctccagcaatgtatgagggttacaatttgtcacttcctcactaacatttgttattttcctattcttttctctttttttttttttaagtttttggtttatctgtttttaattatagccatcctagtgtgtatgaagtggtactttgttgtggttttgatttgcatgtcccagtgactaatgatgttgaacatctgttcatgtttgttagtcatttgtatatcttctttgattattgattagagactgttcttttctaaagtctgcatacagtgctgtaaatttccctctcagtcctgccttaactgtgtcccacaaattttgatttgcttattttcattttcattcatgtcaatgtatttttaaaatttcccttgacatttctatttatttgtcttctgttctgtttttttcacttctgttttctctttctgcattcctgtgggttacttatatttttttttagaattgcattttgatttgagtttaatgtctttatatagtctttttcatgcttgttttacatattttattatataaatgtcacctgtcagttcactggtatcattttaccaattcaggtgaagtatagaaaccttacctccacttttgtctttttattctccctcacttacaatgtaattgtcttaaatatttgctctgccttcatttagagccacatcacagaatgccgtaataattttgctttctctgtcaaacttgcttttgaaaactcaagaggaaagggaaagtttattgtatttacacatatttttactctccatttttttgtttgttctttctgatgttttaagatttcttcttttatcttttcctttttgtttatttatagagtttttttagccagtcttttagggtaggtctactggcaataaatgctaattttctttcatgtgagttactttccctttcattcctgaaaattattttctctaggtatacgattattttatttcagcacttgaaaaacattgtgccacttcctattggctccatggttcgtgataagaaatctgctgttaatccagttttctcttgtaggcttcatacaggtgcattcaagactttttttgtcttttgttttcagaagtttgattatgatatgtcttgacatggatatctttgggtttaccttatttggagtttgttcagcttctctatctaaatgtttatgtctctttttaagtgtgtaaagttgtcagccataatttctttgagcacttttcaaccctgctttctttctcctattcttttaagactctgtgacaccaatgttagatcttttgttctagaccacagtttcttgagctcttgtttgtttttgtttctccttttcttggtctgttttcccactgctgttaggttcagtaatttcttttgttttttctttcagttcattaaacttttcttcatctcttccattctgctgttgaacccattcactgagctttttattttagttcgtgtatttccatttggttcttttttgagacaaagtctcgctctgttgcccaggctggagtgcaatggcgtgacttccgctcaccgcagcctctgcttcccaggttcaagtgattctcctgcctcatcctcctgagtagctgagactacaggcatgcaccaccacgcctggctaatttttgtatttttggtagagacaaggtttcactctgttggccaggctggtcttgaactcctgacctcatgatccacccgcctcggcttccctaaatgctgggattacaagcgtgagctaccatgcccggcctggttctttttttgtatcttcattttctctactgagattgtatttgctggggctttccatttttttcgtttggttcaagcatgttcataattgctcattaaagaatttttatcgtggctgctttaagtctttgataaattttaacattcctgttattttggtgttggtcatttcttgattgtctttattcattgagtttgagatcctgctggttcttggtatgatgaataagtattttatagaaacctgagcatttttgtattataagactctgggtctaattataatcttctgtttccttgcttggactccactgatactgcagaggtgccttgttacctgctgtctgagatgaaagtcctgaccctgtacttggccttctctgacatcaccccatcagggatattgggcattgtgagggtggaagtctaggctccctacttgtcctgtacagttggtgggggggccggtttttcctatgaaattggctactgtagagtggttattatctaagctttctatcttgctatgctgttcctttcctggtcctttggctacagagaataggtttttgtagggattcttttgtctgtacctgtttctagattgccagcttctatagctccaagtctggaatgtatgaggcataaataaaacttagggcaactcagcactttattgtccttaggtcccaggggttccagtagtctactgtcttctcttttagagtcttacatttgtttcatgtattgtgtgccagtattttaggtgtactcagaaggggcaatagtgaaacataagtctactccatcttcccttaaagtggaagtcactgttagctcttttttataggatgattcatataaccataacttgtaagttttaatggtaccatatgcatccctgttgactatctggaaaccacacaagaaagcatttgtcagtgttcagaatctctctaccttgcatatagaaatttattttgttagtcccccatggtgattgtgctcagggagactgattcaagctaataatactctttttgagacaggggcttgctctgtcatccaggctggagcgcagtggtgtgaacatggctcactgcagcctcaaactcctgggctcaggcaatctacccacctcagcttcccgagtagctgggactacaggcatgcaccaccacactcagctaatttttaaaaatttttagtagagacaaggtgttgccgtgttgctcaggctggtcttgaactcctcagctcaagtaagtgatcttcctgccttggcttcccaaagtgctgggattacagacatgagctaccgcacctggccaggctaacaatactcttaagaaaatagtgtatacagtcagacagtcaatttacttaattctcagtgattacaaaacattacttccatgaggatcagatggtgtttggctgggcagtcaactcacagtaagtgatgctgaagcaagaatcagttaaatagcctcacaacagctttcttttggtgcatctgtattgctcactattcctcattgtgtattcattttatggggaatgagttacacgtcagagcagttattggagatgcacacagctcaagattcattcctagaaaatgcaaaggatccaatttaattcagacatttaatggcactgagcttttagagcctagcttatctagctctacaataggcatacttgccaggaggatctgactagacaaattgatatgccaaggctcctccacccatagacaattcttgggtagaccctgctggtttcccctttgatttctacttgcctttgatctttacttacgagtaacctattttttctgcatacttaccagtgtcttttgttaggttatcatcaggcctcattgtcctaggagctgttttgtttttaagggtagttaatctagggtcatagacccccttgcctgtggttgggctctaagaggaagccctgaaatgcacaagccaaccttgtaagagagcataattttctcatcatattctcaaaggagtccatgatcccaaaatcattatgagccactaatgtgtagtgttgctctgctctgttatgcatatatagttcagtctcttataaatcaccttagcttgtcattactgaagtgttattattgctgatttctgtgttttcttactatagttaaagatatgaaaatttggtcttttttgttaatattttttgctttggatttattacttatctagttgttatcaatgtatttcttttttattttaacactagaagtttcagtatttgagggcaagacaatttattgctctttctctttgctgtttcttatatccctctcgtcctaaaatgttacccataatatagaactattgcacgttttcagttctcttttcttcagttatcctgcagtctgatacagaatacatccttgtcattttaatgctgtgtagattttagtttaatgtaatgttttatacttaactaatcattttattctgttaataaataaagtctttaagggcctgtcagtatggaaataggtaaatattactgttaccttttaaaagaattgagtttgttgctaatctgacacgtggaaaagcatcaagctcagatatgtgctgccttcatcaggagcctggaaaaactagaattgccatggagctaagtgtccatcttcagttggaaataatagtgccattggtgcctggcctgcctgcaatttcatgactcctacattgcaccccgtgtgatctgtaggctatacatttcatggtgaacctgagatagcttgcatagcagattttctatacatttggatcttgaacaatgtgggagctagggcaccactccccacccctgtgccatcaaatctgtatataacttttgacttcccaacaacttttttaaaaaatttttatcttaaaaaatttttttttattattatactttaagttctggggtacatgtgcagaacatgcaggtttgttacataggtatacctgtgccatggtggtttgctgcacccatcaacccatcatctgcattaggtatttctcttaatgctatccctcccctagcccccatcccccaacaggccccagtgtgtgatgttcccctacctgtgtccatgtgttctcattgttcagctcccacttatgagtgagaacatgtggtgtttggttttctgttcttgttagtttgctgagaatgatggttttcagctttatccatgtccctgcaaaggacatggactcatcctttttatggctgcatagtattccatggtgtatatgtgccacattttctttatccagtctatcattgatggggatttgggttggttccacatctttactattgtaaacagtgccacagtaaaacatacgtgtgcatgtgtctttatagtagaataatttataatcctttgggtatatacccagtaatgggattgctgggtcaaatggtatttctggttctagatccttgaggaatcgccacattgttttccacaatggttgaactaatttacactcccatcaacagtgtaaaagtgttcctatttctccacgtcctctccagcatctcttgtttcctgactttttaatgattgccattctaactggcgtaagatggtatcttgttgtggttttgatttgcatttctctaattaccagtgatgatgagctttttttcatatatttgttggctgcataaatgtcttcttttgagaagtgtctgttcatgtccttcacccactttttgatggggttgtttttttcttgtaaatttgtttaagttctttgtagattctgggtattagccctttgtcagatgggtagattgcaaaaattttctcccattctgtaggttgcctgttcactctgatgatagtttctttggctgtgcagaagctctttagtttaattagatcccatttgtcaattttggcttttgttgccattgcttttggtgttttagtcatgaagtctttgcccatgcctatgtcctgaatggtgttgcctaggttttcttgtagggtttttatggttttaagtcttagtttaagtctctaatccatcttgagttaatttttgtgtaaggtgtaaggaaggggtccagtttcagttctctgtatatggctagccagttttcccaacaccgcttattaaatagggaatcctttccccattgcttgtttttgtcaggtttgtcaaagatcagatggttctagatgtgtggtgttatttctgaggcctctgttctgctccattggtctgtatttatgttttgataccagtaccatgctgttttggtagtgtagccttgtaatatagtttgaagtcggtagcgtgatgcctccagctttgttctttttgtttaggattgtcttggctatgcggggtcttttttggttccatatgaaatttaaggtagttttttccaattctgtgaagaaagtcagtggtagcttgatggggatagcattgaatctataaattaccttgggcagtatggccattttcatgatactgattcttcctatccatgagcatggagtgtttttccatttatttgtgtcctctcttattaccttgagcaaagtttatagttctccttgacgaggtccttcacatcccttgtaagctggattcctaggtattttattctctttgtagcaattgtgaatgggagttcactcatgatttggctctctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatatgacttcctcttttcctaattgaataccctttatttctttctcctgcctgattgccctggccagaacttccaatactatgttgaataggagtggtgagagagggcatctttgtcttgcaccggttgtcaaaggacttcccaacacctttaaacttaactattaatagcttactgttggccagaagcctggccaatcaataaacagttgattaacacatattgtatattgcatgctgtattcttgtaacgctatatactatattcttacaataaagtaaactagagaaaagaaaatgttatttaacatacaagaaatagaaaatatgtattttttatttttttatttaaaatttttttttaagagatgggggtctagctgggttgcccaggcttgtctcaaactcctcggcttaagcaatcctcctccctcaactcctgagtagcagtagctgggactacaggtgcacgccaccaggccaggctctgagaaaatatgttaagttttctatttgttaaggggaaatagattatcacaaacatcttcatcctcatcatcttcacactgagcaggctgaggaggaagaggtgggcctagtcttgctgtctcatggatgccagaggcagaagagataaaggaggtaggaggcaggagaagcaggcacactcagtgtaaattttattgaaaaagaatccacgtattggactcatgcagttcaaatccatgttgttcaagggtgaactgcaatttattactcaaagatgaagaaaacattacgacaaaatgtatcctaagtattttgaatatactgcctacattctaagtgcactgcaaatgtggcataactagttaactttcttcagtgatttaagaaagcctcacaagaggctgcactaactagatgtagagcatctttgctaaaaaaaagaattataactatctaatacttacttagtaaataaagaaaatgaccatattgaaaacactgattgattttaagtattgccacagaagaaagatagtaatttatcatcaataatagttactgctgttcaactgagatgtgatttaatattactaacaaaattgttcttaattttccatacattttttatctttttatgtagttttaggcctaacattatattaataattgtcctatatatttaagcaaagtaaaaacacttgaaaaatagaaaatgcatgtaaatactatttgaatgaggaaagtagtgatgccaatatttctaccttttcataatttaagacatttctaaaattgtatgaaatacacagtttatatgatttaatacatataatgaaccaagaataataattactttttaaaaacatatttgtttcatggccctgccggaggtgtagcaaagttgatgaggtaattttaaaacaattttgcagtttgtctcatgttttttatagataaaatagatacctgcttatgaaataacacaaaaaatctttttttccaagtatttgatttgaagaaaaaactagtgtgagtaaattcagcattgttgattgtaagtgaatctttttttttctttagcgcaaactcctacttgtgtgagtgggtgaatcttttaaaggcaatttcacatatgtctgtgttgctagaggaaacctctcacgcttctgtcagcgcttaaatgccaacaccactgttgtatttcccttagtagaaaaggggagggtgtttggacgtaacattaccataatagttttgaactgtttagaagataatgttcctttaaaattgttgaatataataatgttcaggccaggtacagtggctcacacctacaatcccaacaccttgggaggctgaggagggaggatcacttgagcctgggagttcaagaccagcctgggcaacatggtgaaacgccgtctctacaaaaaatacaaaaattagccagatgtgatcatgtgcacctgtagtcccagctacttgggaggctgatgtgggaggataacctaagcctggggaggtcgaggctgcagtgagccatggtcacaccactgcactccagcctgggtgacagagtgagaccctgtctcaaaaaaataataataatgttcataggttctcaatacaaattagttgaatttaatctaagacaacttccaaatcttgtatggatgcttatcgtatgttaccttgatttgtaggtttatttataaagcactattgatttaaaaaatagtatggtatgtgcttctttaaagtctctcctggctcttttttctttcttattcttagtttattttatggattatcttttcctacttgccttttaaatattggtatcatctaagattctatcctagggtctctgtctgtgctacatactgtatattgtctaggcagctgtctatctgctacttgaacctttattctcaactgtacacctataaacccaattatcttatatctcctggatgacccaggctatccaacagtgtattcaatattaagctcattatgtctttctctctccattttcagttcataccttcccccagaataaaagagtatgtatatttgcatataaatatataacacatacgtatatctctcatatatgtacttctgttttggaaggcccactgctagtaagcagcaggcctggaatttttaattctggttttttgaatgcaaatcctcagctcagagtgtattctatataacatggtgtccatatcttttcaaccaaaatcaaagatgcatgctctgacaatatttgaagtctgcacttgttgctgtaattataccacattgcttttcatcttactttattaagttgtcagcatcataggggacactaataaccacacatacaatgtaaaactgcaattatgataaatatagtgagacatgtagtataagatagatgaatgtatattttttaaaagatagccgggcgtaggggctcatgcctgtaatcccagcactttgggaggccgaggcgggtggatcacgaggtcaggagttcaagaccagcctggccaagatggtgaaaccgtgtctctactaaaaatacaaaaattagctgggtgtggtggcgggtgcctgtaatcccagctactcagtaggctgaggcagagaattgcttgaacccaggaggcagaggttgcagtgagccaagttcgaaccactgtactccagcctgggtgacaaagcgagactctgtctccgaaaaaaaaaaaaaaaaagatgatttgacctagtcagagctatcagatgcttccctgggaagcaattgagttgaaatgtaaaggttgggtggggaaatggaagattgttcaagataggtgagatagcttgcacaaagacttgggggttaagagagtacgtgctatatgtgtaactatccccgtgcaaagtatttgcaatcttgctagagatttcacgctcctcatttccttctttcctctccttttcttgcatccttattcatatatatttataaaagaaaaaatatatatttgaatgtatattagaatgtatagatatttgaatatatatatttgaagctgaagtttgcattaaatagagaatactagaaagcaaaatgtaactgcttttgaaaccacatagcagataggtaattttagaggaaccatgaaatttaagtgaaaagcatagccatgtgctaaacatagtttctaatgcaacaccaaaaagaaaaaggatttatggtagtattgtttctacccttctaagtcatattgtttctactcttgttaagtcatattagcatttataatcactttataatcactgtcctgttacagttttttaatttataatttataatcactttataatcactgtcctgctacatttttataaaccagagaataactaaatcgggtaataaatttcaaaaccttttcttaaattataagtaatttctcttttaagtgcatttttatactgtgaagtttagtattccatgcaatctttgtgtgtttgagaattagttcaggctgtaggaattctattagaatgtaaagtgacttttgaactgcactgaagtactctgtggtctgtgctattctgcatttgttgactctttattcctttttgttcttgatatacatatgtattatccttcataaggaattctgaagctttggtcctcaaaacatttcttcaacagctcttacctagttcttgaataggaagattatgttccaggctgtacagctgttttagaatcaactagatcctcttagaaacccaagcaatttacccatgttttccatatcccttggttctttgcttttgttttttgttttcttttttgtatcttttctaatcatggtccaaagttcagtgttcataacttccttatagtgtccttaaaaacttagttcgtatctgtttttctttccagaaagggctattgcaagacacgaagtccgagaaattgagcagcgacatacaatggatggccctcggcaagatgccactttagatgaggaagaggacatggtgatcatttataacagagttcccaaaacggcaagcacttcatttaccaatatcgcctatgacctgtgtgcaaagaataaataccatgtccttcatatcaacactaccaaaaataatccagtgatgtcattgcaagatcaggtaattaccacttaaggaatgcccaaatattttctaatacttcctcactcaaattttctagctcaaggggataaagtattttaaagggatgtgagtgctgatctcagtggatcataagccttttaggggagagggccagctaacttttgtataattttacttgacagtatttgacacatttccttgcatatagtatgtactcaaatatttgtgaagtaaatgaattaatgaatagcttgaatttttgagaaaactgatgttcctgagcatagtatccttttaaaaatataattttggcatgataccctgcaataaaaattattgtctcaacttatgatggagaaatatttgatggatacttgtattcaattttgtgaccagcccctctttactagatagagatagagatagatacagagagagtttatatatacattgcttataaatgtatatatagtttagttgtggcttcttcaacataatcttaccttttaaattctcacgaagttttagataaacagatgaataaataattttgtgaaatggttttaagaaaagtagaggaaattatcttatgaaataaaatttgctcatctctttaatagtagtagcatacatttctcccacacctggaattttgactgcaattataaataaagttctctctataaatatggaagggcatgggaattccaccccatgagaaggaaagataatgtttgcaaatactacttaggatcaaataccaaattggagtaggcttattagaaagatatttgtgatggtcctgtagttacaatgatatttatctgtttgaaagcagtgaacttgttacagaattgactgtcatctcactatttagcataactataatccttacacttaaacaagagaattacattgagacacaagactaaggttggctttcttgctagagagctgtttgtaaaggctagtagtatatggtatgtcatctgcccatgtaatttttggctctttgcagaatcctggagtactcttttttgtagaaccaaaattccacatctgtcggccaaaccaaataactcttctatgaatgagaagaaacatgagttgtttttagctatgtgtgtcataaaaactattcattatgtaatattgtgtatctcaaggacaagtatcctaaatattctgtttttatacagtgtgtagtaggttttaaatctttttgcattactgcttttcaaaatatgctttggtttaaaaggaatatgtattcatgcttagataataatttcagatttattcagtagtactttttagaaaaataatgttaatttgtttgttcagcattacaaagtcctggtaactgcaagatgtctggcaatgacatcaaccattattttcatgaaatataaatctggaggagctcaccacatatgacatttataggcatcatgtagtagtatattttcccagttgcatttggatgagataaagcttctgtttttcttttaataacttgttggttatgtataggaaaaaaaaaacagcaggagagaagcataaatgctatcttaaaagcaattggattgcataatgaccaacacttaaaaaatgtttgtgtggggcagcgcagaagaatagtcttaatcattagctgacatacttcaaaattatcagctggtagtccaaaacctgatcttaattaagagtaacttacttaacaaatgttctttatataccctatctccagttttgtgatctcttgttctatgtagacgcagttcttcaaacaagttatatttactgcttccccttcttttgtgtgacatgttttcatgtttacttcacttttaatctagtaagcttcatctaaatgtaaactaaaaattgcactgtatttcttaaaaataatttttaaatattccctgaaccccatctgatataacacacttttattttaataatatcatattttgttgtctctgtgtactgttctcagctaccttttttttttttttttttttttttggagacagggttttgctcttgcttcccaggctggagtgcaatggtgcgatctcggctcattgcaacctctgcctcccacgttcaagcaattctgcctcagcctcccaagtagcgaggattataggcatgcgccaccacgcccagctaatttttgtatttttagtagagacagagtctcaccgtgttagtcaggctggtcacaaactcctgacctcaggtgatccgcccacctaggcctcccaaagtgctgggattacaggcgcctggcctctcagctgcttaaataagaattaaatgaactattttgctcttttttcttctctaagaaatagtttctaatcaagtacaacttaaaagatgagatctttcttaaatctgttgtctccagcttccgtgtaaagctcagtttactcataaaaatattttgagatatgttacctgaccatcctctttattccctcaccttccaatcttagttcagtctgcttgatatctgcctttagccccagctttcctagacattttttgtacatactatattaggtattgttctaaactgtttacctgcttaattatttgtctcaaaaattttagaggcaaagcccaaatatttttagtctggtataaaaccactcaatgtataatagttatatatattctgctatccttagaaatagttgtcaactctgcttttgagtttttcatttatttgttgtgtatgtaatatacacaaaggttgtactacattctttggggaaataacaaagaaatagaaagcatggccacatccttgaaggagcttatttaaaatttacttgggaacataaaacataaacacaggggctatgaaaacagttaaaataaaacatcaatttgtggtgatctcactgaaatatttaaccaaaagtgttccctaccaaaatgtttgatttggacctaatcccgagaaaacaaattaatgtagaatattctacagaacaactgacttctaaagtgtcagtatcataacaaccaaaaaagttggagggaggcttctctagactagagagacatggaaaccaaatgtaatgtatggtctgtgatcagatccttgatcaaaaatgatatctttgttcatagacatagtacatgctgaggtaattaggggttaaatatgaatgacaactatttgctttcaaataggtcagaaaaaattgagtatgtatgtgcatacatagagaaaaaagataaaagtgacaaaatgttaataattagtgaatctaggtgaagagtatagagatgttcactgtcctattttttcatcttttctgtagtttagaaatttttttaaataaaaaagttgaaaagttaaaagaaggatattaaaagataaacatttgagaatataaggtatgagaaactaagcaattagaataaggtgtggactcagtcattaaagatacatttttgcgatgggctttacttagttaatagagaggaattggcaagagataggtaatcaatcaactcttctagttgaaaaatggagtttgctttgctgtcatgtgtttagccataccatatatgtgattagccacatcttttatgatttttcaaaaaaagaattcttttttgctctcatatgtttaggtctatgattatatataaccccttttgttaaaacattggaaatacctagaatttgtattctctgaagaacaacatgaatttttttctttttgaaattcactctcaagccaactttaggttatctgcgttagagcccacagttcaccaggagttgcagatacttttcagagcagcactttagatgaattttctccacctataatgtgtatgctaatcactggttaaaatgcagattcagattcagaaggaccaagatggagcccagttttcaatttttaaacaactcccactggatgccaaaattaatgccgctggtctttaaactgcagtttgagtaacaaagatacagatgatgattctcagtagggatatgggaagatgaatactttagtcttcccaggatggtagggtacttatctttaaattgttattcctacctcccctacaaaatccacatttcttacatagaccaagaggccctttttaatctagcccttgtgtgcaccaacttcttacccactagccacactggccttgtgtttcattgaatacgccaagcctttcccattttaaggcctccgcacttatcctttcctcttagaatgcacttctcctggcttcttccagagttggcttcatgttatccatttaaggtttaatgacatcctcttagaaaaaccatgcctggccatcctacatattaattacctcttctaagttactgtgtactgtatcactcttgttgtgtcttctctggtactaatcagcttactaacttatcttatatattggtttgtttactgcctgtcttttcctctattataagatctttaaggataggaaccttgtctgtcttgttcactactatatcccttatgtttagaatagtgcctgagacatagtagaaactatacattttttgttaaataaatgatgaatgaatgaacaaatggaccaacatagattttgatagcggtagatgataataattactggcagagtgagcacctctgattgacagcagtatgatctattcttatctctcaggtggattgggaaccagccccctgccctacactcctaaaacaggttgaacagcacagctctgaacttcagtgaagatatgttcaattactgcaaacttttcttatatttttatccaaccactactttgttttcctgtgagtgtagaaaactttctccctggcttagtctcataaaagtacccacagccatacaagaaatgtttaagtaaatgcatgagtgggagtttggtagatagtaattactcaagttaatagtagcattcattcaacagatagtaattacagagttggaatttggccagaatgttcaggatgacattcctgctcttttagatagtgaaaacaaatgcttttgttatcacagataatcataatattgaggttgatctattaagaatataggtcaagacactactgttagtgagaagggtgcttcttagctttttcctgtaacatcagtttaggtctgattcaactaacaaaaaaccccaacaccattacctatattgtttgtgtttttccttaaggtctcttcttattacttgctagcctgacttgagtcatcaaatccaacaaaaatcacggtttacactctgcttcaggctagctgcgtttcatgtactatatctgactactacatctgaaacattcttcttggtagcatatttcagtcagagtatgaaaattttctatgactaaagtcactgtagtggccttatttcttctccccaagccagagttttcagtgtcttcagtctccttaacttcaattgatactattaagttttgctccttttttggcctatcactttacctttcatttgtgccaagtatagtcagtaagaatccataaagtgaactgagtagaagtttgcttacctaatctcagtgtcctcttcttactcctctgtattttcaaaccttgtctcaaggtcttaggcagcatgcccaagagaaataccagaagaaaacaaactgaaagacaaagcaagtggtgcagggaggtgagaaggcagatcatgatagagcagaactgggactagactgatgagagagaaaagatgaaggtgaaagagtagagaccaggaaagttctggagaactaaggataaatattaaactgtaaaaggagaagtggccgaattaatactttaaaaataaaacttttaaaagtactgtttttcaaagggagttactcatattatttccttggagaacagttttgaagaggagataaagataatatggaatttcagcagtatgtaaatgatactttttttttttttgagacacagccttgctcggtcgcccaggctggaccaggctggagtgcagtggtgcgatctaggctcactgcaacctccacctcccgggtccaagcgattctcctgtctcagcctcccgtgtagctaggattacaggcatgagccaccacgcctggctaattttttgtattttagtagggacggggttttaccatgttgccttggctggtctcaaacccctgagctcaggaagtccacccgcctcggctttccaaagtgctaggattataggcgtgagccactgcacctggccaacactttcaaatgctcagactgttttctagattagtgtgaaccatgttagccatactgacatcatttatttgcttcacacttttttcttcgtcataaagagaaggtaaacctcagttcagcatcttttgattcattgtaaattttaaatcggccacagctatgttaatgaaactttaacatattgccttagttaaatgctgatgagatgaaagaaaaatacgtatgccagatatattacatgtctagcctttagtatgcttttagtttgagcttagaaagagattctgtgtgttttgaggactttaacaatagtagaggccaggcacagtggctcaggcctgtgagcactttgggattctgggaggctgaggtgggaggatcacttgagcccaggagtttaagaacagccctggtaacaactctacaaaaaaaaaaaaaaattttttttttctttaaatcttggcttggcatggtggtgtactcctgcagtgctggctacttgggaggctgaggtgggaggaccacttgagcccaggagttagaggttacagtgagttatgatcatgccactgtgctgtccggcatgagtgacagaatgagattctgtctcaagaaagaaaaaacaaatagattctagagaattttaaagcaataataatcacctgaatttacctcagatagcatggatttaggaagtaaaattcaaaatcctacatagatatttagatgtagtctcttggtttcaaccaggagtactcagcaatcccagtggttacccaagataataaaaagacaagggaacaaacgtcaagggttattgttaaaatggttgtccggtaaagagagtagtgatcagggtgaatgggaagttgatatgacaataaagttgatgaatgaattcataaggaaataaacaattgagagagttatatcaacagagctttgagatgttggagagatggagtagttttgaacgactggatctgagggattgccttagtagtggatagaagttgagattttcagtgtccaatttgttaaagcagaatcatgatatgggggaggaagacagagcaatatggccaaatagaagccttcagcaattgtcccccagcaggaacatcaaattgaaaaactatccacacaaaaaagcacccccataagaaccaaaaatcaggtgagcaatcatagtacctagttttaacatattaaggaaagaggcactgaagaggataggaaacacagtcttatatctcctataccacccctcctccattccccctggtagctgccacatggcgcagaaagagaatctgcaccctgggtagggggagagcacagtgattgcgggactttgcgtttgaatatggtgctgccctgtcacatcagaaagtaacaaggggcagagctcagctggtgcccacagaaggaacgtttagacagctctagccagaggttaatcttccatctcagcagttggtatttcagttccagcagcccctgccaccatgggctaaagtgcttgggggtcctaaataatgataaaggagtcaattcagcaagagaatataaaatttttaaacatacgtctgtccaacactggagcatccagatatataaagcaaatattactagagctaaagagatagatagaccccaatacaataatagctagagacttgaagacccttctttcagcactggacagaacacccagacagaaaaaccacaaagaaatatcatacttaatctgcagcttacaccaaatggacctaatagatatttacagaacatttcatgcagtgactgcagaatacacattcttctcctcagcatatgggtcattgtcaaggatagaccatatgttaagtcacaaaacaagtctttaaaagttcaaaaaaaaattgaaattatatcaaatatcttctctgatcacagtggaataaaactagaaaccaatagcaagacacatggaaattaaacaacgtgctcctgagtgaccagtgggtcaataaattaagaaggaaatttaacaatttcttgaaagaaatgaaaatggaaatacagccttccaaaatgtatgggatacagcaaaatctgtgctaacaggaaagtttattgcaatcagtgcctatatcaaaaaagtagacaaacttcaaataaacaacctagtgttgcatcttaaagagctagaaaagcaagagcaaaccaaatccaaaatgaatagaagaaataatgatgatcagaacagaaataaatgaaattgaaacaaaaaaatacaaaaagatgagtaatctcagcattttgggaggccgaggcgggcagatcacgaggtcaagagatcgagaccgtcctggccaacatggtgaaaccccgtctctacttaaaaatacaaaaattatctgggtgctctagtcccagctactcaggaggctgaggcaggagaatcacttgaacctggaaggcggaggttgcagtgagctgagatcgtgtcactacattccagcctggcgacagcaagactccgtctcaaaaaaaaaaaaaagaaaaaaaagaaaaaaaaagaaggtttttttgaagagataaacaaaatcaagaaacttttagcccaggataaaaagggagaccttacaactaataccacagaaattcaaaggatcattagaggctactatgagcaactatatgccaataaattggaaaacccagaagaaatgagaagtcttgcagtagtgtagacattatccagcttcctgggcttttttcactttgtgttgaagggtacacattggatgagatatcattcatcctcaggagagggtttagtttaatattgaccatccttaggaagctttgttggaggaaaaagaatacttgaatttgtacctgactcttacttctgcccacgtctttcactacagtatactccaagcttgtactatatgatcttccctgctgtttagtttatataacactgttttttcagacctcaatgtagcatctttcatttccctcctacatcaccatgtccacattaaatctcagcttctggaaaacagaggtgagttgctaaatatatcttaagctcactttagccaccatcttcaatgccttattctctttgccttcttttttcctctcatttttggctgaaatactagaactgattttcatagaaccaaaggtttataggaaataatctaccattaagtggcagttataaagacttttcatattcagcatgtaaagtatgttaaagatgcaggctctggattatttaattttatattttgtttctgtttcatttgcaatttggtattttcattctgtttgatgccttagttgaagaattggaaagaacatgaaaacctcaaatcacatttatttggctctttcagtttcagtggggaaaaaaattgaaaatatctgctaaaatgacattgtatactttctaatgcaaactaatttttatctgcaattcatttttcagattttaatttaaggatgtatatgtgtattgagaggccaagtaaggcatataaccatttccattctaaaagcttcataatttctcttagtatgtgagttattaatgcttcccctaaagataaattatcccagaactcttccatttttctctagttcacattctctgacatatagctatatctgcactgtttcccctccctcacctaccaataggcctttaacaggaggcagctatcatcattcattgatattattgagtgtagtgtagtatgaagtgttccagaatatctccatgtgactacccctattctatgatgtaagtgaaagattgataagttgtcagaattatgcaattgacagttctgtgtttgagaggctgaagtcatagcttgcagatggtttcggtgcggtacaggttggtggacctcactgcccccactttctgcactctatctaggttctaaaagagattcttaaccacttgctatttatcatgcagagatttgcttatcaaaaatgtataccattttccattgagaaattgtatatcactgctttgcagctagtgatacttaggtttatcaaattctatattaaccagttttagacatattaaaatatacttatataatttttcatattaatttttgtgtacgttaattccaataagttaaatatttagaaattttaaatattttgacctgtattacatctctaattttattaatctttttatcaacaagcttgtgatatctgctcttaactcttaaatatcttctgataaccatcacctttttaaaaatcattttggttttaaatattactttttatttgttgagtcattaataaaaataaacttttatgaacagcaagcctctgagaagaaaacatttgatatgctggaatgttcctgtattgcctgctttagcatgtgtgttggcagggtgtagatacatacacccccacaacgaccctcctcccaccctatgtaaatgtactcactctacagcattgtaaaggatttcattgtgccattttgttttcagaatcatctttcactcttttgtgagtataatgatagtagctgtctctatgatgaattttaatagttacagattacagtatactttccttagtccaaacctgtgtttcaagctctgtaaaagtggttttaggtttttaaattcctatcttggaaatattttgctatcatcaaatttcattttctttaaattgtatataatgaatgtgttctccctttttaggtgcgctttgtaaagaatataacttcctggaaagagatgaaaccaggattttatcatggacacgtttcttacttggattttgcaaagtaagttacactgaaatgacacgctaaagaatgctttgtactctagtaacctaaaaaggaataaattcattaaattgttatgattttctaataaaagaatgtactgtcttgcctttgccagttttagatctgtaatttaaatataccttcttagtgttttactgccctctagtgttcataaattggcaattcttatattaattacatattagttattactctttaaagtttattattattgtgtgtatatgccttgtacaaccagaatgacactacttcaggagagctcaagttataacctagaggccagattatgacttaccacatcattgagaaagcaaaaaagctctcactaagttattggtgctccagtgtgtctgcttctcacccaagacatactgaagtgtacactttcccttgggctaccttattttagctttaaaattatgatgtattacgaggcttttttaaaaaaaattcatgatttcctctctcaccccccctctccttctccctctctccctctctccttctctcttgctctctctccctccctgtcactcactcactcactcactcactcactcactcctggactcaggtgatcctcctgcctcagcctcccaaagtgctgggattataggcatgagccactgtgcccggcctctgtcatattaatagttctctcaagaagggttcagaaaactatatgcctactcacagtattcaagtactatgtggctttctgtacagtctgtgccacattattaatcagaaaattaattaaacttaatattccaaacataacagtcttatggatacatttgaacttttttggtagtacacatagtaccattgtagtaaacctcaaatccaaatgttttccctaagattctgcattaacttcaaaaacactaaaaaaattttttttattatttagcttagacatgtttattcagtttttaaattagctattatgatttcagagtaacacaccttgatatattggtcaactttaaaaggcattttttataaaatttaaaataaaagtgatatcccactctcagttttacttaattttgaaaagaaaaagtagaatgaagtattactgattcaaactgataatcttaactttttgggaaatcatgtaattaaaaaagaatcacccaaatattacatacataaagtgatatgttcctatttctagttcctctcatagtactcaagatctttcaatcaaattgtagctctaaagttagatgtatgtttttctataaataattcatactgcaatattgaaaatattttataggcagctttaaaataaactaattatttttttctttgcataggcattgaaccaatttcataagcttcgttcatgtgcatattttccctcagggctgcattatccttgaattgaatgtttgttaccctttcacctaaatgatttattctttccacacacagcttggtttctaatagtctaggttttcattattaaaattataaattgagtgcttttgcttttggcaaagtcttatacttagaacaaagctctgatatatgctgaggttcttgtagttgaaaaaataaggctttttgaagagattaatctcatttattaaatgctgacatgaatttttaagcgtttgaatattttcatagtgagtcttatgttatttgaagggaaaagtattgtgaaaatttttcatagatttttccaagattttaaatacctaaacaaaatcagcctaggtgaaatgtattttgatgtatctatgtaatcaagaactgttgtagatgtaactagtatcctcaaatatcttttagcttaatagccatatgctccataaatggggaaggaaaaggaaagaaacatcgccttaccaattttttagattacagtcgttcctggggtatgtccagggtattggttctcggactgcctgagtatataaaaatcgcatactcaagtccctccgttggccctgtgaaacccacgaatttgaaagtcaccccttgtacacgggtttcacatctctcaagtactgtatctgtgtgtggttgaaaaaaatctatgtatgcatgggcctgcacagttcagactcgtgttgttcaagggtcaattgtgctttactcttcaaaacaatattcttgactggcatagtactttgtggagtccagtaaaatacttgctttcaggagaaagtggtgaatttggcaaaatacttatttaacacatagtttttttaaacttaccttatcagagacattaaaacgaatgtaagccccaagaaacctaggaaataagatagagaaataaaaaatgaacgctcctttctagtttagcccgaccacgaagaaatacacattatatttgcaagcttgtctactcaagccatgttttgattacatacatttgttttttactgaactttagaataataacaaaaatatcttttttacatttttgcattcctatcccatcttgctcctttttgtctgaatcttattctttgatttttttaaagtatatttcctagttcttcttcctttccatttttccctttaatgttaggttatgttttgttttctttttaattggtgaatgatacaattttaagataatgtagatataaattattataaatttgaaaattttccagtttaaaattgtatataggttggacattttcaaaatgtcatagtatgcaggaaatataaagttgagtaagttgcagttcttgaccttaatgagttcactgaaatctttttttctgtaattaccagttcatgaagttttattataaacagtaaaaatattaaatattcctccccttttaaatgtgcactatttattttttaatagcatctattagcccattttgattttcttcaaactttagaaaattaaaatgttagaagtctctttcaaaaacacttcttcagcaataaacattttcatttataatgaataatagctaaaagaacacttttaatgctgtactttctgtcagactctgctaagttttttatgatctagctacctcagtgtcacatgtcagcatctgtcttgagaggtatttgaaaattatttttgatataacagttttattcaggcacgtatcaggtatgtacctttgtagttgtccctagaaatgagaatgagttttcattgctgccattttggttcctccatattgccgctagtatcattttcagaacaagtgaggtgaatcagtaaagaagcagctatgtcacgacaagaaacaactaaatgcttcattaggtctgaaattctaaacagtaatcaagtgacaacattttaggcctaaatagaattagttaatatatagagtcatgtgagattgtcctttctacctaatacttctctgctaaaccagttgacgtttgccccattttctacaacttttaacaaatatgtcacaacattgtagatactttagaaaattattttaatcattccagacaatatgtgggagttgcgtttttattaaccttgtactactagctctttctacagcattgatcctgtagactgctaagaagcaatctctgaagtctgtctctaaagtcagacagatctgccattaaatccacttagactccttgctagctgtgtgatctcacccacattgtttcagatctttgagcttcagtgtcctgtttttaatttgagaataattaaagtaattacttcatggggtggtggtgaggattaaatgtgataatgtagatggagcacttagttctgtgcctcacgcagagcagtatggtgattctttttaaaattctgtcttctttcagttaccatattgtcttaactggtgttttcttcttctccttgtctgaatctctgctggtccttatttccaactcttaattgggcattgtataagactcttagcctccattattctcttttggaaggtttacacatttttgtctgtcatgacacccaaacaagaaactttcaagtaatcttggacaacttttttttatcaccacctatatcttatcagtcatcaagtcttttgagtgtcttctttcatttaacatgatgcttttgacattcatctaatttgatgcacatatcagtagttagttccttgctaagtagtacttcatgtatgggtgtacttcgattgatccattcaccagtttctggatattgaggttgtttatggcttttggtgattatgaataaagctgtcaaaacatttgcatacaggttttgtgcggacttatgtcttaacttctcttggataaaaacctcaaagtgggatggctggattgtatggtaactcaataagaaactgccaaactgttttcccaagtgattgtatcattttgccaccaaaccaacagtgttttaagagttccagctgttgtgtatcctcactagcatttgaaattgttagacttgctctttattacaaaatgtgagccattctaataggtgcacagttgatgaatgcccctttttaagacataaattactttaaaaatatttatttacactatcatcagtgagaccaacaaataccaacaggtcattcacttttttggatacaggacagtgggaccttgccactaggattagaaagtttctatgaagctttaggtctgagagagtccagaataactatgtacaatgtctccagcaagattgttgcctaagtagagaagttaaatttagtatgaagcagaaagatttcaaaacataatgattcccaaaggccattcagccctctttcaggttcatcacctccttttttgactttttccagccagttgacaaggttccttacaaatgttctgagtgtgcagttgatcttttaaccattattgttgttcatttgcatattgatactgttcacttgataggctattgatagaatgtaattgtaaaaaaatgagcctagtttatgttcttgctttgtcacacttcgtatgctgacatggcaagaatgaaattcctaaaatatctttttaccaacctgctgctcagattatatcttttcgtttctgattttcatctgcagattcctaccaaatatgctcttcttttcccaggaagatcgtgttctaacaggtcaacagtagtttattttctgctagtagaaatgggtttttattcttctacctgagctttgttgagaaatagctgaaatgattgaccagagttaaaggtgaggtctgaccacagacttcctatataaactagctcctatagaaactagctggttggcaaaagagtaaaaccagcaaacctcgttagctcttgttttctaactggctgagctgtgtggtccagttgctatttttaatcatgcccattatctgttataatcccttgcctccagcccttcgtgtctatataactgttccctaagttacatatcatagttcatatccattttcaaaatgagttcacagattatatctcattaaaatcatacttcctaataaatgccacccaaagccattccacacatagatagtcattttcctggacagcaaaaagagttttgtaaaatgccatattcccttttactgctgcctggtaattgctgtctgctccacatgtcagggactaggggaaaggaggaaacattggtaggagatgttcttctgcgaggagattattctcaaaggaatggctcaggatggagcagtggctaataatggagaggatagagaggattcccaggaatctcagtcttaagaatggaatcactaacccattgtcctgtaatctctccttgtagtttcctattaaaaacctctcagctctgtgagctaagggagcagcaatatattgctgttgcctccttactttcttactactcagtgtactctctggcaggaaggcttttgttagtggctaattcacaacggtctcctcaacctaattctattaatattcagcacctgtgtgttgggcacagtgctgagcattagtgataaagccatgaacaagagagaaatggtccctgccccggtggaacttctactctaataccgaatgtgacagtgctatgtatttgcaacagtactgtccttcttttaaaaaaaactgtgaaagaaaattttactgcactattggtactatgcctaccctcaggtgacttataatgctgttggggagaaagacttacaggagaaacactagtaggataagctaagagttaagttgcttgatagctcttaggtgcaggatgtgtcaaatgaaagcacatagaactgtatgctagagtcatcaggaagagaggtcacaagattttgttgtagcccctctgtttattccaaaacagcagccaatgaccttttaatatgagttgtgtcatggtaattctctttttaaatctttcagtggcctccctcctgactctgtataaagtaatgcttgtaacagtatagaagacccacacagtctgcactcactccacctcacccccacctctcttatcttccatggtattccctttttgattctacaggcagcttgatctccttgctgttcctcaaaacacctggcacttagctgcctcaaggacctcttagttggaaatcccatctttccagaacactttctcacagatgtttgcatggtaccttcctcattacataagactagtgatgtcttcccaaaaaacacaattttgaattgtattctccctcacctccctagcactccttattccctttcactgaattatttttctcctttgcactttttaccatctgttatatatgcttatttgtttattgcctatctgtcccaagtagaatgttagctctagaaggacaagaaatttagtctttttgttcattgctgtattcctagtacctagaatagtattatatctggcaatattgggttcatacaaaaagtatttttgaaggaattaatgtagaaaaaagaaaaatgagagcggcactcaaggaagacagaataagcaaagatatataaagagaaatagaataagtattgatatgggaggagataaaagaggccaacctaactataacagataaatggtttcttgtttgaggagagttaaagaaaaagttagatcaataaggtggtacctaagacataaggtaaaagaatcctaagacaaccagcaaaggagtttgggtttcatatcgataaatcagtagagttatttcagattcctaagaagagtgatttaacaaatgatgtttaggaacatcctttgagaattggtatggaagatagattgaaagggagagaaactgaatgttagaaaactatattcttgcagtaatctaagcaagcactgagaaaaagggaagtggtaaagagaaagaatgatgaagacaggtcacatctgcgagaaagcttacaaaacaaatcaaaatgactttgaaattttattaaatgaagaataatggaaaagtaagaatcaagatagctgtaacattttaagactgggacaagggtgtataataaaacagggagccagttgtacagttctagggtttgcaagggttgctaaagtaaaattcttcagtgttccatcaactctttatcattccctaaggaaataatgctgaaaacctagtgtctttcacctctatcttgtctttaaaatcagcaacagaaggtagattgacatgttcacacttgtgttcactaatgctgtatccattgatggtgttcaaaaaacactatcaaatctggctagtgtgatgagccagaagtgagaaatcattgctacatagttaatgcagatttgaaactttctgtagcagcagatgatttattcaggaatgtaataaagcaatttttaaaataagtttgcttaaaaattataaatattaaattctttcctagtaatatgtgggtactaatttgagaggggattttctacttggacttaaagtataatgaaggcatagaaataaaatgttttatataattcttgctggtaaagtttaaaattatttttcattcatttttatctcctttatcttcagacatagtttttaaattcatatttcttgtttactttattctgacatgaataatcatgaaatagttcccaatcgccacatacacatacacaaattatttaaattaattcatgttcttttttccttataggaccagtacttcagacttaaacatgtaatttcagggcactcctaaacagattgaaaatgttgatttcacctttgaaattttgttgtatttcagatttggtgtgaagaagaaaccaatttacattaatgtcataagggatcctattgagaggctagtttcttattattactttctgagatttggagatgattatagaccagggttacggagacgaaaacaaggagacaaaaaggtaatattttagttttaagatttttataaagataattgtttatgaactgcagtgagcaatgtgcttttaaaatttgttgttaattataaatttattacttgcttattgtggaaattttgaagagaacccaaaatataaagaagcaaaatgaagaaaattatatagctgatatattgtaatatacatttttttgtgatttttaaaaatatttcttttccagggcggaatcgtgttttctttatggttctattaacaattttctgtgcgattattgtaattattcactaatatgatatatttttgtgtattttttggttctctaagtattgatggcagtttatatttgtgatcatcagtttaaggacactattttgctgaagcagctatttttttctggcaagaagagaataatggctcaacaaagttcttaacaggctcaaatttgggttgtcttccatttcactgcattttctagagtatcaccagagttacatttctaagaaatcaaactgatttgtcacttctctggtggaaaacctttactgggacttcatgctcatggattaagacataggagacacaactggacacgatctcagacctagctctcctgtctgattttcctttaggtgtccagtgcttcggccacatgaaatgtcaccatcctctgaacttattgcttaagttattaatgcttcatacttttttacacatgtattattccctatattgagaatgcctttcctttactctggaaaactctttatccacctttaagatctagctcaaacatgaccacttccgtaaagtcttttctgatgcctccaggcagtgagtcatatctctttcagggctcccagagcacttcattcaaagctctcttttaagcatttattttgtgatatttggattaccagtttacctactgtcttttccaaaatgtggtgaatttcctgaagcatatatttaattcatcttcgtttcctcagaatttagcatcatacctaggttacccgtaagtgcttaacaaatggttgaatgtgtgaattctgcacattttaaacctaaactattacacagtagtgatgccagatacttggtatgttaatgataattaacatccaacagtatttttttctaagttagttataccctctgtgtcacatgatgggggcagtggttttttgttttgttttcctttttaatgatttctagaaattgctgtttctttagtctcaaagctttaggcagaagatactgatccaaacacagataactaaccaaatctgttttcttaaataatgctatctctcagcattatttaatcttctagaaatatttattgtggagattctgcgaagttttataaaatctattagtataactcttatgacttactactttagaatttattgatatttatttctaaattcacttgtgcgctttctttttattttttattttagccctacttacactaactcttgactcagtaaatgttagtatctgtctccctcctttgaccaaagtaatattagcgtcggtgttggaaaggaaaagattgcagtcatgtaggcccctatatccatcatttatcattgtcagccctggatagcatggttttgtggttcctagcctgtgtagtttgggggattgggtaataataactaataataattattaacagtaataatagctcacatttactgtgcaccataccaagcagtgttttaagttattttatatgtattttttcaggtagcttgcgcaacaattttatggggtagttgctgttattgtcctcattttacagaaaaggaaactgtggggcacagaaaggctaagtattttgcacggtgtcattcagctagtaaatggtagagctggaatttaaaaccaagcactctaattccagagcccatacatcttacatcctttgaaaagaagagaagaaatgcaacatgtcactcgacatttttctgtgaaacgtgatccaaagttgcatattcaatattcacaaaaaaatccaggcagcattttaacatcatctccctttcatgtttgaaagttttaggtagataggccatcctggagctttatctgttcttcaccctgactataataaggcctggggttttgtttttttattttttaacttcgttataaaatacacattaatatgcctgcttatctagatgtagtgttgataacatcagcaaaatactattgcattgtcttacttcttatgaggacagggctgtctgtaaataattgatttataaaaataagaaattactttgttttgtgctagacagaatgtaccttttcagtcttgaaacatattggtgattagacatttttagtaatttggcttgtttcttatgatacacatgttggtaacctaatgctgataccctaatgagttaagtggtgtttattgcaaataactccttaatatctttaactagcaggagttttcattaaactcatctgtaaagttgataagactgcatacatataacatttctaaagctggacaggttttagaaagatattgggtgttaaagggtggccatgattatgttggaaataccttgtaatggcgcttattctcaaaaatgtgtagatagctttatttctataaaattctagattctttgcacctcaagtgatattttgaggtgtattaaacagtattcagttcagcacttatggcaactattatgttttaaactgacgtactctagtaatctgaactgctccgtggttacacttcaaacacattttagatatatgtgcacctgcacctaggatagctttcacttgatcttgtaaagaatggaaggcttttgatttgggagatttcaaatttgcatattttagaactagagttttatttaatttaacctttgcccagtacctgggaaaatagggatattaagtaatccaaagatgagcattgaataactatatcaatcaaatcagtggttctcaaactttttgatataggaactccttttatactcttaaaaattattaaggattgcccaaagagcttttgttttgttttgttttgttttgggttatatctattgatatttaccaatatcagtaaatttgccatttactgaaaaaattttaaaatattaaaacaatagtaaagccatcatgttaacataaattatattttaatgcacataactatttctcctccgacaaaaaaatgaaaagagtggcatcggtttacatttttgcaaatctttttatcatctggcttactatagacagccggttttctttttttttttttttcattttctgtttttttgttttgttttgttttgaaccctgagaagctagacagctgattttcatatttgctcctgaattcaatttgttcgaaatgttcttttggttgaattgaggaaatccagcttcacacagatatataattagaaaagagaggattttaatagcttttcaaaaaattgcggctattctttaataaacactaaaacttgacaagtggtagtttcaaaagttagttgcaatgtagaatctgaaaccatagcagtgaactttttatactttgctacattaaaatctattgatatgttttacactttgaatgaatcttttaaccaagcataattttgaaacatcatacattggtcatttggaacatactggttcactgagttatgtggacttttcaaatgttaacatattttgttatacagcgttaaaaactcatatacattaatatcaccactaatctcatcagaaaagtctttaagtattgggagactgtcaagcttatggtggcagatacaagttttccaaaattttattttttgcttgaaagcttaatttttatcattggcctatcacaggatttctcaacctcaacattattgttgttttgggccagataattctttgttgtggggggcttcttatacattgtaggatgtttaccagcatctcttacttctacctggtagcatcccccatacctcagctgtgagaacgagaattgccttcaaacattgccaaatatcacctgagggtcagaatagcttccagctgagaacccgtgggatatcaacactgtcagtttttccttcaagtgacaggcataatttattcattttgagaaaatatcaccaaatactcaaattcaaatagctatagtttgggatatggtaggtgcatggatatataaggttttatttcttatttcttcttatgagctacaaaatctggcacaaatgataataaaaccactttttagaaaatggcctaggctggcaaatctaagaccatctagaaaaattcagaaataatatcaaatgcctcatgaaaatattttatttcctctgtcttcacctccactagagctatgcctttaatacccatgtaaatccccaaggtgcagtcttttcagtagtcatttacaaatattaatagtgcaagtggtttatatagcactattctatatgctctggaggacacaaatgctactgcttgatccacaaatgctacttcaggaagttttcactgtagttggaaagacagaacataacacataacacatttaaaaagcatatgaaacaagttatgtagataaagatatagacagacagatcaacctatcctaagattctaaaccagatcctaagagctgcctgttacaaggcagtatgtgattttgttttgttttgttttgtttttgttttttttgagacggagtcttgctctgtcgccaggctggagtgcagtgtctccatctcggctcactgcagcttccacctcctgggttcaagcgattctcccgcctcagcctcctgagtagctgggactacaggcgcgtgctaccacgcccagctaatttttctatttttaggagagatggggtttcaccatgttaactaggacggtctcgatttcttgacctcgcgatctgcccgcctcggcctcccaaagtgctgggattaaaggtgtgagccaccgtgcccaactgtgattaatttacatgactccaaaaaaaataagagtgtctcatcccacctactctggcccatttatttaataatttaccacattagatatttgataggtgagacttggatttatggcttacccgtgctgctttgtctttgttctagacctttgatgaatgtgtagcagaaggtggctcagactgtgctccagagaagctctggcttcaaatcccgttcttctgtggccatagctccgaatgctggtaggggagataaagttggctcagattgattatcatccttattatctctgtaatctgtgtttcatttcacaagggctagatatagggaaatcggtgaaagactagactaaaaataacatgtaattcagtaatatctagttttgcagttacttttaaatgcatttaaaagattcctcatgtagagtgatatcctaatatccttgcattgttttctgagatgccggtttttagtatttcttatttttggtgttatgttttgctgtattccagcagagctcttagagactgggggtgggggtgggtgtcataaatcttattttgtccaaagcttactgttttagctattcatgttaaattaagaaaaggcttagtgggttaaaattcacctggttttactgttaaactgattttgactttaagagaagccaaggttatggctgtggtttagtttgctagtaaatatcaagtggaaaataaagatactttaataagaactgtatttcctcagaatgtgttgagttttcagtttttaaaaataattttacgtatttatttgttctattcaatcattttaataggagaagtaggagaaaaaaggaacatattcaaagtttcttccataaaccataatgagaaatacaaggaatgtcttcattatttgagataatattattagattgctgtggagtttaaggtcctactcattagattacatcaaagcctcataatagtataagaattggaagcctataaagaatgccttctcaatttttaaccatttctttagaacagggattggcaaactacaggttgtatcctgcagacccagtttggcctttcacctgttttattttttatttttttgagacagaatctcactctatcacacaagctggagtgcaggggcacaatcttggctcactgcaacctccgcctcctgggttcacaattcttctgtctcagcctcccgaatagctgggactacaggtgcctgcactaccctggctaatttttgtatttttagtagagatggggtttcaccatgttggccaggctggtctcgaactcctgacctcaagggatccacctgcctcggcctcccaaagtgctgggattacaggcatgagccaccgtgcccagctgtgtcacctgttttataaataaagttttattgaaacacagccacatacatttttttacttattgcttgtggctgttttcacactgcagcagcagagttgagtaattgtaacctaaaccatgtgtattagctgttcttgcattactgtaaagtactacctgagactgggtaatttataaagaaaagaggtttaattggctcactgttctgcaggatgtacaagcatggcaccaacaagggcctcaggaagcttacactcgtggcagaaggtgacgcaggaacaggcatatcacatggtgggagcaagaaagtgggcagtaggggtgggggtatggttcccagactttcaaacaaccagatcttacgtgaactgagcgagagctcagttatcaccaaggggatggcactaaaccattcatgacagatctgctcccatgagccaatcacctcccaccaggccctacctccagcattgggaatcacatttcaacatgagatttggagggaacaaacatccaaaccatattattctgcccctggctcaccaaatctcatgtctttcttatatttcaaaatatattcatcccttcacagtagtcccaaagtcttattccagcattaactcaaaagtcccaagtccaaaatctcatctggagatgagttccttctacctatgagcctgtgagataaaaaacaagttatttattcccagtaacaatggtggtataggcattggataaacatttcccttccaaaagggagaaattggccaaaagaaaggcgcagtaggccccacacaagtctaaaacccagcagggcagtcattaaatcttaaagctccaacataatccttgacttcatctcctgcatcctggtgcaaggggtgggctcccaaggccttgagcagccctgcccccatggctttgcagggtacagcccacatggctgctctcatgggttggaattgagtgtacctgtagtttttccaggcaaagcgtgcaagccgatggtgagccaaccattctggggtctggagggcataatcaccttcccacagctccactaggcagttccctgtttgagtctttgtgtggggtgagggctgcagtgcaacccagttctgaaatctaggtggaatctgcaatctaggtggaatgcaagctccttcatgcttgcattctgagcatctgcagacttaacaccacctggaaaccaccaatgtttacagtttatgctcccccagagtggtggcccaagctatacctggactcctttgagctgaggctggaactggagtggccgggatgtggggagcaatgtcccaaggcttctcagggcagcaggaccctgggcctgcccccttaaatcattcttccccccaaggcttctgggcctgtgatgggaggggcagcctggaagatctctgaaatgcctttgaggcctttttcccattgtcttggatattagcagttggctcccttttagtcatgctaacctccttaataagtgattgctccacagtgttattaaattccttccctattccctgccctattccctggaaaataggctttccagtgggagtggttgctcatgcctgtaattccagcactttggaagaccaaagtgggaggatcacttgagcccagaaatttgagactagcctgggcaacctcatctctacaaaacataaagttagccaggtgtggtggcatatgcccatagtcccagctacttgggaggctaaggtaggaagaacacatgagtccaggaggttaaggctgcagtgagccaagatccagcctgggtaacagagcaagaccctgtctttaaaacaaaaaacaacaaaaagagggggctttccttctctaccacatggccaggctgtgaattttccaaatgtttatgctctgcctccctttaaaatgtaagttccaactttaagtcattcctttgctcttgcatttgattgtagcctcttagacacagccaggccacatcttaaatgctttgctgcttagaaatttattctgccagatgtcctaagtcatcacttttgtgtgtgtgtgtgtgttttttgtttttttttttttttttttttttttttttgaggcagtctcactctgtcagccaggctggagtgcagtggcacgatctcggttcactgcaacctccgcctcccgggctcaggcaattctcctgcctcagcctcctgagtagctgggattacaggcgtgtgccaccatgcccagctaatttttgtatttttagtaaagatggggtttcgctatgttggccaggctggtctcgaactccagacctcaggtaatccgcctgtctcggcctcccaaagtgctgggattacaggtgtgagccaccgcacccgaccagtcatcactctaagttcaaacttccatagatctctagaacttggacaccacatagccaagttctttgctaaggcataacacaggtgacctttactccagttctcagtaacttcttcatttccctctgagacctcatcagcctggacttctgtccatatttctgtcagcatttttatcacaatcattaaaccagtctcgacttaagaaatttcaaagtttccctcttcttcctgtcttcttctgagcccttcaaattcttccaaccgctgcccattacccagttccaaagccactttcccattttcaggtatctttatagcaacacccaactccttagtaccaattttctctattaggccattcttacattactgtgaaggaatacctgagatggtaatttataatgaaaaaaggtttacttggctcatggttctgcaggctgtgcaagcatggcaccaacatctgtttggcttatgatgcaggcctcaggaagcttacaatcatggcagaaagtgaagtgcgagcaggcacatcatatggcaagagtgggagaaagagagtgaagggggaggacccagtcgtttattattattattattattatttttgagacaaagttttgctcttgtcgcccaggctggagtgcaatggtgtgatctcggctcaccgcaaacctccacctcccaggttcaagcaattctcctgcctcagcctcctgagtagctgggaatataggcatgcaccaccatgcccagctgattttgtatttttagtagagatggggtttctccatgttggtcgggctggtcttgaactcccaacctgaggtgacccgcccaccttggcctcccaaagtgctgggattacaggtgtgagccaccgcaccaggcccccagtcttttaaataactagatctctaatgaactaactgagccaagaactcagtcatcaccaaggggatggtgctaaaccattcacaagggacctgctcccatgatccagttacctcccaccaagcccagcctccaacactgggaatcacatttcagaatgagagttagagggaacaaatatccaaaccatatcactatgtagtctgcaaaacctaaaatatttatcctctggccttttatataaaaagtttgccaatccctgccttagaacaataaagacttgctctattgggcatttttgagaagttaattgtatttctttagtatgtttcatagattcacagaactgggagggttcttagaaaccaattaatcactgttcccctccccctctttgttttttttaatagtttgagaaaacaaaattgagaaaggtgaagccaccagctcaagatcatactgctacttaaatgcagagctagaatttggattaaggaatatttgtgctaaaaagaacccaaaagtatagtttattttggatcaaatctctgttaatagcattagctgacaatgtaaattaaaataaaaataaaagattcttagcagagccattatctattttctgttcctcagaaatttcagaaaacacttagctcacaaaaacccgaaactcacacaataagcagtaaacacaaattgtttacactttgctagagagctcttaacagaatttagagtagtttaaaaaagttaaaacacacactaaatcatatgggaggggtgtatgtttcttatatccatatacatttttaaagtgcccttaaactaaattgctcatgttaagagtcctctggtaaactctgaattagcactcatagttgagcagaaactggagatggaagcaaatgaaattggaaacaggtgtgcctcccacaggatggtaataaagaggcattgaggctttggatatacatgtgtttatctattttctctgtaatatatggtgtcaaaggcaccagaaacactcagcagatttcacaaccaggttttaattccttttctttggtttcaggaatgtgggaagcaggtgggctatggatcaagccaagtataacctaattaatgaatattttctggtgggagttactgaagaacttgaagattttatcatgttattggaggcagcattgccccggtttttcaggggtgctactgaactctatcgcacaggtatataaaggaagggtttctttttaaagctttctttggtttggttttttggtttgcaacttgtaaatatgtgatttgaagtttcttcagtgaaacacaacagatagctccagaaaggcaggtatcttgtcggtttctgctcactattttcaattgagtaactgtgaattaggtgaaaattagaaggcactgtagaaatagtggaatgatacaaagtacagaaccagccatagaaatgtatggtattcaataatgccagatatcaaacattaggcctgtgtataagtcctgcctactaccattttgaagtagaggtgtgataggggaactgaagtatgcctaagccatgttttagcagcctcagccgtattatcatgtgtctgaaagtgataagctaattgtgtttttgttttgtttcgttttttgctattgcttgataagatgcagtcataggaactcttctccttgaggatgcatatgccctagcttctaacacataattttagagaatacagattatgagaaaatagaatacagtttgacaataggtattttatcaaaaataaactagtctcagagcaccaagcacttgagaatatagtgtgtgaggtgacagcctacactttactgtgtgccaatccttacattgactatttgacatttcattaagtctttactaggttaaggattaacattctaaaggactgaatcatggctctagtttgatcaaggctccgtttttacctgaattatataagacaattatgttacctgttcttaatgtgtcatattaaccacctcttcaaataaagaggcattgatcttttgtgtgttctccaagaattatttacctttcctttttttccccctttgtaagtaggaaagaaatctcatcttaggaaaaccacagagaagaaactccccactaaacaaaccattgcaaaactacagcaatctgatatttggaaaatggagaatgagttctatgaatttgcactagagcagttccaattcatcagagcccatgccgttcgagaaaaagatggagacctctacatcctcgcacaaaactttttctatgaaaagatttaccctaagtcgaactgagtataaggtgtgactattggattcttgaactaaaatttgaccctgtcttcacctttgttctcagctccacagtctggattgctgacagtaggtgtatatgacaatttgtattgagccaaattaggaaacagacagtaacgtcaaggaagtagatactggctggcattgtcagtgttctaagtttcaggcatttttatttttcctggctaaacgttggtgaaagttataacctcctgcctgggagaaaatatacatcacctaaaatgaacttatggcaggtctaatcaaaaggctaaatacaatttcagaaaaggttctgatactcttgtttttgataaagcattttttcaactaaccatgaattaagatgagtccatttgcctcttctgccttcactgagggtttgggttatacacctctactgaattgtgttaataactgtttggcagtgtgtactttgtttttgtgagtcatgtctcatgaaatttattggaatgtttaatcatatttgctaagaaatgtttctgctgtagttggatttgcccatatttatgtaggtggttttaattttttaaatggtgattagtgttaaaaatcaatttaaatcatgactaatatggtaaaaagataaagcatcaaagcagtatttctcattcctgcctcctcaatatctaatactgggaagatacttcaaagaatattgagattgtctgaagttttagttaagattttcacacattaatatcaaaaaagtaagtttagtatttgtttctccatgggttatttgtaaagctgtaaactgagatatcggtgactccgtattatgactccattagtgagctgtggtatgggtaggattttcctacttcttctgtacttttacctgtagactatttttactaaggtgctttataatgtgttttaaagcattgcatttacaaaacaaggaaaatgctgtaaatattgcatattttatgtatttggaccaaaaggttacaagtaattagacaaaagtggttttgcaccaattttatgtcaagtaaaaccatcagacctactgttcttgtatttctcatttaactttactgttaagacatcactgaaatgaacttcagtaagctttcaattttgatacacagttcattattcataacttgaggcagtaattacagtggaatgagtactggacaaggagtcaaaaaacttgatttcaggtcctagctctagcacttacagctgtgtgatcttgggcaagtcacttaacctctctttgcctcaatttcctcatcttgaaatgaggataataatacctgctgtacctacctcacagggctgttgtgaggattaaatgagatggcatgtgaaagcactttgaaaattgtaaagcgctatgtaaatgtaaggtattatagaaacatctttaacatatagtttcataccattcattttttaacaaagaaagggaaaagtctgcttgtaagctggttgaaaaagttaatcttgatataaatttgtgtttgataaatatcctctcagtgttttatcttccatgtttcaacaactattgaaatatgaaatgcctgtgaactcttaaagcttcatgagcagctgcttgagttcaggaagttcactgttagaaataggctttgttagctgactagggtcagggaaacttttctcttcaaatttgaaagctgtttctgttttcattttacattattattcagaaatggtagctattctatacctatggtttaagtaaatatttctgaataaggcttcaccatactgtaagcattttaggtagattgccttaaaggttatgggagggcatgagggaacacttcttatgagaaaacatttataaacaaaagaaacatttataaactaaagaaaaactaaaagaatgacagaacaatcatcttagcaccctttcctcacaataatataaaaatattaaaagaacataggcaggctttttttaaatttggcttttttctttccttttttcaaattgacttttataggtatttcctgaaagtgtatacaaattatttcctcgcccaaaataaagcaccacttcaaggtgtggtttgacattacatgctaatgaacaaacccagtatgcaagttattcttgcaccacatgctcaaatcttcttgaggtgcattaactcttttaggtaactagagcagtacttggtgaactagatcaggaggtcagtaaactttctgtggaagggccagagagtaaatattttaggctttgcagcccatacggtctctgtcacagctagtcaaccctgccattttaccacaaaagcagcaatagacattatgtaaacaaatgagcacagttatgttccaataaaactttatttacaaaaacagatgacatcccagatgcagaccatgggcaaccaaccattgcactggccaaatcattatttatggagaaatcctctttgtgtctctactctagatgcctaaaagagtttatatacttctaaaagctcctaacttatatccaaagaattgctttctgattcgtgtagtctctcccacagattcataaacttttatgacttatattgtttccaggtgggcatggtttatttcccagtttaacagttcagaataggggcatttattttatcatattttagggtgggttaggagtatcctttctggagactgagaaaggggtgtatttaattccatcaggtccagtacagtactaggagtcataatactttataatcaattaaataaatagaaccactgagacaataatgtatttttttaaagtggcaaatgtggttttcttttttcagcctttgcgctttttcagtattttgaccatagggagataatttttttataatacaaaagtaaccacttggaattttaaagataatgttatgtgtgtatgtgaaatatatatacatatatatatatatgtttatttcctaaaagaagaaaagatacctttctgttcaacttgtatcaactcctcttttctaattgctgtgaaatggcaactgttgataaattattgtgattgttttaaaatctaatgggaagtaaaatatattttgattttacccagcttaatctgtaaagtagcacttaaatatatctgatagcaacacttaagatattgcatggggattactttcctatcatccatatgcatttgtgcaacttcaaacatattgggtgcttctgaattcctgatgattggatttaagctattgaaaattggataatttaaacttaatgatttttataattttctgatcttaaaatttggttaatgcctataatctgttgctttttctcaatatgtgtcctattggaaattcctcaaatcgttggtgccatcagtgatttacaaacaatattttgatattgcagatgacttgcttactgtatttgcattgttagaaaacagtttgtagacaatgattcttttttaataaaatcaaataattctaaaagtgctagagaatttaactaaaagctggttcccaaatgcatagctggcattttaatttaaattcaaatctacatagagaacatctgtgtaaatcatctaactggatttttccattggtcattcccaaacacacctatggtcctagaatccttaagagaagcaccctgtaaccttttatgtggtttgcctttaagaggcccaggtgcttctcctttatgatttgagttggcctcttcataaattagtgctgtttactttcagaggaagcagagaagttgctgttatgtttttgcatccgtttaccctatgcaaagttgctgtatgatgccaactaaactactctttaggcagccttctgaggagaaaagcaaccctgtttcaaatccactgccaattcagctcctctggagtggagctttctgatttcttggagcaggaattttagagattgaaatgaatgatcatttagtcagatttatcctgtaatttcatgcagctttgtggcctttgcagtactatttataaaatggaccctgatggtgatgaactctttagaacgcattactgttaagcctgtgttgagacattgatgctgtctatctcattttttagacagtttttgtagctttctattgagagtcaggtatgtgagcatctctgaagcagtgttgaatgtaattttcggaaacatggattgtgtattttgacttttattttataaatacacagctcaacagtgccttttttttccctcatagtcctgttggaagatgctcactactttctctcttctctctccctgccctcccccactccattcagttgattcatttatgcaaattctgtttccaacttgaaaccattttgtcacatctgttggagagataatcactccttttccttaacattctgccagctttctgatgttgaagtgtttcagttgactacctgatgcaaaagctataaaataaacagtgggaaggggaaaaattggtgtcctgttttaatattttcttttgtagccttgacactgatggacattttccaagctgactcagtgttcagtgtcaacttaactctcagatagtgttgccatcaagaaagcatgcaacatcattggtttctaatgattttatggcttgtgacaatattttatctggactgacatgcctctgctgcttttgctttgtacttcattgctggtaataaaatttcagatggaaaacttacaaaatatatacttaattagaagaaaaaaatagagaaagggctattagaattaaaaaaatttgaaagtaacttaatctaacatttatggcacagtttggacatatccataattttttttgggaacacacatttctgattttttttttcccccttaaagaagaaagtctcaattccattgattttcaattcttagccactggctcattgctttgagcaatgcttgattgattctatttatattatatgatattgggttgataaaataccagttcaatgatgagttttcttaacagaatttggtttgtacttgcagtggctgaacaaagagcatggcttgagaatcaaagggatctgcatttagcaatgtgatgtcagtaaatggacataacaggattgttgtaaaggttgggcatgatgtatgcaaagtactggccagggtagactaataactgatggcatttatatgctgtgctggaatattgttaccaagctgatgtgccgttctcaccctgcagaatactggttttgtcatttcataaatgatatttttataaatatttttgaatgactgtactttttactgattatcttaataccgcctcacttatgtacctgtagcataaatattcctggttctgattcttgctgttctttccacatacaaatcactcatttgtacagattaaaggggggaaacgctgactgttctaaagaagataggacttgcttattccagaaatgactgagttcatatcttagtatatttgaacagtaaggactgctaaatagtacacacataaaattcaggatcacaggaatgaaatgatttgcactctttgaacagaaaggacagcagcagtgtaaggaataggctctcaagctaaaaactgagaacatgaaaacctctgaggacctgactgcagttgtcaagaaaagtagagataaggttggggagaagcagacagatctcagggccagaaacgccaacatttggtgacaggtgggatataatcaataaatggggaatgaaggcattaacttgggtttgtaacacaatgcatctgtgcaaattttcagcaccccttgcttttgcctcaattaggcaatgatgattacttcctgtgtcaaagcttataaaacagactagtgttttcccaaagaacataggatcacaaagaaagaattcactgtctccctatcagatgtttggcttccttgcctcttttgctcttccagattttgtgacctgggttagagtttagaaagaaccccctagaaacttttctgatgttctctggtttgatgatgaaggcgtctaataaaacacatcaactctaagcctctacctctacttctctaaacctgaagtttagaaatgaaagtcatgcctggaaatgtttcacatcattagcactgacagcgtttacagggaaatagagaaaacgtatatggattaattttcttttagatcaagggtgtgggcaactagatttctagagccttcagcctgtctatcggtgatgctggaaaaggaagaggatgagctgtaagtgcagtaactgacccctgtctaggttttcttgctaaatacgccctccatgaaacagacaacataagtattttgaactgtaagaatgttaagaaatttctgtccctgagcagcagatcgaagagtgattattctgggattctagaatcagttcattcttttctttctccctctccctccgctctcctttctttccagtttaaaatcactcagtctcttagtagaaatttaacatcaaagaactgtcaaacttgctaatttgtgattttttaagcatgtgccgccttaaactatcaaagctttaacctgtatctaattaaatgttaaaatctggcaaagagtagacctacagtccccaagtgatctggtttctgaactttgttttgctttcacaaatgtgagccaatttgccctaaatctgggtatttcatgtagcatcttgagagatgtatttaaagtgcctgtggcaataacatttcatttgtacccattttgatgattctgggtgccctcttgataaggcagccaggttgtgctgtaaaaaaaaacaatgtagaggtttcagtcttaggtgtttgaaactgttggatctctcaaaattgattagctgaaatataccttttctgcgtaactgaattcaccagtaattccatttgaagcgggcagagcctttctgaaaatggatgatcagaaatgagtgacattttattcaaccaagagttaccagagacatattttttttcctttaaaagtaatttaaaattcgccagaggattactaattaggtctcttggcatagcatggttatctgatcagactgtcatgcccataaacagtaaaaatgcagcatgttgatccattcatgtctgtttttaaaggaggctgtggactttaaactcctctctcgcaggcttgctctttgtttcatgtgggggctctttgaataacaccttagatgagaacaatgtttaagaaataggccagttatattttgcttttctatttctaccatgctaatggctctctacttgatcgtttaatcactgatccaaatccagatggaattagatgctccttcctgctgtagtcctgcagtcagacagtctgtaatgtttgatacggatcttctgagtggacaagatgagattagattagtctctctgggagccagccctattcattttctaagaaagttatactggaggcctgaggactgccaagagcaaagtggaaacagagcccagccttttcctcttatcaagatccacagtagttccacattaagtagtggagatttgaataatattggatcagaatccaggaaggaggtccttgccacccacgattgaaatgtgaacttcatgtgttacaactttattaccttttcttattttaatatatgacaaagactgaaatctctggcatggagtcagtggcaaattttacttttgtgggtttttttttctacatttagtatttattgagcccccactgtttgccaggcactgcactacaggctctctctgcaccatgagcttaacctttcagtaatcctcatattcaatcctttacaactgtttagaactttataatttacaaggcgctttcatttcacatttatcctctcattagattctcacgtggaagggtagataccattatcctcgttttacagttgaaactgacacagctaggaggtggaagatgggctccccagccctcaagattcctagtccatcaaaccctgatgcccttcctgatatgtgcctgtctctcaaagtcagcaagggctgtaatacagattaaacaattgcagtggttcttaggctataatcccatctctggaccaatagtgtcagcatcccctaggaacttgttgaaaggcagattcttaggccctagccttctgagtaggacctagcactatgtttattaataagctttcaggtggttctgaccaagactaaagttaagaaccactggtctagagcaccagtttacagatgagacgactgaagctctagttgagcttaacctagctggttaagtaacctaaggcttctcataacaaaagttgtgaactaggatgtgaacccaggtcagtctggctccaacaccatctgttttctacattggactgcgttataaactatagtgtatcttatatatttcattattggtaaattcctctctgaaatatcgttttgggggaccacagagcaggtcaataagaagaaaaaagtcccaatgtgctcttctggagtaaggcaaacaatgccaccccttctaatgagtttctgttttctgtgtgaggtgaatgtgggggctaaacctcagcgtggctactagtgtgctcaggaaattcagggacagagccgagaatccaaaatggctacccaaactaagtgcatttcatctggactttctggtcccagtgttctttggtcatacttaatagtttactgtgatggatttaatggcaagagggctccttgccctggcttggcaatatctgtggagccatgggttgacgtagtgtgggaatacttgtggctacttggaaatccctgttgctgtcatcattggcagtgcttcccagccgagattcttagtctgtggtcacgtgtgaactcttccagtcatgcagcttaaacagaagtgcccacttgtttctcacaaattatatctgcatttttttttctcctagaagcaagagcccagaccaagggttagtcgatagctcaagggacttccagggaaatcagaactgatcttcgtgcatagcaatgcttataggcttccttccacacacactgagagatcagcagggcagtggactgagccttcgggtgcaatgcatttcctcaacacattctttttgaaagaggaagattgttgcccatgtatagtgtacttcttatgtgccggcactgtaccaagtgctatgcatttgttaacactcatttcatcccccctttttttttaagagaaagaggatctcactctgtcacccatgctggagtgcagtggcacaaccatggctcactgcagcctcgaactcatgggctcaagactcagcctcccaaagtgctaagattacacgcttgagcccccatggctggcctcatttcatcctcttaatcctctgaggaaggtactactagcagccccattttacagatgagaatgaattagaagttcagatgctttcttacagtcacacagctagaaagtggtggagcaggattcaaatccaagtctagctacaaattttctgctcttaaccatcctgttgcataggctctgacagctgtgacaggcagtagtggggggttgttttgaaagtcttgccataggctggatgcagtggctcacacccgtaatcccagcactttgggaggcccaggtggggggatcacctgagatcaggagttcgagaccagtctggccaacatggtgaaacctgaggtcaggagttcgagaccagcctggccaacatggtgaaaccctgtctctactaaaaatacaaaaattagccaggtgtggtggtgtgcgcctgtaatcccagctactcaggaggctgaggcaggataattgcttgaacccaggagatggaggctgttgtgagccgagatcacgccactgcactccaacatgggtgacagagtgagactccgtctaaaaaaaaagtcttgccatgtcttttctgcctcttttacacagccccacagggcttggcaacaggaaaagcatgacctagggctatggcagtcacccatgtgggctatagctatggctgcaactcagtgcggcctccaacgacgaggactgggagtttggaggggcaaatttaggccattttgttttcttgaaatgcttcctcctagtccctaaattcagtcccaggtcaataaatggcagttagttattctcggtggtcgtggtgatgtctaaagactgacaggattcccagattcaatgttgggaaaatcaccttgagtccacttttcaatgtgctggggagtgagtacaggccaagttcaagtcatcagttcccagcggttcagccagcgtgtcttgtgaattctcccagggctctctggttttagcagggtctccatgtgcaaaccttgcctttgcacaagagccaccatggcaggaggttgaccaagctgttctggggaggtgaaaggtgctgagaagttgatgcttcctcctaagtgctgtatggagcaggcttggcccagatccaacatgggcacccagcaaagactggttgtctcctggtgtccctgcagccctcccagccatcccctcacttcccactgtggcatgctgcttacagctctctccctccacatgcctgagggcctttctgcaaagaggggttcagagatatccatgaccagccagtctaaccttttcagggtgggagggcagagcagaagttttacagtggatacgaggcctgaagccaaaggagtaaaacctctgcctcatgggagtccaggcatgcttaggcaggaggggtggcaggtgggtaggacagcctcttgactccagaaatctcacttcataagtggcacctgctctgagctctccagatatccctgaatttggttttaccctctgttcttgcctcttcctgtctccctcctcctgctcagtccctcaccacaacattccttttgtgtttagggagatttcctagcacctccctggctaacagatcagatccatctgagtcacactgagcctcccatttagtaacttaggactctggagtccgggtggcctaggcgtcatgccaaactcactactgctaatagtaatgctattataatggcttttatacttaaatctcctttcttccaggagccccaaggtctttaacaaatgcaagaattacactactctccaaaaaatagaaactgaaggaaaatacattccttattccaagtctactccttcatggccttacatagttgctttgaaggatggatctttaaagattcataagctttggtgggtgagtggggtggacaaaggagataggctttcttattgcctgaggccccaccagtttcaccatcttatctttcgttggttttgcagctcaaagaccttgaaactacatctggatgagtctaataaactggtatcttagaagaagagataaggttcaatacgaagatgtttggctctcatacccccagaggttatgggcccaacagatgctcactgagctcagcttgtcattgcgtggtttaggacagacaacaaggaaccttgaaggatggagtcagcttaaaaggcaagcattaggtttggctacacacccctatccttagcacctgtgaagatctcagagtgcaaagagaaatacagatcatggcccactcctctatgcctggcactgctgggtgcagaggaagggaagaagcaccaggggtgggcttggccaggacgtgccctcctttcaagggtccagccaccttgtttaatgtaagggaaagagaattcatcttgatgccaagcaacatagcttcccgttctgactgcaccttttctcacctggcattccctcaatgtccaccaggttgctttctttctgttggaggagaaaatgctatctaactttaagtattaagatctgatctcctgattcaaactcattcttcacactgatgccagaaagaaagtttctgtcttccagagagaaagttcatgttgcttcttccctcagaaagtctcagtggcttcccacccactgtgggaagaggtgcggctcctttaaggtagcattcaagaccttctatgctaggtccctaacttccctttcagccttgtttatcaccacagctctctggtagcctggaccaaccaggtcacttatgcctgctttcatacctttctccctgttcttctcccagttctctatggaaatctttctcaccgttcaagacctagctcaaacagcatctctctgggacagtttctttgatcctgaaagtcagaatttactgtttgtcactacactcacaaagcccattgcttgttcctatgttcaataatagtgacatgggaagcacatgctttttgaataagacagacgtgaatttaagtcctggctcgctcacctgtcatgtgccttttggaaaatcactaatctctaagtttccttgttctaccaaaagtaaaaccaaagccaacttcaccttatgtgttgtaagaattgaatgaggtcatagctctaaaatccttgggagaagaacattgtgggtgagctgaaggcgtcagcgttccctaacattttgttcttggtattgtccacctgcacttcttccccttaggtggcaaactccaggtgagggccttttctggctcttgatgttggccccatccaactccaacaccatgtcttgtatagggacactcactaaacatttacaacattgaaagcacttaatttctcagttcctcagtttctctatctggacagtagtgaaaaagaatagcaaaaaagaacattttgggctctgaagaaaaactccccatatgcccctcccaggacggagcctattgttaattggaaaataaatagttctcagctgagcatgtctttgcctttcatggggccccctgcgatgctgtttgggagacagttacagctactttgaggataataatgactgccccaaactcctgtggaagaatgttgggaagataaatgagataatccacctgacagctctttgagctcttatgaaaaagatacccttgaaatgtaggatacaggtgtgccttgctttggtaggtgaattttggagattttataaaaatctgaacctacaaaacagacaaattaaggggtgaaaattagcatcgcaaacagcctcttggtttgacagaaagattcacagcagggtccctttaaatagccagctcccctggtgcatctaaaatatgactcaatctataaagaatttgatttacatataaccagtcaggaacacttctactacagaggaggaagcacatatgttttttataataaaaatcgataactctggggttttaaaaatataaaatatttctttcttctcatcatctttaatcctgcagttaacacttccactgctaggaagtcgcctaaaaaacaactgcatgttctgcagaggccgggccctcacgagcacagctccaggagtgtgcaggtagaaaatggctgttcagctgatgcccatcacatctaaatgcaacttgctgttcctaattgggctaaagctttttttttttttttgagacagagtcatgctctgtcaccaggctggagtgcagtggaatgatctcagcttactgcaacttctgcctcccgggttcaagcgattcttctgcctcagcctcccaagtagctgggactacaggcgcgtgccaccacgcccagctaatttttgtatttttaacagagatggggtttcaccatattggccaggatggtctcgatttcttgacctcatgatctgcccacctcagcctcccaaagtgctgggtttataggtgtaagccaccgtgcctggcccatttattttttttaatttttttgaggtggagtctcactgtgtcacccaggctagagtgcagtggcgcaagctcagctcattgcaacctccaccaactgggttcaagcgattctcctgcctcagcctcccaagtaactgggattacaggtacgtgccaccaagcccagctaatgtttttgtatttttttagtagagacggggttttgccatgttggccagcctggtcttgaactcctgacctcaggtgatccacctgccttggcctcccaaagtgctggtattacaggcatgggccactgcgccctgccggctaaagcattaacttaatgtaagattgaaagcaagtggtagaccgctgacatctgaaaaagtaaagcccagccttatttagaagcgggacgatatttggcagatgcaggagcttctagaaatgagtgagctcattgttcaactttcctctttgggagtctctcaggggtgtgtgtgtgtgtgtgtgtgtgtgtgtgtgtgtgtgtacatgcatgtatgcataacagccagtgcttggaacaatctcccaaagatgtccacattcctaattcccagaaccttcacatatgctatgttacatggcaaggggaaattaaggttgcagatggaattaagtttgctaatcacctgactttaaaacaggaagattttcctagattatccaggtgggcctggattatctagtgtaatcacaaaggtccttaaaagatggaagaggaagaaaaatcagtgtcaagtgatgccatgtgaaaaagactggcctgttcagtactggctttgaagatggaagtgacaccagcctagtgagacccatttggacttctgatctcaagaactgtaaggttatacattcgttttgctgtgaggcactaaatttctggtaatttgttatagcagccatagaaaacaaatctggtagtagggaggtgggtggtagcaggggttattgcagcttcactgcatatttcatgctgaggaggcccgtgtaaaatctctgattgtttttgtaaacatggatgcaaattcatattcaattgctacaggccccatgtgtctagaaccacattctaaccaacaggcgagatgcaggggaaaacagaaatattgtgggctggcccttgaatcatcctgtgtgccacacaggagaagacgtagaatttcctctaatgacaatgactgctttcttctggttaacttcccacttgtaggttaccccacaaagccaatggcacaagtatgaacaattccaagttcctcccttcctcaaaattactgtgtctctaggcccctcctctggcttcagcagctccctctccatgcagagccctggttctagccgaccaaccatcttggagctcctctatgcctcccagcccttcccttagtccctccagagcaagaggatgtggtaagctggctggcctgcctgagcatatcctagaaaacggtttgtgttggaggagcaatggaacactgctctgcctttgacagcctcctgacccctgagggttcaacacacttgtctccctcacctgcccctggtgggttgccctcttgccacttccattgatgacccctttgcaccttcaactgaagtctgcacccactcccacctcctctcacagcctcagctcatccctgatgactcagatcaagtttccttagggtgaaatgaagtggggtgaagctttgtctgcttcttagagttcagggaatacccaaaacaatctaacagtcacaccacctgaccaactttgtgaccttatccacatgaggagaaggcaagaatctcaacagctgaagtgtgccagaaacattatgttttgttttagtgaatccgttacaagtccccatttggcttgctgattggcaatttcagttactgctggatagtctttctctcgctgggggttgtgtctccattgtaggtggcttattactatcacaacagcctgtgtgtgtgtgtgtccatgcatgcacagaggggccctctgacccaggttgtccatccacaccagcctcccaggtctgtatcaccccatcccacccttgatcactgatacccacaggtttgtggctgccctctctcaccccccactgcaaggtctgtgcagatttgactctttcttaactactcctgtgcccccttttgagggcctgtagggaattctgctatgcctctgccccataccccacacaactactctagggctgtgggaattctatggggctgtcacaggcctctcgatctgggcacacccggaatcactttctactctgctgctcctgtccatgctgggcacccaggaaacagacagtggtgtctttgctcttccatcccacaacctcttttgttgttctcttattcccctccatcctccagggggcagcagtaatgcagctctttctcagggaccccactgaggagtcctctctttccttctgctctcctttggagactccatctcatcttgggtggcaagtggggtggatacaccaaatcttttatatcttagtcagacttcacttttgaatctcaaaactcaaacagttggatcttgggtgctttagttccactgggacaacttttctttgacctagaaatgccacatgtgggagggtcacaacacaacagtgacactagtgaatatatctctgcgttgtccccatatgcggcaaatgggtgcaagatgctgcctgccactcactgtgcaaagactacccacaccaggaaaaagcagagcctgtgctccatgaatctgcaatcacgggcatctaagcttagaatatcccactctgttgcaagtgaaaacatgtaggtgtatctctttggcccaactcaaaaggtagatgttttctcccttttaatacagtcacttggcagtttcagctttctatgaacattcttctggaaaagaacctcagctcgttgtgtagttaaatttattcagcatataaatctcttaaaatccatgcccttaaatgtttatggtcatgtgggatattatcagtgtcagagatgggcagggttgaaggaatttggggtcagactactttcttttaatcttctccaaacattttaggtttggcaaaacttgaattgcattttgccaagcccctgtgcctgtaatttgtaaacccctgtgtattttcagttaaatgtagtccatatgtttctgattgatttacacttaactcatctaaacgttgttttgttagtgttatttgatgtccaaagggcctcagagcctgtttacatctgtctaagctgctcgttttcctccctgagactcaggaagatctgttttgccaagagtaaactaagtcgaatactgcaccgcccctccccgcctccaccccctaggattggatcagacttgggtagaatctgacaaagagctgaggaagttgcactgggctttgaagttgaccaaacactctaccctacatttcaccaagaggaatcagagcgcaaagcctcccccttggggactgtgaccaataacacgaatacagagaccagatcctaggccaggccaacttcccagcctggcccttttccttatggcactgacatttggctgcaactagccaccaccgacctcaataggcccgtcccttacaactctttcatccaagcttcagtgggaagggtggaatagattttatacagtgaatgaaagcaatcaggcctcttgctagatctgtggtaacaatctcataaagcaagagtgtggttttaaaatgaaacaaaagaaatccttagctagtgccccatttcactgaaccttaattttagatagcttgcatttgccttgcaaatgagtccacaaattaccaagccacaagcatttaaaaccatcctgcccactgccagaaggagtatgcctggcagaaccaatgaggctggccccctactgctccaccacagtaaaagtgagttataggagtgatgcttgaactgagatggcatcccacaattttggaaacatggtaactagggatggggacaaactgcaactttatgattcaacattgagggaaatggcgctttgttttgaaagaagcgcagtggctcacgcctgtaatcccaccactttgagaggcccaggagggcagatcatgaggtcaggagatggagaccatcctggccaacatggtgaaaccccgtctctactaaaaatacaaaaattagctgggtgtggtggcgcatacctgtaatcctagctactgtcggggctgaggcaggagaatcacttgaaccagggagtaggaggttgccatgagccgagatcattccactgcactccagcctggcaaaagagccagactccgtctcaaaaaaaaaaataaaataaaataaagcagcactttaatgtgtatttggtcgtgttcaagcaaactctatttggaatggaggtatttgagacaaagaggagccaagtaactctgtaaaatactatgacgggttgtcttctctatatgcagagttgcatctcagagataattatttcattggacttggaggaccctctgggagatttctctcttttttggaccccaaaatgtatcagggaagccagattctaggtagaaggaacatggtcaaagcatttggggaaaagcaggctggcccctgaaatgagggacaaattaggagttaaggacgaagatagttaggacttcctatctctgaggtttaacctttctgtttctattttgtaattcccttctgctatctttgagctttcagaaaatttcgatcaatattatagtttggtcttatgttctgggagactaaaggaggggtatggttgtatgcagtgggggagccagcgacctggagaagccaagggtgacttagaggcagtggaaaacttgtccatccagggcaacctgatgtggcaaacaggcctgatctttggaacgtggatgcattcctgggtgattcttagaaacaactggggtaggagaagctcactaaagactggctttcctgcagcctcctgggataggagctaaggttgtagctgtttgcatgttaagggaagagtcgagtcttgaaggctgaagaacttggggacatgagtatcacatcagtgttaactctggtgggtggccaagtggccatatttgcatgtctcactttcaaactgggcagcagtggtgctatcacaagttccctcctgctggagcctctgcagaaggccaggcaggctgctctcccacagtcacgtgagcagatgtcctctcctgcctccatgaaccatcccgtttggttacctggacgccattatatccccctgccccaccatagtgctttctctgaactgcattttagcgtgaagccatcaacctccactgaaggctgagaaatgcgtctcctgtaagcatgttgttgaagctgccatttgcaaccttaaacgtctccttttggtggaactctaattagagaacttcttcctcatcttcgtatcagaaggagaagtagttcagctcctcagggcctggctttttttttttttcttttcttttcttttttaagtcataactttttagaattgcggtaaaatgcacacgacataaaatttaccatcttaaccgtttttatgtgtgtagttcagtagcagtcagtgcctacactgctgtgccaccatcaccaccatctatttcctgaactcttttcgtcttcccaaatggaaaccttgtacccgttatacaataactccccattccccttctctacacttcctggcagccagcgttctactttctctctctgtgaatttgactcctctgggtacctcctctaagaggaatcagacagtatttgtctttttgtgactggcttatttcatggttctggtttgttatgatcactgaattctctaacaaatcagatgtctctcctcccccattttttgctttgccatggcagctagaaaacaaagccaaatctctgcctgatccaaaataagcatatgtgctagaaatttttgatgtagcttcatcctttattccattttttatttatagtcttgtgtttttttaaaaattgctgacccacctgtgatttattaaatagttctttatacaaggcatctttaatcttctttgtaatgaagaagaacgtacatttaaaaatacaggttgagtagcccttatccaaaatgcttgggactaaaagttgctgacccacctgtgatttatcaaacagttcttatagaaggcatctctaatcctctttataatgaggaagaatatatatttaaaaatacaggttgagtagcccctatccaaaatgcttgggaccaggaatatttcagatttagaaaattgttggggattttggaatgtttgcattataaaatctgactctgaaatgctccagtgagcatttcctttgagcattttgatggcactcaaaaagttttggactttggagcagtttggatttgggatacctgaatttgggatactcagtctgtattaacaagtagttgatggagggatttaggggattgggtcaagcacgtagtgaagtgggttctcacagccgatgtgaggctcatccaaacaattgcacccatccttgcccctggacggcacctcctgttgcaggtgcaggcagtggggctgctctcactaatctcttcttccatgctgaccccctccgctccaaagtcaatgaattcagattgcaaattagaagcccaggaacttttcttataactaaatgtactggtctaagctagtgggtttctaaaagtattctgtgtcttgccgccaacaccttagtcttttagggaccccagtaaacactttctcttggaagttcctggcatccaggaatgggttagccactctgaccagtgggctttcacgggtgagattgggcctgaggctgggcttggaggtgagggatctggcttgaaagatgaggacttcttatttaaagccaatactaccaagccaggatctgagtgcttttccttggagttatttttccacactggagaattgtttgtgaccattaggccctgaggagtcagtttctttttgctcatccttgagtgaccacttaagcctgaactagtgctgggtggggtctgccactgggccttccaggggcttctccttcataacctttaccacctggcaaaccctgttgttacacttagctaactttattttattattattattattttgagacagagttttgctcttgttgcccaggctggagtgcagtggcataatctcagctcactgcaacctctgccccccaggttcaagcgattctcctgcctcagcctcccgagtagctgggattacaggtgcccaccaccacaccctgctaatttttgtattttcagtagagacagcatttcaccatgttggccaggctgctctcgaactcctgacctcatgatccacctacctcggcctcccaaagtgctgggattacaggcatgagccaccatgcccagcccacttagctaactttaaggaggactggtccgtgcaggccatgagggttgagtaccgtgtttgcagtcaggagactcaaaacctgtccctgccattcactagcagcatggctttgagctaactgattcacgtctctgaaactccatttcctgctctaaaagagggatgataatacccttctttaagagttgttgtcagagtaagggagtaaccacaaagttaataacatgttgtttttacaataattattatggagaaaactgattattagacattatcccctgaatccagctctttgcagcaactttgtgcttcctcccttgacttaatttttacaaatctcagagaattaatgctgaaggactttaaaaggtcatctggaccacggttcccaaagctggctgacatcaaagtcacctgcagagctttaaaaggcatttaaagtggaggccgaggactccgtatttttaggtggctttcctggtggtttggctttgtctatagacgtacgtttgagctacccctggtctagaccctctctctgctatttgccaagaactcttttctgctatttcaggcaggtaaaaacccatcctgtgtttacagttttcactaagcaggactccacaccttgctgcagagttcatatagtgtctaatatcctctcacggctctactcttccctttgcattctctgcttatgtctccaaagatcttgaatggcttgtgatgactgtcctgccagtttctttgtctctcaatctggttactatcatgatcatctcctttgggagatgggttctaccatttatctcttctcgttattctctgaggctagaggtttgctagactctaacttcaactcttcattccttccccacactttctcctgtctggagtttgggtttatttttcttcctgcctaactattcctaatatactaagtcaataaacagattctctgtggttacatatggcaaacagctgaaatttacagttgagagtaaaatttcctcatttgggaaaaaaacccatcatttcacagatttagaaagtggtcattctgatctccagggcaaataaaagtgttttataaccttccacaaaagcttatgccttgattaaatttttattatgaattattaattaaaccaaggaaatgcagaggcctaaaccgttgcttaaatttgctccagattgagacacaaaccaaaggcggcaagaaaccctgaaggggaggtttaatgatgagcaacacatataaaaccatccgcacgctttcatctgccaaaggctccaaaccagccatgtaaatgagcccatgtgcccagacccggacagaggctggcaatgggcctggaagaaacaggacctccctggcttctctctcctgggggtctgtgtttgggttgcatggggcactgtgccattagagacacaggggcttatctacctcatggagcagctgtagttagagggagtagctggtagtagagcagaaaagcagcctggtgtcttggaagctgagccagaggtcaggagaagtgggtcactgctctctggatggagtgattgatccaaccagagccaaccaatacagttgtgcaggttacctggagcctgggcccagtgggtgctgacatccagctcatctcctactcaccacgccttgctccttgctgtagagctgcacccactatgaggagggagaacctttttctgacttgaacaagggagtcacatggccttgcttggaggctgacagtgtgcgtatggcgtgagtgggagggatggggctgcattcttctttttcttagaacacagaggtgttgtttgggcaagtggtagcctagaactgaaccagtagatactggggatgcaaacctgaacaagactctcattcaaagagctcacagtaccttgaggaagcagacagatatacagagtattctaacacgtggggacaaggtgtacaggacatctctatgggtacccacccagatgggactggacagtggggaatcagaagctttcttggggatgatgtctaaatgagtcttgaaaagtggaaggggttgggatgagggtgtaaagagtgagaaggcactgaaggtaaacagaactgcaagatcaaaatcatggaggatgaaggagcatggtccaagagctctcagggaagacgtggagatcctgtgggggctccccacttcatgttgttgcagttgaagacattttcaagtatgagcagttattcaaatatgaactaagcgggtgatacccattcccttccccagtgaccaagactggagggcttgagaactccaagttcccagcatgatgcttggcgtttgaatgctactttcttccccttcctcacttcctcctgccctttgatttttaatatgaaaacattttaatatgaaaacataaaatatatacatctgtgtatctttcataacattcaaaaaagagctaaaaaatgtgaagtgaagggtaatagcatgatgctttggccatggtcggctccccatgattttgtgtccccgcttctgggctggcttcttacagcggattgcagctgtgccccagcaagaagctggcctctctggatcaatcactccagaagcgcagaggaaaggggagcttgcctcagtaagcaaaagtcaccattatctgattatctttagggattccctactatctggatagctagtcatgactagagaagattctgcatggagacaatatatcatttatttggcttttatttttactgaattcagtgctcatggaaagtggcacattgacaacgctgcttcctagcatgacatcacataaataagtttgaagatactgcttaataagaaccctttaaagataagagaaatggtagaaagaattgaaggatgctgtttcctttttaatatctgccatgaatcatagtccagagagaagacagccgaggcatgcagggacaagacactagcacaggggtcaggagatgggcattcacagtgggtacagctcagatccctgcctttgctttggcctgaggctgggcagacagggacatggaaagctatggggctggtctgaagggtagggtggggtggttaagcctttgctggcacatggctttgcaatcttgtacactgaataaatccatcagagcactgcatccactcacccaattagcctgcacctcatgaacacctattgtgaggccagcaccatggggaaactgaaagaaccagatattctaccaccatggaggaatgacctcaccctgggtagtaactcttcccttctgctcatctacccaaaggtaaaagaaagtgcaagtttcctagtttacattgtgtttcttgagggagaaaaggctcttggtaaaacaatgccttattcctttcgtttggaagttctttctgcagaatacagctcaactgggggtccccaaaaggcccctgaataatttaaaaaaaaaaagaggtggtgtcaggcaagggctttaggacgtagaaggtcacttttggttgttgtcctgttgatccaactgctttactaactggagctattgctcaagctggagggtgagggaatgggtggggctgaggctgggagttgctcagtagttgaccccaagtgatcttgtttgaggaaaactcctgtgatcccccatcagaatattttgaaagtggaagagtctgctggcgggaagggagaagagtgggaggaggaaataagcaacaggcagcttcctttcttgacagatggaaaataaagggcctgtgcacagctcggcgaactgctccgtggacctcccagcggggctgctttctgaggtgatggtctcctcgctccttagccagcctggtggagccagctactgacgttggaaaggagttggaggatggaggtttgtggccggcaaatgagaggtgtcggggagggagaagagaaaagcaagcgggctgaggaaaaatgtaagggagggagatggttcttcgatgaaacctctggcctcttttaaaccataaagaggtctggctggtttgattccagtccataaaatggctcagtaggatcttagggattatttagctcaaacccctgagaggtgaggaaactgaggcccagaggtcccacttgcctttggtcatggggtgagtatgtagcccagcagggtcccagctcctgtgagctgcgattcatggtgttatctttgctggggaggcctgaagttcctttagcttgtccatgtgaaacagaggaagagcccacaaggaacgcattcatctcagagttaggtgaccttggctttgggatctagttgctcattacttccactttccttgccaacatctttcctaagccttccagatcagggcacagtaccactcccttgctgccagacaggtggcctgtcgtgtgggcaggaaggggagttcaaggcaagcaaggcccactgtgaaccccctgctagaagtgctctccccttccttcttttggaggtggcagttactaggcagcatgacccagaggaggagataagctgcctctgataggaaggttttatctttgaggttattgcaaatatgcctgacttcttcatctggttctgtccggatctgaactggtagccagataaactgttggcggtcccatttcatgtatttatcaagtctaaacaattgtcaggaggcaattatcccccaggaagccaatggcagataaatagtgtcccgcagtctggttccagccatggaatctgtaagttgtccctccttgccctgtgcagattttctcctctgtccctgctgccctaaattttaaaggaggtttgatgttccaacacgtttgctttggtgttctttgcccacagccccaaataaaatctaatggtttttataggtggataaatcctttttaaaggctcttttgttatcaccatggggtttgtgagcactaaaactggattttaagggatcagtgaaaccttagaatcacggtttgctgtatctggaaggaaccatgaccacttggtacagacccttcaagcggtagatgaagaggccaaagcacgaagggatttgatggcttgtgaaggcaacgtgctcttcagagtcgggcagacgtgcagctgaagcttggtctggccactgatctgctgcccggccttgggtaaactcctggagcccctatttccttattgattacatggagataccaatccagactgcacagtattgtgagaggtagtaaaactgtttccctctggtcgaggtcaaacagacaactggggggcagagctaatgccagaaccttagtatcctggctcccaggtctttatcctttccattattctgcaggaggtcttcaggctactgttaaataaaaagtaaagcttctacttcgttccacccaaaattctagttcagtgtttcccagacagagcacctccagcgggtctgaggctcagttctatgtggagactcatgtttatacgatgacagcatctatattttttctggatgaactaataatcgactggccattgtatttaggaaaaaccagacatcacctcatggacgtctcattgaaggggaccgtcagttattccattcattctggcaaattttctttttagctttggttgcagcaggaagagagagacgtctggggggctttttgcctgttggaagggcatcactcgtccacagctggagcccctgggatgacccatcccaaggtcccagcctaagtctgaggttccagggctggtcgcaggccgtccttgcagccctcgccagagcgttgtctgcacctccgacactaggtggcgccataggaacatcctcgcggcccgaggcgcggtcgcagccggggagcactcgccacggtgctgtggaattctctggtttttcacgcaaggtcaggcgtcctgctggcgccctctcgccaccctgccctcccgtcagaagcccggctcctcgccggggaaggccggatgctggcccgccgggacctgggacttgtgccacatggagtgtcgggagtctccattgccgcgagttctacaccacagggccaggctgtttgctccccatcggtcgctgcccccagcaccctgttgttattaaggactcatttgcttggagcggcatcattacaagggtgtggggtactacatatactccctatttttctattttcgaaaggctgcaggcgcgatgcacagtgcgcttgcacggtggggcctagtgctagcccgaggagcggacgggggccgggcaggggcggtgggcgccggcctcgtctcggtgctgctcggtcaggctgtcccggcgcggcggcctcgggaggccctgccgtccttcacccctggaggcgggctggggggcgggtgcggggcgcttcccctcctcagggccctcaaaccgcaagggggtttccgcttcccagtcgatggtcgtcctctcccatccccggctgcatctccatttacccgtcgcccatttcctttgcccatccaggctccttggctccactggggtctccgttcccttctcccggtcccccctccaggtcgcggctcctttgtccaggactacgcaggggcttgaccccagggcgctggtttaggccggatctggggtcccttgtcactcccaggcttcttccacttccgaattctggagaaccgggaatcaagccctgcgcgttcctcttcttcctccttcgtgccgaaagcacgcttcatgtctgccagggcatcagttctgaaagtgagcggagaacaaggagtttctttttcttccccagaagttgccttttgtaaggactatgtctgcgccagggcttgatacatgttgctactcctgggagtgtgagactgggaagctgatggaaatgtcagcattagctttaatggtgaggccaaagggaggatggacccagcatcaagcctgggtagaggagaacgggagagggaggaccagaaccaggggccgcctgttcactgccttgaggtgtctgaatcctgcctttgctgtttgtgagctctagcactatgggtaagttggttaactttttgagcctcagtttcctgttctgtcaagtgggaatacaacttcctagctcacagagttgtggtgaggattatgaactattatgcatctacagtgtcctcctggcaagtgaaaaggctcagtaaagggtaactgttatcatggtccagtctaaacttccgtgctagcccttcaccaaattgatcttacagaaatcaaaaggttcctgcttttcccaccttgtttggaattagaaaaaacttcccctgcactattagtgttttataggcctcttctctccaagacagaaaggaggagagggtaacggggcttattttcttctcccaggactcttgaagaaggattcaggatgtggctgtgccgctggggataaacggtgtaacactggggcaggtcagtttccttgttggtacgatgggactcttacacaggccccttcctttccagcaccagatactgctacaccatctcatcggcatggacctatatgtggcagcaagtccatctcatcgcttttggtgaaagtcagtccagtttgtaaagattctcattgtgagtatggctaaaccatccctttgactaaaaaccaaaccagatactcctttacctatcaatacctcctgctgctaaaaagcagcagctaaaaagcagcaggaggtattgataagggaagtcctatctaaattcctggtttagagaatgactatcctcattttatgagttaaacattacccccaattaacacctctgaaaaaccctcccaacatgtttatctcattaatatcacggggttggcaggtcactgtagacgaggaactgggacaccaaaaggagaaactctggccacgcttgcaccctgttcccaatcctggtccagtgtcacccacagatggtaaggagctctagagacctcaccagcccctgggattggtcacctcactcttctatggacagagattcctgctgggatcctttgagggcaagcagacccttcttccagctcggactgtgaactccactgcagccgtaaggactgtctgtgacagtgagcccgagatgactgggctctgtgctccctcccggccctccaatccttggcctgccacagagaactgagctcttttattagcaccatgaatgtgactgatacagctagccattcccttgtgcgaatgactcagtttattaatgctctgctaaagatggcttctttgcttgccagcagccttaaacagtatttcattaaaactggcttaattattttgagaagacggcccaattaaaagctatacactccctctatgtgagtgtttatacatagagctgtatatataatacatatttgtaagtgtgtatatatatatgtgtgtatgtatgtgtctataaatatataggcttagcaatttcattacatgggataaattgttggaaaaaatacccaggagctggtcccctttctgttgctagattcagagtagaggccacccctccactctgggagaggctggtgttggtgatctctcaatgactctgcaatggaagtcccaactgcacagagccctgccccagtttcaggagccagcagcctcggagaggcggatcctgacctctgctctgctcttgggatagcctttcccttcccagcagggttgagatacttgggccgggaaatgttgtggcaaagtgtttgccaaagctcaggagagacacagacttggggcttttgtttcttgagctggctgtctagctttcctaatgagcaaatatgttctctttaaggaaacaaacaaacaaagcaaaaacaccaattcatctggattttattcatttgttttaaatacaaacaaacaaaaggagagtggttatttctgcaccaactatttcaaatgcaagttactccatcgctcggggtggttggatggtgcttgtcaccataggacccacagggctagttccaactgttattcggtaaggcttttttctttccaaaattcccagtgttcctttaaggcccatttagctgcgggttttgtttattctcccggcaatcagcatttaaaataagacaaacaagcattttttcctgggctgtgaatccccccggccagcctccacctgcacacctgaagccagcatgtccaatcaaatttctctgtaacccatatcccctttagagacttgcccccgtcgtataccaggctggaaatagagaacttaagcagggcaaatgtaattttaagaattgctaatgatgctagaaatctgcaatgcaattagcgtcattggatttggcgctcctccgaaggcacaaaactccttgtcatagcgcagtggcagcagcggcaagtgcctccgcatgtgccgggctgtccgggtatgctggcagccgctttgcactgagatgtgagcagttggttaggcttcctctctttctttctcacagatactgacttctttgtctcttttctgggttgcagagggatgggtattttccattgattattactttagcatttgaccctccagtggagtcaccctgttttttttttagaaaactgagactctcactttgtgaattcactgtgctctctgggatttcagtgctgtagttcaaccaccaatccccctgtcctgaactccagtacttctgatgctattaattggttcctcaacaattgtggccttttccatcattgcccaccatagtatatactttttctttctctctcttttttctaatttccttgtcttcttcactctccatggagccagaggtagtatgaagagttaaaaataggaatataaagaaagccagagggacagagggagtgagaaagaaaaattttaaaaagggaggaaatgaattattggattaaaaataaacttttacttttttgcagaaaaattatttttgctctctgggaaaataacatgggccaggcataaaaagcatgtcagctggctaaaagattgcaaaatccagaagatgatctcgatgtgtctgttcaatttagcaagggtatctactaggggatcctcttttaaatatggaggcccaaatcagaagcttgtagaggggagctattcttccaagattccagatgtgtctgtgagacaacacgttatggggcaaattgatttcacccttgggaaaccagggagattttcaaagttatgtctgcaaagccagctaatgcaattccccattagtgcattaaagtgcgcccttattaattcaaacataaaggcaacaaaataagcttttaaatttaaaatataatacatatataatgagcatgtgtgaaagccttattcaaatgaaaatacaggagtgtttgaactactgaggtatcttttgtattgaattatgagcatatgtaatagatttaattattaatttccccattgttctatgcacacagacagggttcaaggcacagtcattctctggctttcatagatctaatttgtataattattgcctgaataaaaaattgctccaattcctagctctctttctttctttcccccttctaaatactatttcaatgctgcattccaaaaggggaacacctgccacttcttcaaagtcagctgatcatttggaatgatggacggcgctgctgccgatgacgtcccctttcaagtctctttgtctaagtgaattatcgtgcatccttttaattttattgaacaaattacatttgtcaaggtctatctttgtaaataaatgataactagagacacatggatgcgtatttctgctgttcaagggctcttgttccatttctggaagccagatgaacatggaacaaaggagaaactttcctctaaaagcaattatctttctgcattcccatcagtataattatattgcagggaattttaagaagctgtagaagtagaattgaatgcttaaaactgtgtttgctgaattgctatgcaaaagttgaacaggctgtattgcatcacacaaaatagtctaactctctcctggccacatttctgtaagtttagaatgtgcctgaagggtggagatggtgtgggggaggcggtggggatggggatgaggtagatcgcatttagggtttcctgtgtttcttgaatggaatatttaatgacatttctgaaacctgagggctgttagcaaggtgactgggaatgtgtctaataaagccacccattccagtctagttggaaagcttctgatttgcagattgctctctgtctgaaacagtcctgctagtttactaactaatccatgaatggtggtgggatgaagaggggaccgttcatgaaatgatggcagcagcaattacactgctcccaaaacaagccagcagctggcttacagagatactgaatgtggtttgtgtggctactgtgtcaatactgcgcatcaaccaggatcattcctttctcattggctcccccacaatttagtgaagtaaactgttgctgtgaggtaaattgtattgtctgatcactgacagctcaataacctcattcctgccccttcccaatttttaacaaactccctgatgaacattcaggaggaaaataaagcaccagtgaaaagtggcaacagagaatgccataatcatgggttagtttagtatggctggtaggttttgagttactggacaattgatgggataatattatagtctagagatcttgaagaaaggaaacctacaagaaggatgaccttggatcctctcagagaagtgaagggtgaatcaggagcctggcgataactcccagttcacagagactgcatggaacagcgggatgagcatgggcttgggttgggatggagacaacccctggcccctgcattcagtgtctgcagtggtaagatgagggatctggaccagatgattgaatagcctatctttagattccgggtctaaggtcatgaaacccattgtatggggcattgatcaccataggaaagtgggggaggcaaggtccatgtactaggattgcattgttaaagctttatgaatgtgttgaaggggaaaaatgattttttctcataagaaaaatgagtccagtgcttttgatctctaatttctgtggctgaggtttggtgataagcaagaatggaaacccatgggatcattgcaggtgacatgatcagaaagtggtaggcccataaagtaggtttaaaatggtgccttggccatcttggtgattgaaaagcctcctctctcaggagaaagtggccagtgggactgatttgtttgattcagatcatctcactaagcaggcaatgaagggaattgcagagaactagcatgtccagcttagagttgaattcagtgctccctgaaagtgtcagaccctctgctggagctaggaataggtcatatggtccctgtcatcaggatcatgttgcatacatatgaccgtgaagccaggtaggaacatctgtgattctaggacacagtgatcggggccatgacacagttctcctgggagggagcctggtgggggctgaggtagtcagggaaggccatggaaggaagtgaggcttgagtagacacagtcagataaaggtaggggtagacaatggtaacagagggaagaatacgtgacgagcagtgacgtaaagcagcaagacatgttcaaaaagctgctaatgcttcaagatggccaaggcggagggtgagtgtgggtgagcagaaggggatggggctgaggaaatcagcaagtgccagacatgggggcctagccaggaggctcgaactttctgctctgagttagaggaaaggggaaagcactgaaggagtgtcacaggtaagcagtgtgtcagggtcagaatttagaagggtcatgtttacagctaggactggatcctggggtccctgtgcaaaatgaaaatgtggggccatttattcaaaaaccaggaaaaaaggtgctgttaaaggcattagaatacagagcgtttcccttcattctgcagcctctcaatctgtcgtggcatttttgtatcctctttaatgtcacatccctctggtcctcatggcaggacacttgtgggacaagtacagactttcacgggagctggagccctccctaacacttgggacacatgtggtccactggcagctggctcctcctctccatagccatgggactgatgtgtcatgcttcagctaggggtaggaagatgcagccaggtgtctctccttcccggaggcctggtgctgtcacccttggcaagcaggtaaccctcaagggtattgcaacttccctgtcaagatgtactgggcatcttggttaaggttgagcctgaggcttcctgtaccaagttgcctgctaagtgcatggtagcgctgacagcctggggtgaggatggccactgccacaccccttgcaagatactgtgaagcacgctcaccaaccctgcccctctccaccctgcgcccaaccctccactgaagtggagtggacagtgtcactgggacaggttgtgggggaggttgggcagggcccaaggtgccaggggcagtgaaatgggtagccgagtacctgtcctgggaggcagggaggtggtaagagatgctgcacatgagagccaagaccctaagcccccggcccatgttcatgtgccatggacttcacttccaaaatggtaaatcattaagaatttcaagatggcaaccagagagcatgtgccctcaagcatgggcccttctgagcatggatccctgtgctttgtgactacaggaatcactcacccttcatgaagcccattggcagcaaggcaactgtagcagagctaggcttaaggcagggaactcaccaggaaggggctggagctatctggtaatgagtgctgagaaccacagtgaagatactggtggtgagaatggagaggaagcaatggagggagatattaggaggtagaagctgtaggattaagaggcaaacaggacgtagcaggggtgagtgaggccgtgggatacagggtcacttacagggttctcatatgggtaactggtactttatgaaatacttttacataattttatcacttttacataaattttatcacttaatctgcaaaacatattattgttacttccatcttattggggggaaatagctgaaataagtgaggtaattcactcaaactcctctggtcagaagacttgggatcagcccaaggcatttgattttgatggcacattcaatctaccatgactcctctgctgctctggatgagtctgccttgtttgtttgttcattcatttatttattcattgcttcactcagcaagtacttatgaggggagcacaaggtgctgggcattcgtctaggtgctgaacaagccaggcaagccttccgctctcatggagtgcacattctagcagggcccaggtgccagatttaatcagaagtttcgctcgggctttaagggccagtggaagcaattatttatttatattttctgtttcttgtcccagtttctaatgaattagagtttgattagcttcaacagagcgctatgactagagggagaataataaagtgtcctttcatccacccctatccaaaagctgtgtgtaattagaggaatcaaaccctgtactcttcatctccacctgggttggcagaggtcagtttattctgtagatatgtaattatgttgttttgctctttcatttaaaaaatatattatctctttcaatgaatcttataaatctcaggctaggagactggatacccctgataaagaataaatttctaggtgttacattgttgtcgtgccaacagcaatggttctgaatgctgatcagatgactcaactgtacaggtcagaaaggcattcactggcaactcagcccctcccaatggcttacaccatagaagaccatcagtaatgcatgtgttgaatggtgttaggatgaaccagttttcttccttggtgcacagccccagggaactagaatggctgccagatggctccgggtgctagggcatgagcattcattgtgtgaaggaagtgtggagactgaaatccttttaaagacaatgtttcacttgataggaaacaacattacaataagactaatcaagaccactgagttagtagtcatggagaactaaaatcattattcttgcagcacaaattcctggacctgatgatacctctgtggcctgtcatgtgtcagagagtctgcaggaatgtaacatgaaaacctgtaataccagaggtgtagagcacactccagtctattcactctggaatgcctggggatggcccttggcttctgagctgatggccaagagagggtggaagaataagtggaggagttggtcttagaaggtctgctctacagtaggcctggggagagtggtggatcaagaggaagattcaaaccaagtgcattgagggatctgaagaccatacccataccaatcagtactcccctggaccagcgtcatcatcctgggccccatgtggctgcccatcgcatacaggaggcctaattgtatgtctgctgtgtgtggcatgactccttcgaatggcgttccttttcccaccccgtggcattgctctgctctcgcagtctctctccatagtaacagaagcttccactgagttaacacctcaacctattaagcttaagtgcttttcaaaacattttattattggctgagtgtttgtgaagcagtttaccttggactccgactggcttcaagaggtttgagcctgtcttgtattccagggaagcgtcattgcaaacccagcacccagctttccaccctttctttacctctctcaccaaatggtgtgaggccattcatgggaaggccacgatgaattttgatttcagtcgttgtatcattacttagctaatttaaagatggatatcggcccttaaaattaaaaattgtatgttacatggaaggactccacccacccagggtcaggcaatgagtatatgattagacaaatgagggagtggtgctttccatgttcctctgttgagtgaggatcccggtggaccatgtcctgggtcctttctgggacacttcctggtgtcaagttccctaacttctgtgggctgccaggcacaagtgtcagcattcatgttgcaatcctgatgccatagtgtggctacttcaaggagatagtattcataatattgacctcttcttaaaattatttaaataggcaccccagtgcttcaggtaagcgccatgaatcttgagcaaatttgactcatgaggtaacttcagagaaccattttagctggtatgtgtgtgtaaggtggggcaggggtagggttgggtattaaacatcaaaaggtcatgctatgtaatacatgcaatatataaagtactgattcaatagaactatggcaggtgctgttgtaattcttttttctgcattatgcagaatttgcaatataaaaattaatgcatgttataaacttaaggtagcttcagcaaataggataaagaactccatgataacaaatcacagtgtatattcaccgctggtgagataaattccattcatgaggagattttgatttcaaccccttataagagaattgtaagatagtggcagcatctaatcttgaggtaggtagatagtggtgagatggctactcatgaataattttaaaatcaatcatctgtggctaaatgtagtgatttcaaatcgcttcacagctttgggctgtggaggggaaaagccattgtggtgaaatagagtaagaaacaggagatgtaaagctttcctcatttcttgcttcaattcgatccctgttctttaattgctctgggacttaagattccttttcctgaagctacagtgtgttctacatcttctcagagctgggtcctgccgccctcctcacacagcgggtgaagctgctcccctgcttccagctgctggtggctcagcaacttgggggaagcccagtttgctacctttctggacatcctaggggacctgcagttcagccacagcgaggcccagggaggggacagctggtgtcctggcagctgggcttctgcactgcccatgactttgaagacacagcatcagagaacagaatggtgccttaggtttctggagggtccttgaactaaaatgtgatgagaaaatctgtgtcaggagaagatggcaaggagggaagagtggtcttctggccacagcaggactcggggtggtgctgggccacagatgtgtgcccacctcattggagtgcagggcttgtggtgggagctggtgggcatagcagcatttacactgtacaaagtagacactcttctgcaaaccttcctcccataactccctgccctcaagtgtggcctaaactgcatgaacctaaaacattccaacagtatattgatgacagctaaactgtcataacacaacaacatggttatattgaatgctgccttttagccatccatgatgtctctgtattggtgacaaaatattttcctacaaccacacatctgttttcactctcaggtctttgtatcatatccttattcacaattcaggatgatgatgacgatgatggtgatggtgatgataataatagtagctaacactatgtaatattaggcactacgcacatttcatctgttaactcatttaatctccataagacccacctgaggtaggtactttattatttctattgaagtaacataaggtcacattttggtaagtggtagaaccaggtttcaaatccacgcactctggctttgctctctgtgctcttaaccactttgcaatggtgcctctcatttcctctattcttaagtaaagaggagagcaactcagaacaattacctacagtattcaaaggttagaaaattttctgttagttacaaagtatcagcaaccaatccacatagcccagggaattagctttgcatttttgcattcttgcatgggtgcattcagaaatttattgattacttaccacctgccagaccaccatgctgggagtaagaccaaggcagacatgctccctgacctcatagagcttccactcattctggaaagttaacaaattaaataggcatcacggtgatgtgtgatgaggattatgctagatgaaagtatagaataacaacagctaatatttactgagcattttgctatgtattgtgtgatggttaatattaggtgtcaactttactggattgagggatgcctagatagctggtaaagtcttggttctgggtgtgtctgtgagggtgttgccagaggagattgacagttgagtcagtggactgggagaggaagacccaccctcgtgggtgggcaccatgcaatcggctgccagcccagctggaacaaagcaggaggaagaaggataagctggcttgctgaggcttctggcattcctcttcctcttgtgctggatgcatctgtctgttcctcctgcccttggacatcagactccaggttcttcagcctttggactcttggacatacactagtggtttttcgagggttctcgggccttcgaccacagactgacgtctgcactgtcggcttccccacttttgaggcttttggtctcagactgagccattactggcttcttcttcctctgcttgcaggcagcctatcatgggactttgccttgtgaccgtgtgagctaattctcctcaataagctccctttcatatatacatgtatcctattagttgtgtccctctggagaaccctaacacatattgctaggcactattctcagtgcttttagtggactcattcatttaatcctgatagctaccccatgaggtaggtactattttattcccattttacagatgaagaaatggaggcacatcagggttatagaaatgctgagtgacacagctatttaacggtggagccagcagaacacatcggggagggttagctttgcctgggagtttgggagtccagtttcaatcaattggtgagcagtactcatggagacaatgaaaaatgggaggtccttcattcagttggtgcctttgttcattcaaaagcatttattagtaggcatctttgatgtgcaaagatcaagggagtgggtggtggttggtggtagatggctatagagttgggtaacatagggtgtttacatttgagacataattcagtaggcaatactgtattaagtatttaagggtataaaaataaagaattgctccttagtctcaaattgatatattttaaatatatatataaaattataaaatgataaaattatgcaaatatattcatcacctcacatacttatcatttctttgtggtaagaacatttaaaattcaaacttttagtaatttagaaatatacaatacgttcttattaactatagccaccttgctgtgcaatggaacaccagaacttgtttctcttgtctgactaaaactttggactctttggccaacatctctccattacccactccctcctccccagcctctggtaaccaccagtttactctctacttttcggagttcagattccacatataaatgaaatcatgcagtatttgcctctctgtgcctggtttattttacttctcaatttaatattctctagatttatccactttgtcacaaatgacagaatttcattcttttttaaggctgaatagtattccattgtgtatatataccacattttaaaaaatccattcattcattgatagacacttaggttaattccaccttttggctgttgtgaatagtactgcaattaacatggcagtgcagacatctctccaacatactgattttaattcctttggatatacccagaagtgagattgctggatcacgtggtagttccattgttagttttggtacatatttaacagaggagttcaggcagatgaattggcttgtgcttgtaggtgcacacagagcttgatggagtggagagtgtggccttcagatgggagcaggctccacttctagcctgcattgtcatacctctagctgtgtaaccttgaccaagccttggacttctagaaccttagaatgaagaccctcattttacagatgaaaaaactgaagcttagaaagttgtcataagctagaggaatatttgaaaatggaccaattctgattcaaaagtccctttcagccccgagacatagaaatcttaacttgtaagtgattgttgagttttccgatactcaatgtacacattagaggctttaacaagctgtatatttgggaattcagtactaaaggaagccttcctagagtcaatgagaggaacttccaaggaagagaggaaagcagcacaggaaacaagaaggagatgctcccagcatttgggggtatcttgggtgggagcttggaagtaacatgaaggagaattgtggggccacacaaagctagacttggctggaatgaaggagggctgcaagaaatgctgtagggccagtggtagtattggggaggtttgggaaagcagaggagataaggacagaaagaatgtttccctaggttgaaaactttgtcttgtttatcaacatacccaagggacacttgcgcaagtaattgacaagaggtttctgtgctggtttcggttgctttgggaaaatggaagggaagtgtttaattacaagttcaggtggtagaggatgaggccttcaaagcctcccacatgggagcaggataattcttcctcttcctcctcatcctccttctccttcttcttctccttctcctccttcttcctcttccttttcttcttcctcttcttcttagagacaagatcttgcttggtcacccaggctagagtgtggtgacccactcatagctcactgcaacactgaactcctgggctcaagcaatccttccacctcagcctccctaatagctgagactacaggcacatgccaccacacctggctaattaaaaaaaatttttttttttgtagagatagggtcttgctctgttgcccaggctagtttcaaactactggcctcaagcgatcttcctgccactgcctcccaaagtgctagaattacaagcatgagccactgggtccagcccagaatttgtataatctacttgcacaaccagcctttcagattcacctgaagcctttatatcttcaacaagaccactctttagtttggccccattcacctgctagagttggcgggggtggggttgggggtgggggggaggtgggggaggaagaatgcagacataaaagagtttcctatttcctcttagacagtgactatatcatgggcatcatctagtaatggagagaggaaaaagaggaagaaataggagagagagagagagaaggtttgaggggaaggggaaggtacatagcacttggtagctccagttcctttgagctagatgctcccctggctgatgctgcttcgaaagccatgttgatgtcgctcaagtctgtatgtgatttctttcctcattttcttcctttgccaaaaaaacaactatggctcttattccaagtatagtcaatgagcagttaccaagagggtcctagaaagcatgtttctgaagaatgtcatctcggcaacgttgttccatctgcaccagtcagggaggaatggaggcagaatgcctccaacacacactttagatctggagatattctaaggtgtaagggaaggatggtctcttctggagaactttggtttaatccctgaataccttcccccaggagtacaacatggatatttcctcagactgccagagcattttagagtgttatttgaccagtatataagagatatttgctgtaataaaagttacactgggcttggaatctgaagactttggtctgcgatctggccatttttacttcctagctacgggtaagttgccttcttcacagcctggtaatgaagagcaaatgagaaaaatgatgacaacactttgtaaactgtaaagtggtgcaaatattacttgttattgttacctagcaatactcggggattttccttgtttggttccagtttaagtaaccagggcctgtgttaggcttggaagcttcaattacaactgaagggtgaaattaggtgataaaggctttaatataggttttgtgttgaggacctaagacaacactaagagtgaaccctgtatgagtccacaatcctgaacagttgctttgggtggtagctagccgttccttctcaccagggattggtcatgtatttaatggcagactctcccttcccctaccttccctgcttccccacgttttcccctgggtgtcctaaaggcttggcacccttaacagtgccttctcctcccatgggctcagccacaggtatttcttaggagtctcacctcctcgggtgacttttccagcctgtcttcctggctcatcccactgccttgtctgggctcaacggctgatgctttgctccatttcagttcccactttccttctcctcccttgacttgatacttcctactcccccttgcttcccagggtcccttcccctcccatgttgatcacttgagaggagaggtaggtgactgggtttcacagccccaccttggggcaggttggaggtccttctgttggaggatgtatttggaagtgttctgaccaaggggtcttctcacgctcctcagcatttcctaaagtgcactttctgatggcgtgggcactccactttcactgtggctgctgttctactgttgagacacttccctatttcaccggacagtctctttgaagcttccacagttgcccattacattttgctaggaacagggagtcacttctctctggctgggaggagacctctgagtctagtcaggctccagggtccctggatgactggcttttgcctcagtggccttactcttcctatggcacactcactgtccgcctctactaacctacaccaccttcttagactgctgtttgcatcttcccaagacagagttttccctgtgaccacttgtgcctacggatgagtcttaagcctccaagtcttcccaagaaactgaccttaactcaaggatcactttgttacacaccaggctacttcaatcctctggccttgtttccattcttgatccctttgatctctgctgagccttgaggcttatgatcctgtttcagggcttcagtgattccccttgctcccagctctggggactggtctgcttatcctgtctccagtccccatggttggagctgcgaagcaagagcttctgggcaagatgccactagaaagcctgtctccctaagaacaacagaccgcttttctctctagttgttctgaaacttaccccttctctctcgcagctgtgtgaaaagaagccaaatgcccattcttaatgtgtgacaactgaggctcacatgcaaactgctgttatctcagcaggagagcaatttgcaatcatttaaaatcctttcactcttcccttctcctcagtgtatggttatacacacaccagtccatatttattagtgcagatggtgagaaactcgtcattgaaagggcttagagcacagaggaaaatggatttttggcctcactctggccttataaacaagaaagcttaaatgattttaggttcctgattcttgcctcaaaagagcacagtttgcttctctccaaacacaagaggttgtaaattggtaattcatctcaaccaaaggccacatgatgagcaattgtagaagtattttttttcttgttgtgcaaaggaggaaccagacatctgagtataggttccagctggaatttgcctttcaccatttgtagcctaaaggcactgtcttggccagccctgggcttcgtgcagcttctgcctcttcacctgcatcactaacagggcgatcgctatcacaagggtagaaatcagctcagcatttccatgtgacttcttttttttttcccagctaaaaaataaatctgttctaataaaaacatttatactatattctttattgtcagctaatcctgcccaaactcattaaatggcagtgtgtgggttatttgctgtcagtgaaattatcaaaggcatttttcagctggggcaccaggaaaacatatgcttcaatgccaactaaaacaataatgaggaaatgttatgatcagtcttgaccagatgaccctgcccattttagattagttcttaatttcagcacaagggtcatcctgtgaattcttacaataagtcactgctcaccactcacatgaaaaagatgtgacttattagaaaactcactgtactcattgcagttaatgagatgtggaaagctttgtaatttgatttgctgggccatatgctgtaaagggatactgctgatttcattcctccgtatttaatttaagctgtatgcaataccttcttcatatggctacttatataataaaaattaacttggggtataaaaaatacaccattgtggggtttatgacttggtgtggttcagtttcaagtgttttgcatggaaacatctgtaagtaatgtgtgcgggtctaattttaaatcccgccaaatattttccatttaacatttggtttaactgacaggcttgcagaggtggttttcagaattgtcggtaacagatatgtacagtattcccaaggccgtagccttttttttttttaaaggaagatagtaattcaaacttgtttttttttaaatttttttaatgtttacatttcagtagatacaaatagcagttcagaatatggctactcctgtcccttgaagacccagctgcagttaaatctattaccccctaaaaagagttaccttggttttgacttttgcttcaacatctgcgagctaggacacctgaggctgactgggaaggttgaccgtgggaacgggacccttcaggacagggtcctgcctccacagtggagagagacagggagggagagaagagggtaggactgagaaggggggcaatgtccagggaggtctgagcctccagagaggctccgagaatccacattcggactattttcctaccgtttaaaaataagtctcacctaactcttaggagaggcccaggccccctgaactatcccgatctgctcagaagctgagctgtaaaaccataaaacagaacctctcctttctctactgggtaggattgccagataaaatagaaggccccgagttaaatgtgaatttcagatagaccacaaatatgttttagtacaaacatatcccttgcaatatttgggacatacttatactaaaaatgtatttgtggtttatctgaattcaatcttaactgggcatcttgtatttttacttgctaaatccggcgactctaccgccggggtcggacgttgtttgctgactgcattctattcgtggccgcggaggccttatttcaggttgtttgattccggtggctgacaatatgaaacagcttgaacaggcaggccggtgggcagaagccataaatagccacctcgggggggcccccctggtcgctgggagcgccacgctgctctgttaataaacatgcgctcgctggagtcctcatcctggggctcgcggaagcgctgactcagcaccggggcagggaggatgcggggacccccagaaacataattaaactgtttccatgactgacttgaaaataaaattgtgtgtgggaagagaaacttgagggggaagttaaacaacaaatggagaggtgtggagtgaaacctcagggaaactgttggttttgcttcaagggaattgaattgtgaaacttgcagttgtgaaatttcactcggttgattcttgtgagaaccgaagtttgttttaattgtcaattaaagcgaatggtgcttgggtccctgggatccagggaacctcagggcggtgctcgcctctgcccggcagcgagagagggacccggtgcgggcccgatgacagggtcgaccgctgggggtcaggataagcttgcagagtggccccgccgccgtcctgaactttctcgggaggggaaggcggctgtgtacagaacagcacgccctgggaagcaaaggcctgtcggagaagttgatgaaagatgcaccttaggtgtccccgagcagggccgccggcctccccagaggtttccttggcagcccttatttgtaaggcaaatccaggcccgcgcacacgttgctcgaatgtcaggtactaaattgcctttatgagagtcgagcaggcttgccgatgacaacactctgataacaaaagaagtgtggcctcgttgaagattttatgtaaaaggaaatgattcatttgaattcagaaggagccttaaaacagggcagagacagccaaaccctagattttctgccttatgacttgtttcttaaacttgttaaagaaaaaaggggagaaaacttaaacaagaaaagctaccccaaatcgccagccaaggtttagattttcgtgggttgctattttcttcagatcaaggttgccttcttgttaacccgagactgcagccgcagaaaattagattccccccactcagggattaaccacatagaacagttagggaatgtggaggtctggagagacttgagatcaacgagttcgaaacgtttgaaagaaaaaaatcttcagtggtttgagagcttcactaagatactttaaaaaaaaatcaaaattgctcttatttaagagctttggagatccaaatataagtcccttttcttttgccaagaaggcccttattcattttgtgtgtctttaatgctcaaaagagatgctgggattcctagtcaattcctaaacaggagtctgacaaccaactatatgattttttttgcaaagacctttttttttccttaaagcttcaaatttctgttccttttgatgatgatatgttgaagaaggaatcagtgcctttctcagtaagtgaatgacagaaagcccttacatcttttgagtgggccagcgtttgggtggcagggctgcttggatggggagcgatgtgacagggctcttggacaaactgctccttggcttagggatggtttattttgaacattcattcattcacttattcaaccagtgtttattaaacattcacggcctctgtgcagggctaggtgtgagggctacagtgtctaataacacagagtcgtggtcttaccctccaggagtctgcagtctgctggggaagccaacaacatgagaaggttattctgctctactggaaaaggcactgatcttgtcctctctttttcttccagaagcaagaaaaaaacccagattggtcaacacagttttataaacaagtggtactttagcaacagcaaccaaagtcctatttaattagccagtggaaggtatccatctgtgatggccaactgtttcctttttccaaggggctcatcttctcctttggtgacccaaaatgccttttactttgagccacaccctctgcctgaaatcctgcaggataaaatggggatggaggtagaaagcaagtggatcacttggtactgtctgacttgataaccagctgttgaatggcctgccatggcttcactacaagaatggggaaactgttcttttacgtctggaagaaggagaagccagaagtttatttaatcttttctaggcaacttattttattgcatttttaatttcctctcttgcattaacatgacccttttcactggcttcccacgcctggtacttaattacttatcattagcaatgtacacgggggccttgctgcatatttataaatgtgatcattagtacatggaaagacaaaggcttctttaagactgtcattagttattctgttttcatggaaatgttcattaggagaaactacccacctggttaaataattataattaagaattggtaatctcctttgcatttttaacttgatcttccgtctgtttgtgtgaagctaaacaagccttatttggcaagtattctatctttcattttcacaagaattgtcaacaaatacgtactctttgtttttaacctataggtgctgactgatttgcagcatgataaatataatttttgtaattcagcagttaatctccaaacacgttaaccagctgtggaatggtgagtcagtgaatggagttaaaggatctctggttgattttattttctggacttcagtcagtggtgcaaattggactccagtctcccagtcaaactttgcaaagggtcccctttaactcttcaaccacagagacaccacgctgggtggccactggccactgctcctttgggtgtgccaggcaagacaggtggcagttggatggcccgagtctttgtgtgtcagcatctgagtctttatgtgtttgtgactaggggtaaccacagcagtgtcatagctgtggccctgccaatggctagtcaaatagagtccacaagcactgtttgaattgctagcaaatggtcatgcggctcgtacgtggttacgtgtcagctgagctgaaacaaacgaggtgacagaaacacaataagggaagctcggttatgctgccgcccactcccctctgcccagactggttcaagccgccaccctggactgatgagaatatgccagggataaaccacaactgtgggaaatgctgggtgggggcataaatatcatctgtaaacaattaggcagccactgctcattcagtgccgttttgagaagctaaggaagtccgcaatcagttatatctccaattaccataaaaatatattagccattcattcatttattaatgattcatcagttaaccacacataatgagcaaataattagcagtgctgtacggttgccaaaattgaagaagtgttggcattttaaagatgaaaggttgaatttatgcagaagtctggtgatgataaagttaatatggaagataattataaaagtggctgtcctctattacaggctgaggtaccacaaaacttgcctaattgaactgaaattaatattcttccaaagtctgtgtgttgccacacacaaactgctgaatttctcttgaagatctcccttcagtaaggtgcaccgcacaatacaagttaataaaatgccagacagctagactgtgttctttgtttgcttggttcagggcctcgtggaaaacaataaattgcattcatgtcagctgaggcccatccctttgctaattaccgtttggtgctgaaatgacttctgtgaaattgggagcatgaggaaacatacagccatacaagggaggcttttcagagttttgcagtaaatgtgagataggcctcaggcacacagatgttaaaacagcgaattcccccacagattacactaatggaaaccctgtcagggtaagtcaaatccgggtctgtggtcaaaatctaattaaggtttctgtacttaaaaagaatatgaatgcctgggggtggcgatgaatgtataagaaactcacttgtttgtaaaattgttagcatgaatagtaagtaccgtggggctgttacctgcaatgtaacacctgttttctgaggctttgctgaatgtctcaggatgggttatttcagaggtcagcaaactaggctcaggccatggcagcctcccatctttggggcctggggcacggcatggtttgaggtcacagatgcaaatggatcccttagaagttgccctggaatcccaaaggatgctttactttgccacatgaaaaccaccccagatgatcctgcccaactgcctggcgccactgaggaaatcgttcttgccgagggtgttggactggccaaatctcccctactggggaaacaaagggttgtctgctcccggctcgccctccagcctgtcgggactgcctcctggaacagctgcagcgtgcaggcgcagccctgcttctaatagaggaaatgaatttataatgctgcagtctcttcattttcacccagcacaaatttccccttaaatacttaaaaacaacacccagagctggatataccttaaatttccaataaatgaaaccttaatccagtctgttgctgagtctgagctgttattaaagaaataaatttgaaacagcaagtggtttgagaatttttgaatttaattatttaaatctacttagggcaactgtcacgcgctatttcagtttcccatggagaacatgaattctgggaaaggtatcccacgcagggccctggaaatattaactttcatgtacaactgtgggctcagccatagacagactgtgccaccctcctccccggaagagcagaagaaagaaactcagatttctttttctgtatgatccagccaagggatacaggatatatttttcaaagaacgagggaagccaagtcctcttctttcaagttctgtgggcctcttcagatgcactgtttacatggagttcgtttgaagctctttggagagcgacagttcatacagtcattcactgagcaacgttagggagcaaaaggtaaagagaaagtgtaacctgtatgatttaagtggccgacagctaatttagggtgtgctctggcctcgtgagtgtctggagcctgatttttgacatttgtgaaaatggaccatctgctgtgactgtcccaagggtgatagcaccaggcttgggctggagcacctgagacttttggtgccacttcagtcttcaggcttggagagagtctgctttcatgattagagacagatgacaccctggccttagttctgagagcgcaggataccttccagatattagcaattgagatttttaatggcatccacattgggatgtgggcggggtagaaggtgaacaatttaggcacacactcgtaagtgtctccttctccagttcaccgggactttgctatggcacaagatggctttgttttggaccctgtacaagttggttaaattaccagatacctgtgaagcatctcactagagcatgatctcaccaacacagtgagaccccaagacctgagtcagagagatgctcaatatccaatttgtttctcttttgtgctagccatttgatagtagttgggacctcagagccgccaagtggaactttcccacacccaacccagactaccaagaggatattgacttggagtgatttctagatccagagttctatttttccttccaacataaaaatcttcatagaagccaaaaatctttaagaaaagagcagctcttagtgtggggcccgtctcagcctctaccttgtacccagtaaatgcaaagggctgtggaaattgcacacaattcacagtgttcagaggatgagtgaatgttttaccatctcaaagaggagattatggggttccacaggaaataaggtccagtggctagcaatgcctcagaagtcaagagttttggggtttatgttttttaataatggtagcaaagacttataggtaatgctgggtatttaatttaaaaaatctataaatatttatggaataaaacttctttccaggtgcagttttgggctctaagacttcagagagaaaaagtcatggttcctgctcttgggaggctctcattgtgtctgggggagcaggcaggcacccaacagcctgaatcaaactccatgtagccaaatttctacatcattacaatgcttagcatgtaggaacccaataaatgtttgttgaatgaatggatctgttaaaaagggagtgtcacgctttctctctttctaaggagttattgtgtgaattagagggttaacatttataacaccttttatgcccctacatgctatataagtacaagttattaaatatcataataaactagggtcctaggcagtcaattacattttcttctgaagttagtgacatttagattcttttgttgggcagatggtgtaatattgcacctgttggaagagtaggcattttgggaagggaccttaattcagaactatttataatatagcaaagctctggcttcttaataaatgtatttgtattgtttctcaaggaggtaacatagctgaacagtccgactctttgaattggaacttctgaaattggaagaccattatttcttaaaactctatttactctacattttctcttcactttcttcacttctgattttcttttgcactctctggattggcttttaatacccaatttgtttccagccttctctctcctccacatgtctctctgctcctcattcctctctcttcgctgtctccctccatcttccttcctttccctctcctgccaagacattccatttctctggaatgcccctcaagccactttcgagtccaactaaactatggtctgttgggaagtccagagctgctgtttctgcttggatgtctaagctttccataatccacccacctcctagtctacttctgggcaagaaacactgcagcggccaggccgacttcatcattgctctgcaaataccatgtttgttgggcctttgctcttgttaatatctcatctggaagctgtcttcttctgttacacctttctaaagtccatgtatcaattgactgtctgctctttgaaattgctcttatttacttccttgatctttacctcttctaagctcccagtgcccacagtttagcaaccccttttgttgcatctcataatttagtagcttctcatataggccccaggcttcttctatctagaagctacagtgttccttattatgtgccaggctctgattaaggtgcattgcattattatttcatttaatctccatgacaaccctatgaggtagacatttttgtcatttccattttacagatcaggaaactaaggcccagagaatatgactgacttgcccaaggtcataaagttagtaagagctagagctaggttctatggaagtcactatttgctaccacccagatcccccttcaggattgaagccttactcctccagctgctgagagtaccattggctgacagccctcagctgtctccctctctgctcattgccctctatgtaagtgagcctcttcactcaaggtaacaacccctttcctgggttagcctgtgtccaaaatcttatattgcagggctataaaggtctctccacttcaccacaacttcagaaaactcctaagtgcaaatcagcttctgagctctctgtgaggttaactgatgccttctttgtgactgtatcacagcccaacttctcccttgacccagtcctgtttctttccctgtgctttcacttctatgaatggtgatttccaagggcaggcactgataaactttctatgcaaatccctgattcaaagtctgcttctcaaggaacccagcctaaacagttggtacaaggagtggtccgagaaaggcaatgctaagatgggattctggagctagatcacctgctggctactgatagtgaggacctcatctctgggagcgggagtgggtggagcagagtagatcctggcacagggttgcagtgatgatgtggaatggtatgctggtgaaaggggatgcactagtaggtgaatgtaccaggcactggagaaatacggggaaatagtaatgataagagcaatgacaacggttggatattactggaggcaattaatgcattggataagaaggcaattcataagcaattagtatgtaaaccacagggcgtcactactggatatcaagtaagtctcatatcctgtagttagaagccagaaaaagttgatatcagggctaggacttaaacataagattgagagaattcctgggaaggttgaattctcaacctaggcatgtgcgctgtgccaggcaaggttctgattgggaaagaacaagcccttgagatattagatggtgacatctgacttgatgcacttaaatatcttgagtctccagattcccttaaactctctgggcctgcagaagtggcctactcctgtctgctaaaggctagcattactcctctcttgcttgaagaatatgcaggggcctctgccttagaagacaaatgtgtccttcccactttaagatctgcccccacggtccctttcttggcagccagactaataaatagggttaaatcacagcattgcctggctggggaagtgctgggcccactagcaaaggaaaggtactgcaggaactgcaggatgtagctaacaggcactggcagaatatcaaacattatttaaggactgggttctgagagtactggatcaaggtagatggaatgtaaagttatataagggaaaatttatcaatatgggatcactctcttgggctacaggatttagcatctggcaaagatcctgggatcctgctaatgtactgctaggatggctctcagaagcttggagaaagtaagagctcacataaaaggaagtagaaatgaattactgtgacagttggtgggagaaaggacaaaaaagctcagagaaatgggcatggcaggatgggccagaaaacccaccaaatgactatgttcagtgagagggttcaaagcagaggttacacacattttgaaaagcaactcttggcatgctttgtgactgtacctgttagtcatccaatggtgatgaagccagaactgcccatcatgaacttcttactgtcagaccaaatacattataaggttggtgggtgaccagaagtaattcttataagatgaaaagggtacatttgggactggacacgagcagggccagaggtcagcagtaagttgcaggatccagtggctcagactgccaagttttcatccaccaccatcatgttacctctgcctcagtgcacacctgtggccacatgggggtcccttatggccagctgatggaacatgtgaaaggttgagcttggttcatgagaaggttggcttggtatgtgggtacaagctgaaaatgaactgctgctgcactttagccctactcagggtgaccttgaagtcactaattagtagaaatcatcccaatgggcatagctttaagtggtgtacctgctcatccactttgtgtggaaagagaatatgtctaagctcatgggcagtggaaaatggcttagtcaaatggtcagaggactggaaggaaaaagacaaggggatttggggaacgggtacacatacaggagtgggcatgaagtgtgaagagttttgtatcacatgttaactaacacccaccagaaagtattcaacacaaagatagaatgaccaggccagttgacgtaagccagcctctgccatgggtcacagcagtgctggcacaatgggtgcataagcggagtagccagagtggtagggttggaggtgatatatgggtccacggcatggctcatactcaccaaattaatatagctcttgctgctgctcaatctctgattgtcagcagcagagaacaattaccaacatgatactatcttttgaggtcaaaaagaagccacttggtggcaaattagctacacggctagaaggagcaccgattcattttaacttgaaaaaatgatatttcacaatgggattgcctttccctgctgcagagcctcagcctgcgccaccatctaagagcttagagtatttgatatgtcaatagggatcccacatcacattgtatcataccacaggactcactttatggcaaagggggtgcaccggaagaaatacagccaatggtcctatctcatatagcaccacatagaagaatctggtctgctggagtgaatggcctgttgaaggcacagtggagggaccagcttgaagatggtatctgcgaggatcaggcactattctccaggatgcagtgtacactttaaatcaatgaccattacctggagctgttcgccaataggcggaacacatgagttcaggaaccaaggagtgaaagtcactgtggctctgcttaccatcactcctggtaacacacttggggaatttatactttcctttcctacaattctaggttttgcaggcttagaggtcttggcttccaaagggagaaagcttccaccaggggacacagaagggtcccattgaactctaagctatggttactggtggggcacttcagattccatgtgctgaggaaccaccctcttagcagcactatttgatcctgatcaagaagaggagggctactcttacacaatggaagcaggaagacctatttttaccacccaggtgagccatttggatgttctctttggatggtcccttgcccagttttgaaggtaaatggacaaatgctgcaaccatggcctgagaagaggctgagaggctcagatccctcaaggatgagggtctgggtcactccaccagttaaggcacacagacaaaagagatgccagctgagggtgaagagaatctaaaatttttattagaagagagagacaatgatatctattgcaatattgagaccagcagatgtagtctgccccagccacagtagtaggggctgtgtctgcacagctggagctggtggggatacatattgctactcttagtgactcaagttccttaccttccagtctacacaatgatttggttcaaaaataggcctcccatttctgatataccacattagatgtgttggatggtagttaccatttttccacagccttttcatattgtttgaagacgatttttcatccagtgaacatttattaagcatctactgtgtgacaggctttgtgcttggtacagggaatatgaaaatgacagagagaaataagaaatagcccttgcccttaagggccttgcggtcaagtggagcaaaagataattaactactgtaaacattatggtgaatgcagtggtagagctgagcatagaggagtgatgccttatgtagttggagaaggatggtaaaggcaagtttctaggaggagttgatacctgagcttagccttgcggaataaaaaaagagctcaagatatggcaggagaatattctaggcagagcaaaggtacacgatgaaaaatggcatggatgagtgtttctgtagcatagaggacaaggtcagagatactgaagggtcagataatgaaggctcttatagcccatgctaatgagcataaacttcactgtgtggatgatgtggagccattgacagatgttcagtggggagtgtggttctcgagtgtccttcagtctattttcttcagcttcctgcttgcagtcacctctgcttgagtgtcttttagtcattgtctgtggcatcttacaaaagccctacctgaagcatgtggggatgacgtgtttacactaacagcaaatctcagttctggcagatagcaagcaaatctggctgctgaaaagacatccttaaggtcactacctattggtagggtcttcagcatcagagttgctgatgccttttcagcttttctatattgctgaaaattgccccttttcccgcaagttatttaaaatggcagtgctcaaaggcacagcaggggaagttggtgattgattatgggcccagagctcccaaagaacactggttttttgacatcgtcatccagaagttcctgcactttgatagtgctctgaaaggcctcatgttggcgtgagctactttgctaagtcattaacattcactgatgatagttctgaagacagagactccatacaagatcgtcacatcatcctagccacaaaacctgagatgtcagcatcccaagggagcttaaagcaggcaatgaactctgatgatcagacaatatgttatctagtgatgacctgaggggcatggaaggaaaaacagtcaggaaagaccattatgtattaggagacaaggagacttggtagctatttccgcaataagctcctgaccaagttaaaggtcaacattgaatcgcagggtgaatccagtattccctgtagatgaacttaaatatgaggtagaaacctttggtttcttggttgttttctttgctaataaccatacagaacacatattggttggttagaataatcgacaatgaatttgagaactacagccagtctactgggatagaaaccatgtttgtttgcagaaatgtgatatttttgaaaaattataatgtcagcaggatgtcctacttgggcaactgttctaaattagagatccataaaaatctctaaaaacggaaccatttgtatcctgggttagtacttggtcttccctcatttcccatctagtccacatagacataaatgccagatgttgttccagcatagcccaaggtgtcaacctacatactgcacacagagactcagagtgaggctttgctactgaaaatcaagtttgaaaccagacatcataattgatgatacagagtgccctttagaaatttgataaaagcttaatgtagcaaagactgtataagacaacaacgaaaggtgaatgctacaaccaaaattgtggggccagccttttgtgagtagtttttgtgagcaaaacacctggtatagattgaatgtgggaaaagcttttaaaagttttttttaaacctattaaagcaactgttaaatttaatttaaatgttttagatctgcataaaatggtcatatttccaaatggatggaagaactgaggattgatagttctctaggagtttctagttttctaaccatgtctctttcccctccttcaatcaattgctcctctccttccttctcctgtcgctaaagctcctttcagtcgctagtaagttgaattctttaagcccagtatagttttcatcctgtttccattagaagcccagaggttcccacagtgtttcacttggttgctctgcctagaagagactgaagtatagacatcaactgccattgattcttgttgagctgggctgaaagattgactgaaagggaagtgagtgatgcttggttcccaaaagacaatagagagagtaaaagaagcaagctttcttggtggagagaaggactgtttcaaggaagtgataacattggatccaaatggactttctagccctaaatttgatgtgtcagtttcatccatttttgagtcattgaaaccgagataaagatgtgaagtttctagacccaattgttattaactttaggacctgggtttccctacctgaagcatggagggatgatacaatgatctccaagtttcctttcaacttgaaaattttatgaaaaagaatcacatatggccccccggctggttatattgctactgttatgttttctttaaaccaagtctcaaatccattcaatatgaggtagattagtaatgggaaccagaaactcgggagaggccaccctcatatacagggaatttactgtcttgcgctttgtgtttgtgtttatttttacagactccttggtgacggtcgattctagggaagtaacattgatataaatccaagtggagggagaagttttctccttcatgtccccttcccaaacaacctagcttagttcatcagcttctgttgacattatttataaatgctaatgaactcataagtgctaattaataactccatgtgctgctatttactagcaaatataggaatccaggtgcagtatagacctgtccccaaatacagtacatttcttcatctctgagccaagtagcatgtctgggatgactctgttccaatactgccgaagtcagtgccatacacacttaaaaaatacacccaggagctacacttaaactctcacaacagcatcatcttcttattacccacttagataagaaaccagggtcaagtccagctgtattagtcagggttctccagagaaacagaaccaataggatatatatatatagctctatagaatgagatttgttatgaggctgagaagtcccgcaatctgctgtctgcaagctggaggcacaagaaagctggtggtgcagttccattccaaacccaaaagcctgaaaaccgggggagccaatgatgtaagtcctggttcaagtctgaaggcctaaacaccaggagttccaatgtccaagctcaggagaatgtggatgtcacagctcatgcagaacaagggaattcaccattctgcctttttgttcgatctgatcacccaacagattgaatgatgtgcccacctgtgttggtaaggtggtgagggagtgagggagatttttgttttgttttgttttgtttttttcagacagggtctggctctgttgcccaggctggagtgcagtagtgcagtctcagctcactgcagccctgaacccctgggctcaaagaatcgtcccaccacagcttcccaagtagttgggactaccaacgtctgccactacgctcaagcaaatttattttattttctgtagacatggggtctttgtatattgctcaggctcgtcttaaacttctggcctcaagcaatcttccccccttggcctcctaaaatgctgggattataggcatgagccaccaccctcaacctgggagcacttctttactcagcctaccaatttaaatgctatgctcttccagaaacacacagataagcccagagataatgttttcccagccatctgggcatcccttaggccaatcaagttgacacatttggttaaccatcacaccagcaaatggcaagattaggttggactcccgatcttgagaatggaatgctccaagtcagtgaactcaccccagcctgatctggagcatatcaaggcattgtctccttgctacagagtgggacaggaatcccataggggcagtatggaatgctctgcaaggttggactaaagaaggtctgtggggctttaaggggcactggatgccagtgcctttgctctcttatgggtgtagctgcgtctgtctcctccaatggctggtaatctctggaaagccaggagctcagtctgtcaggagccaagcctccctacacatgtgccatattgatattgctgatggatgtgtggacttgtggtcttctttgggagaccttgaactttcttcagcaaacaaggagatgaggccagaccttggttctagtgatcatattacctggagtttatcaaacacgtatgatgtaccacttactatgtaccaacttagcatcaaattcccaaaacagtgctattttgtagttattatttatcactgttccatttgagcattttgtaagctgagacagaaggataatgtaacttggccaaggtcatacagctggtgagtagcaaagctggggtttgaactgcctggtcaccctgaatgaagcccctgtctagcccaccgccttgggtgcagctcccagtgtgactgcagactccagcaatggaggcctgtccctgcacaggtggctctgtgctgtcggcagccctgctccctgggcgtcttccttcctctctctttccaggacctgttttctctccagattgaggaattggatccaattccctttcccagctgcaatttgcctctgagcccccagaacccctcctgaattggaatcgccctttcccccagcagcgctctccagccctctcctttcctctcagggcccagctccatcccttaaaagcactgtctgggctacattttaaaagtcactgttaaataaacttaggacccaccccctcagagagagagccgtggttacaggggagcagagctgaaggcaaacacttgtatccttgtattagacccaggctggggagcagcacaagctatttcttttggatgcgcctcctaggagtggaggaacttttctttgtaaagaaagagaggatctttataaacctcggacttttttcaaggaggctttatgggtggcaaggataaagctatagaggcaggaaaaagagttgctaactatatgccagtacagcatactttttaagggtggggtgtgggaggaggtggggagcttcccctcagccgctctttccctggatgcaatgaactcatggtcctttgacacctctgccaccgctccatgggacagcctgaccccctccatctctgctcctcacactgggtggtgctggagggagagggacctgtggctgtgtctgccagtcccaaacgccagcagctgcacagtcctgctataattgctaatatctgtttcttctcctttccaggccttggaaagtgttccaggaatggactttctgcagtatgatgacctgcaaaagcagcccttccatttacatttcaaactccaagtcagccgtgtcaaagtttgaaccagaactgtggaggataatgggtcagatgcaattagcagcccagagaaccacacgttgcagtctgatttatttttttgcccatcagattccaagaatcctagtgcttaaaagcaactaaacaatcgctctattgtactgaaataaagcccggttaattcagaaatcaattgcaccaccaggtggggcacactctggccccaaacagatggggttgaaaactcccctcaaaatgcagtcttgttaaattaaaaacttgatccaggagtggaacaaatagggagccatgaatggaatggagtcaggtccactcaggcggattctttcttctcccactccttttcctttaaaaaagaaaaattccccatttcactttcatcagtgttagcatctatgcagaaacgcagccatccaccctttgcagttgaatgtgttactttaattagtctgaaaattaaagggcaactccgggccaatgtgaatgattatgaaaatacatgtgcatcccatgcaatcttctcatttaattaatagtcttgtaaactatatggctcactttaagtcagtcaagaggtataacaactccattttaaatatccacttaatacttaacaggatgtgaggaacacactatagcatacggtcccttctcaagtttcactgtctgaaatttttcaaagctgacccaagtcaacctgaaaaatgtttaacaccctgggcttgaacacaagaaactctgtgatgaacagacattcaattacattttttaaaagtgagaagcatttttgtaaaatagcgactctggaaactaattggcagccgcaaaacttgtgagcaaaggccaaatcttgtggggaacttttactacagtaacacgactcaaagaaaatgtgaataaaaggcatctttgtttcccagtcaaattagctgattaagaaataaaacatcttaacatgttttt

SEQ ID NO: 36379 - DNA, 18703 bp, Homo sapiens
ggtccacccagtgcttgcggcctcgcggccgggccggcctgggctgcaatcaatgcggctttgtctgggacgcccacatcccagaggccattcccgggtcggcaaatcggagcgcggccggggcgcgcgggggtgagataagcggccatgtgatcccacctgggctggaaggggaggggcgccaggtgaggcggcggccggcggggcgcgggcggccacgcggggctcctgcagcatggctgtcagcaggaaggactggtccgcgctgtccaggtgagcgccggagggagccgggaggggcggggggtcggcggggagcctttgggtctcctctcctcggggcaccggcctcctccccgcctgggaccctgacactgaggctggatcctggtcttgctgcgactcgcgggagacaggattggggccaaactcgggacccctgaggttacagggtgggtcttctcccctcggggcctgaggccccacacagggtgcttaggggaaggctggtcctcagtctggacgcccgctgggatatggccccccctgtggaaggtggaagcaggaaggaacgttttgggggattgtggaggtgttcaggagtaacctccaagcctcattcctgagagaagcctctctcactgcccccgtgtgtctctggcggagaggacccctgggaggtgtcccacagcccctcttgggagggggagcagggagagccgtcttggaggggtcagtgaagaggactggagggaagcagacccgtctcccactaaggacgctcagaatctcagcatggcattttggggtggcatctgggctgggaaccttaagatagttgccatccccatctgtgctgctgcaatctttacttgtacactggtctcctaaagggtcggggatgaggcatcctacccctgcctgctggacatcccatcagggtccgagaggcctggggaaggcgggtgttcagaaggcagcacccctcatggagattggtgacctctagcgacttctcttggagcgaccctgcacctctgccaagaaggccccctgtgagcattttcacctcattcctccactgggcgcccccgtcccccatcttgtccctaaggaaactgaggctcctgcggtagcccagagctggagcctgctcttttgatccctttctagccaggtagatattagcctcttagctcctcccaggtgggcatttgggtcttggcctttcctgagccagggctatctctgccaggtgcagaccctccagccatttgggtcctgtaggctttccccagcaaggcatctttcacaggtttttccagtgctctagtatgtcctctaccccgctcctgccctcccttaataagggctccagaactacctcattgtctcaggcttagcctctccatagcagctcatcgcctgggactggggggccacctccccagaccctcaagacctcacagtgctctgaagcactgtgggcagcccatgggctctagagaggggaaaaggtaagccccacgaatggagggaactcagtgctctggaaaagaaacccaggctgctatagaggaaggtctatgctgagggtgcggctgaggagtcaaggtcttggactttgcatgtgggtcagtgtgcctgggggttgatgtgggagtgtctttgcttctagatgtgggcctacctgtgcctatgaatgtatgcttatgtgtgtgtgtgtgtgtggcatacttgtggacaagtgtgtttatggcctatgaagagatgacacatctgtgtggggagctggttcttatgttgctgagtcttgagtttgtcagtctgcatatgttcagttgaactgtttattgaagacctcagtactgtgcattgggttaaaaatacaaaccagacactccttcttcagaagttcatagtctggtgggatatatgtgattttgtgtctgaaagcatgcctggatatgcatgggggggtgtgtgtgtgtggggaggcagctggggcactggaactttgaaaatgggagcaaggtctggcctaagcttgtccactgctcagatggacatggactcatgtggctacagccaagttcccacaagatgtccagggtaagtgccaggaagctctggggaacagtcctgccacaggggcccctggcctgccctccctgccgggtcccagccctcatagagccctgtgggcagacgcagctgctgccaacagtcaccctgatgaggcacctggaacagaggaccgctcccgctccgctccctgggtgaacaagcctcagcgggcaggcaggaaagggctgtgagtcactgtcaacagagcctcctgggctggggaggaccgtgctagggtgtgacagcacggtcccaggtggggaggtggatggagaggtgggtgggtagctgggggccagcctgcagcccatccttggcatggagcagagattcaagtcttccaaccctgggattgggggggcagtggtgagctggctggctgggtgccctggtcagaggccttgtccttttctccccggactggcctggtgaccagtgaggctgggccaggcctgtctgcagggggtgaggggtggatctgagagtgcctgggactgaacagccagtggttaatcatttccctgcctgggccttgagccgccctcctacttccaatcgctgccctgggttctccagacacctctccctagacctttggggctggaagagacctgagttaccccccacagtgaccatgcagaaggggaacttaaggcctgccctgctcaggtgcaggagactggccaaggtcatgggcatgatcccccaaccctcctctgtcctcccttccctaaccccagtccccaagatttgcaaattatgctccttgagccccagggttccacaaaatgcatctggggcagccttctcaccctctcccagctttaagcagggcagctgagccttaatctgttgtataatgggcttctgtctatgattcaatttgggaaaatggcttgtactgctaaatatgacttttaacaaccacttcacttaaatccctgccatcagttgctgcagaatagatggaagttagacttcaggaagaaagttcccagggtagaggtcaaaacaagctctctagtgagtaacggcagaatgtcctttagaattatttaagagaaaaagaggatccccatccccaaaggatggagttgaagtctggagtggggaggaggatagcagcattacatggagacaccgagagggacatgtgtccccagatgaaggccaggaggtgggggaaagggttgtctagagggaaggagtggtaggcagctgcctggggctgtggcctcagctagtaggagcagctgagcctccgcagctgttcgggcctgtaggtttcaccctgggcctggctctggggcttgaaggtcaatgttgcatgggccacggggtttccccaaacctctgccctcccaggctcccaggctttgccctgggccccagcctgtcctggggtagggaataccacaccttcagatgccctcttgggcctctgttccctcccttgaaggttcagctgttgagctccctctgggttagggccagccctccctggccataccttttctggcacttggtatgatggttaagcgtaggtgcttttgagaggctgacctaggtttaaatcttggtttcttgtttttattagctgtgcgatcgtgggaaggttgttaactcttttgagcctcagtttctttatatacgagatggacagagtctcactctgtcactcaggctggagtgcagtggcatgatcttggctcactgcaacctccacctcttgggttctaagtgattctcatgcctcagtctcctgagtagctgggattacaggcgcccgccaccacggacccagctattttttttctatttttagtacagatggggtttcaccatgttggccggcctgatctcgaactcctgccctcaagtgatccggccgccttggcctcccaaagtgctgggattacaagcatgagccaccgcacccagtggctgttgtaaagatgaatgccaggggtattagaacagtgactggtgttagagtaagcacttccacgttagtgtgctcacttccccccttattcctttagttattcaccatgttcaagaagtgcctaacactgttttgagccctcagttttttaatttattactggggtttcaacagctgtacccactgagtcccctcctggggactgggctttgcccttccctcccttccatttttatcctcataacttgtgcttattggagataacatttctccccagggtggggtggtgctgctgaagggactcatgttttgccaggtgtcagggttgaaggcagccccatgattcccaagcagcaggggcggtggccacatcaccttgggtgagctatggggtcttagtataaagcttggggacactcaaggatccctgggttctgagtcctgcagctgagccctggagacccccaggagaccaggctctgagtgctcatgcaccatccagggccccacaggaggataaacaaataggccacttccccaagggctgagggtggcatgtgggagctgtgtggctcaagacccaggaaccctggaggctccagctcagccagctgtgggtgtggtcaggggagaggcactctgggctttgtgggccactttccccagtatttggatccctcagctttggagggcaagagctgtttccaggctatggacaagggacggggtgcatccagaggagggagctggaggtgtggcctcacgtgtaagccagcagaagttggcgtttctaaatctgaataagaaaaccaaggagaggtgggactttggagcctgccttataagagagcatctgtttgtgtgtagtgaatgaaggatgaatgaatgatgaatgttcaatctacaaatacccagagctcacagcagtcatgcagaggcccaggggaatcttgtttaagttccgtggccaaggccatagggggatagtttgatttgggcgcctctccatctcccctgaggaagtagaggtgtgactgacaggagggattgaggttctcaccaggaagagctgccctgctggcagaattgggagggtctggaaggttctcctccaaaggcacttcctttccccttggggtgatgggcaggcactcgccttccctgggcagacagctgggcagattgcctttgggggaggagtgggctttgttccccctttgtgcgcctcggcatcgaggcagaagttttgtaatttctagggaggaggagagcccagcacccctgaaattgacacttacttgctgttccacatttgtcagcacctgctgggtgccgggcaccgtactgggcactagagatgagacaccctatcctgcggttgtttctctcactgcaggacaactcaatcactcttcacttatatagagatgggggtctcactttgttgcccaagctggtctcaaactcctgggctcaagtaatcctcccaccttggcctcccaaagtgctgggattacaggcgtgagccaccatgcccagccagtcacactcttttcaaccctctcagaccttctccactctctcctttgtttgctcatcaaaaaaaaaaaaaaaaaaagcaaaacttaagatctgtacattaatgtaaattataccttaacttaaagcattctttgagcccacatcctcctctagctactgtcccaacttttttttttttttttgagatggagtcttactttgtcatctaggctggagtgcagtggcgtgatcttggctcactgcaacctctacctcctggattctagccattttcttgcctcagcctcccaagtggctgggattataggagtctgccaccatgcccggctaatttttgtatttttaggagagacagggtttcaccatattggccaggctggtcttgaactcctgacctcaggtgatccacctgcctcagcctctcaaagtgctaggattacaggcatgagccactgtgcccagccactactgttccatgctatttgcttctcaaaagagttgttgatactcactaattccttttttggtttccatttacccccaccagcctgctcaggctctggtacagccctggcatctgcttttcctgtggtatctggtgcctctgtgctcacaattctgtcttggtctcattcccctcgcagcagcatctgactggggccctcactcccctgttcatgccaacaccctcctctggtttccttccagctccctggctgcaacgtcttgatctttgcctttcgctggtttcttctcctttggaacaagccagaagcacagctcttcatctccttcttgtccctccccactaccacccaacagcccaccacactccttcctcccctggtcttccccatgttattaatggccctccagaaatagcttgggcccaaaatctagcagttcttgatttttctcttttcctctccctcctcccacccaacatccaatccaacagtcaaccctggtggctgtatcttcagaacatgtcccgaatctatcacttttccccatattttctgtccccaccccagttcaagccaccatagttctagctctcgcctatgggattgcaggtgccttctgacgggtcctctgtttcccctctcccctggccctttcaatgtttttttttttcatacagcagccagagagattaaaaatagagcgatcccatcatgttgtttttctgtgtaacactctccagggctctccagcacacctggaataaaacccaagtcctttccctggtctccaaggccctctgctctggccttgcttccctctccagcttccctgtgggccactctggccctggtttcccgtcttcccctgaatacccagctcctcacatgcaggctctgcactggctggatcctcctcctggaacactggctgacggatctggctctgctgcctcctcctcatgaaccagggctctccgagggggctttcccacccagccaccttctctcatgtcacttactttgttcccttgtcctagtgacacttagctggtgtcattttgttcatgggcttgtttccttgctcatggtctgactcccccatgctggatgtgtgccctgtgaaggggaagaccctgttggtctcattcccagctgttcccagcccctggaatcgtgcctggtacatagtaggtcctcaaaagtaattttttagtgaatattggctcaatccaggggatgctggacctagaaaaaaatcggagcggttcatgtggttcatccttctcattttaggagggaaaactgaggaagagaaaaggaagtaacttgccaaagggcaggaggactagaaaccagatcacctgaccttgccttaccacagactccctgtggaggagacaggctcagtgggaactagggctgagcagcaggagaggctgggacagcaaagggtagagagtttggcatctggcagtggcaagaggaggccttgcagtcgttgctataactctgggagggaagaaagaggccttttctagaaccttttaacctgatttgcagacaatgcagggggaaccacagagaagggctcccccagctgactttcacagcctggtactcccctgctcacaccccctcctgtctcccggggtgaagctcagcctcctgtccccagcaaaccctgaacctcggtaccttccctctgcctggactgccagccccaccccatcgaaagcctgtttgttcactgagatgcagcccggttcatctcttccatgagccttttctgataatcttggcctatagcatctgttctctcacactgaagaacaacttatgcactttggttgggggagttattggtggacacacttctctttttcactggattgtcaatatctccagggcagagaccctgccatgttctgtgatgcccacacagttcctgacatggtgctggcttgtcatagtcattcagttttcatttgctgtttggttggactggaaggggtggggtggatggaagatgggctggtgggaggtggtaggtagggcaggtggataaagatggtggaaacagctgagtggctgagtacatggatgtgtgggcgagtagtagatggatagactggtggagttgcctggctggctgtagaatgcctgcttggccccatgaatgaagggtgactggggcaggaaccaaaagtagagtgtggggtccccttgctccccagagaagtgaaagttgtctggattttcatccagatctgtggagctccatggctcaactctttccacgaagctctttccatctgaaaggtgagggaggctccaagagcccctgggaagtgaaaggaaggcgatattggagttttttccatgggtaaatggttttgtttgtaagtcttcccttcccaaaagctaagaaattccatggggaattgagtgaggaaatatctccatgactgtccactgatggatattacctaagaatcccaggaccaaaaagagaaaggcacttggcaagttcatctgtttccttcaggcaggaccaggcccgcccttccacgttcctagtcacccccggtgatggaggccctcccattctcatcccggggtccagagtacagttcaacccagtggttcctatgtggggtgactttgccccccaggagacatttggcaatgtcaggaaacattttggttgtcccatctggggcatgtactactggcacccagcaggtagaggctagagatgctgctaaacgtcctgtgatccaggacagccctggacacgcaattgtctggccaaagtgtcaacagtgctgagctggagaaaccccagtctaatccaaagccctgcagctttactaggaatttgatagacgtatgatttgaactacatttaaaatgttaagttttttttgagatggagtttcactcttgcccaggctggagtgcaatggcactatctcggctcactgcaacctctgcctcccaggttcgagcaattctctggcctcagcctcccgagtagctgggattataggcatgcaccgctatgcccagctaatttttttttttttttttgtatttttagtagagacagggtttcaccaagtcttgatctctggtgatccaccctcctcagcctcccaaagtgctgggattacaggtgtgagccaccgcgcccggcctaaaatgttaagtttttgagtagtcacattaaaaaagtaaaaagcagcccagcacagtggctcatgcctgtaatcccagcactttgggaggccaaggtgggaggattgcttgagcccaggagtctaggaccagctgagcaacattgtgagacctcatttctacaaaaaatctaaaaattaaccaggtgtagtggtgcacacctgtagtcctagctactcaggaggctgaggtgggaggatcacttgagcctgggaggttggggctgcagtgagctgtgattgtgccactgcactccaatctgagcaacacagcgagatcctgtttcaaaaaaaaggaaaaaacaaaattaattttaatattatagctcatttaccccaatatatccacaatattgccacttcaacacacaatcaatatacacaatttttttctttcttttttgagacagagtcttgttgtgtcacccaggctggagtgcagtgacacaatctcgactcactgcaacctctgcctcctgggttcaagtgattctcgtgcctcaacctcctcagtagctgggactacaggtgtgcaccaccacacccggctaatcttttttttttttttgtatttttgtagagatggaggttgccatgttgctcaagctggtctcaaactcctgagctcaggcaatccgcgtgtctcagcctcctaaagtgctaggatcataggcatgagcgaccgcgcctggccgatgtacatagttcttaatgagacctttcactggtcttcaagatccagtgtgtatttcacacagcatgccttggttcacaccagccacgtttcaagcacttctgagctgctagtagccagtgcaggcctagagggcatttggtctcttctcccagccctagaggagcctgcctcgggagggtcctgggtttccccagctgtgctgaccctctcctcccctcccccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagaggtaggtgctcaggtttctatcctgatggatggggatggactggttgcctcagactaagtgcagcatattcagtctgctcagggagttggggcccaggaaatgaggctgaagggtgtgatgatgaatttccagttccccaccttccccagactcagtcctgccagcttccatcctcttcataacaatgcttgctactatttgtagaccatccatgagccaatactgtgctggacattttatggccatagctcacgtaatccacacaatgtccctgagagagaggtattgttaacccattttacaggtggagtaacagggttgaaaagtacttaggtgacttgctgaggtcacgtacctcaagagtggcagggccagaatgtccatccagatctgtcaagctcccgcctccttccattatccaggctgccttcttctaaccctgaccctctataatttacttctttttttttttttttttgagacgaagtctcgctgtgtcgctaggctggagtgcagtggcgcgatctcagctcactgcaagctccgcctcctaggttcaagcaattcttctgcctcagcctcctgagtagctgggactacaggcacccaccaccacagccagctaatttttgtatttttagtagaaatggggttttaccatgttggccaggatggtctcgatctgttgacctcatgatccacctgccttggcctcccaaagtgctgggaatacaggcatgagccaccgtgcccagctgccttttttttttttgagatggagtcttgctctgtcaccccggctggagtgcagtggcgcaatcttggctcactgcaacctccgcctcccaggttcaagctattttgcctcagcctcccgagtagctgagattaaaggcacctgccaccatgcccggataatttttgtatttttaggagagatggggtttcaccatgttgggcaggctgatcttgaactcctgacctcaggtgatccaccagcctcaacttcccagtgctgggattacaggtgtgagccgctgcaccggcctataatttacttctgaggagaagaaccttggggctagttttgccatctagattttgggattatgaggtgggggaagagcctggggtttactgaatgccacctacatgccaggactgtcctgggcaccctcatgagtctcattttgcttcctaacaagcccagtttgtagatgtgaaaactgaggctccgacagtaagttaacttgcctgaaagcacatggagagcagggtgatgaggaaggaaaataatctccttttgctggaggccaggtgctgtgggttatggacaatcctctcatgttacttttgtttctttgggtcccccaagaagggagaacagggctgtgatgaccctctcctctcctgtcctcccctcccccagccttgcccggcagcagactctggaggatgtccagagctgggctgcaccagtacctgtggctgtcacctagtcttggctgcacccacaagactgacaggagtgtggaatggtgcatcggaagacttaggttctgctcccagctcccccacgaatcagctgtgtgaccttgacaaaatccctggacatctctagtcttgatctaagatctaaggggcagagactgtgcttattccttttgatccccaatgccccaagcaggctctggcacatattaaagcagttattcagagtctgttgactacgtctgaacatggagtcgttggacttcataggaatttataagctttttaaaaagcatagtgtgctttgctcagatgataccttggaagtgcaatatatcgagtggataaaggtggtggtgagccggggaggccagggcctgacatcctcacctcctccttggtggccctggcagcatctccattgggttaggtatacttagggtatcttccacctctatcctctgattctgtctcccatcttctgattcagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggttggcagtgtcccgtccctcccacccttctactctgccacctggctggcactgccggccagtcccacccaggtagtccctggttccctggctgcctccatcctcctacctgcaggctggccttggaagtctcttctttccctgcctgcttctagccatggtcagagcagggaggctgagatggggcaggctgctggagcttaaaggggcaccagctgtggggcagggagcatctggtgccccccaccatatcctcatccagggcctgggctccaggaccccggcagactagtggggagcctcagatccttctagaagctcccctggaaagctctgcctggtgccctggccccaagggactttgtctgtgagccactcccacagcagatgaaggaggcaggagagaaggcacagggctgtctcattctcccctcttcctgcagctcctggggtgagccatggggtttatggctgccccggcttgatgggccctagacctcttatgtgacactccccctgctccatccaggtgaaaatccccagcaaggaggaagaggcagatatgtcctcacccacacagcgaacctacagcagctccctcaaacgctccagccccaggaccatctcctttcgggtgagagccctgggcaccctggtctgcgagccactggagggcaagtggaggaagcccgcatccattacaacataggagccgtaggttaggtaggaaggtcccctggatagagaggagctttggattcccatgggtggccctgaacaaacaaggttgtattcagcagaggagaacaggttagtaacctggggggtaggtgccagtaagcatgagcagccccacctagtgggcaaggccagggctgcatgaagaccggacaggcagggctggccctgggctgcagggaggtccacacctgccttcatcagttcctggcctcacctaggagacttgtctaggaggggaggggaggaacagagagcagcaaggctctcctactgctccctgccctgccactctcccaatagtacaaactatgtggattggggaaatctcgtcttgctttgtcctggtgtttattcttggttcttctgttcactgggtcattcactcaatcattgggtatcatgcctctaatgtgtgccaggccctggagaggtggcccaatagcgactggtgcccccacagagctcatgggcagtgggaggcagataggaaacaggtggttacaggtgccctgcgaaggaagtctgaagaaagtcttctgacccatattagtgggtgggaacctgtgtcttccagatacaaacaaggatctttaacgaaggcttgtccacatatttctttggtggggttgacccctggtagaaggggtgggaggtctgaagaggaggaggacatgtcttgagagctgggctcctcactcgagggggccaccgatttcccggggactcccacacaacaatgcctttccttctcatttcagatgaaacccaagaaagaaaactcggaaacaaccctaactcgcaggtggggggcctggaggctctggttctttctatttggccatgttcaggctattttctgagtacctgcacccgccctccttgtgccaggctgtgcggtagggcacatgaggggaaggtgcagtccttgcccagggctccagatctggcagggggatgggattaacaggatgaactcaggcgggataagatggaacaaggatggggaaggatcagggagagctgctcagaggaggcagggcttgggtggggccccaaagggggatgagggtttagccttgaggttaggacagggaaagggggctttctgggagggagaccacgaacagtgtaagggaggggaagcccctgctccagcaggcctggttggggggctgtgggtctgcaggtttaacaaggattcctgggctcgctggtgttgatgcaagaagcctgaggactatgctttgaaaaaaaagcaaaactgaaataggatctgagaagcagatgtgcttatgtattaggaatgtcatccactcatgctgtattcatctgccccatgaacatttactggagcctactacactaggctaggcctgggggctggggtgggggtggaggaggaggagtacaaagacaaatgacacagctgctgtcctcaagcaactcacacccacccagcaaacctatagcagctctctcaaacatgagaacattacatactggccaaccagggagggacagggacacaggaatatgaacccagggctaggagctcaggagtagctgcacctgctcagcctgtgagagctggggaaggtgtcatggagcaattgattttccatgaactagcaggaagtttgctcatgtaaaactggaggaatagcattttaaatagagggaacagcatgtgaaaaaggcagagtgaagagcatggtgtccagctggctggcacacaggcatactgtgggggagggaaggggagggcccagatcactagagccttgtatgctgtgccaaggcctatggggtctgagctggaaggacaggatcagatttgaggtaggagcagccatgtggagagctcacggtggcaggctgggagagcaggtaagtggcgattgctgtgatggggaagacggaaaggaaggacctgctttgggaggtgttttgcagtggaaatgacaaggtatgggggagaagggatgtcctattgaatgggacgtttcttggaagtggagggaaatccctggcgtctgtaagttcctcatgttggccaagtcaacacagcctgctgtgtgatggagggccacattctcttggccacaatgagaacgtgtgatggggctgctcctcaggccctgggggcaggcctggtctccctgggtgtctcacttggctcgcctgttccatcttccatcctgcagtgccagcatgaagctcccagacaacacagtgaagttgggagagaagctggagagataccacacggccatacgggtgggtgggggcttctcctgaggggcggagggtgcaggatgagtagtgggcatggccctttcccctccccagcatgggtcagctgttggtgttcttggttcccagagatcagaatctgtcaagtctcggggtctgccttgcactgagttattcgtggctcctgtgggtgtagccagcaagcgccacctctttgagaaggaactggcgggccagagccgagcagaaccagcctccagccggaaggtgaggggctcaggccccacagggtccttagggtgattagccctgacgtctccaaaacccaaatcttggctgtggcaatgctagaaaactgttttcatgtgtcaattaatgttggcagaacctccatttgagttcccattcacgttcctgagcccatctccttagctgggcacacagctccctgggggaaggggagggggctgtcccaggtatatgtggcatgtgctggatgcataggggagtgagggagagtcctatcccattccagggcctctgaacatgcctcgctgctgccaagggccctaaaccctgagatggaaagttctctttttaggagaacttgaggctctcaggggttgtgacatcaaggctcaacctgtggatcagcaggacccaggaatctggagatcaggacccccaggtatcctcaccctccctgatgtctcttactgtggagcctttgtggtgggatgactggggacagaggagggacagtcgggagaggaggagtcatttcgggagaggaggagtcatttcgggagaggaggagtcatttcaggagtggaggcagtcgggaatagatgggtgtgtgggtcagactctggcagagaggaggggtgggtctgggttccttttctcttttgggaagagaaaggacatcctgggctgggagctgggcctggggtatcccgagccctttggagcctggtcttagtctctggtctccaccctgataccctcaatcaggaggcacagaaagcatcatctgcaaccgagaggactcagtggggacagaaatctgactcctcgctggacgctgaggtgaatggtggggaggagcctggccctacggcggagggccacggtgtactgtgggagaccccatcgtccccgtgtgcacacactaattggcctgcaatcgcgcagtccacccagaacgcccccatccctgctcatgcagattggtctgagccaaccgtgagaacaaggttgagccctcacctggttgtgctgcctgcagctctgcagagcccctccctcttcagctggcagattacagggctctgactccttgtgggtgtggggcttgggcaaagggatgccttcctatccagtggcccccttccccttccatccctgacaccccattgacttgtgctaacagctctttgccccacaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattaga

SEQ ID NO: 36380 - DNA, 29376 bp, Homo sapiens
atccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggagtaagccggagcagagggctgggggccgggttcctctcccccttctgctgcctcttcgcctttcatccgcggctaccctggtgtgctgaggttcccgttccagcagctgcacaccatatgcgctgtggaggggaccctcctggcagcccctccgccgggtccctcctggttcgcacggttccctccgcttgtccccgagtctttccctcacccattctgttctctctcacccgcctgctgtcttcccttctttgatctcgtcggtactttccgttggatctagaggtgtttggttacctcctacacttcctagcactcaaacttgcttctaggtatcatgtttcacaacgccacgtctctaggagaaatgtgccctacccccagccatcccaacctgagacatgttctagaagcccccttacttcctttcccgcttccaccccccacccccgatccccgatttctttgctccggtgttagcaatggttaatgcttcgcttgaaccccatgcccactgacggctcctgagatggcatatagtagtattagagtaattttttaagtctttgtatgtcagaagacattcttatactgttggaactacacattttcctctcagtgacttggtgtggtctttgatcttttctctcgtagtaacacattatgtaactttttaggagaagggatatatttttagggattgattgtttctgaacctgagactaagaatagcattacatttttagccctttaaaaaaattggaagcattgaaataatcttgggttcatattttattcactctctgtgtttggcacttttgtagataagagagccttgctagagcatttacttacgtgaaagaaaacatatctgcactttttagtgctgatgtgtcactgctgactaaggagtcaatcgtagcacttggcatgacataagctctgttcagtgaccatcagatatacccgttgaacaagtggcaaatgcctttatatgagatgaggagctctggcagtttgaattctatctttgtgtgtgattaatctttttttttttttttttttttactataaggtttagggtacatgtgcacaacgtgcaggttggttagtatgtatacatttgccatgttggtgtgctgcacccattaactagtcatttaacattaggtatatctcctaatgctatccctcccacctcccccataagtaatcttttatataaggtttttatacatcactttagattatccagttcttgaaacaaaatgtttcatttctagaaagtaattactgaataggaagcacccttttaggaagcgctatttctctcaaattaatgtgtaattgaaaggtatagattttaatttgacttaatgaccaagtcattaagtagttgaagtagagtgcagttatttcgttactcagcagtcatttattatgtgcccatgcagcaagggtatattactgggcatttgttatcaaggtatctctattcttgatacacaaaggtgatgcaaatgatatcaaacacaagtttttggagtttttgtttctatttgtgggatgatgaattattcagtagtgatggatttgttcacacattttcacttctacacctctccactgcctgcctgttcttctatcccttttctctttttctcacactcacatacactacattagccaattaggaatgttaatcaactagtcaaatcagctaccttgacttcctttacagagccggaaccaactaatctattctgctgcagaaatgtcaagataatgtaccagtaaattaaagccgtgtggctagaatgaatttgaaacaaagtattagtattttagccatgatttatctggctactggctctgggaatctctgctatagacatcccttgctttcattgtcactgtagtttttgcataagcctcactgtaactacattgatcatttttttcttttcgttttgctctgcaattcattactttaaaaaaaaagtagagaaatttaagatctagtttaaacacagccctttaccttcaaccccaaattaagaccaaatctatggtgtttctctttcttaactctaatgttcctttagtacacttaaggccataagggcaaaaaatgataatttgtaaccctttatagctctcagagttctttcactttcattctctgatttgatccttagtagacaaggcgggtgttatctgttttatagatgaaaaactgatgttcagaaaggttaaggtttttgaaaaaggatacataagtagtaagtgtcagtgaagttgaactcaaatctaggtcttctgattctgtgttcagtctctttccatgatgcccacaccccatcctttgaatgtttgtaagtaacagtgaacagtgactgatcctactaaagtatctcagctttcctttttgtcaacttttttctacctgtaaagtgagattacagttacagttgtatttcccagcatgggtttcagaattagttaatatctgagagctagaattgttcaaattttaagtctgatagacctttagtaattacctagtctaataataggagaaatagctaacatttattgaaacatttaaagctacttgtgtaggcacttaaatacctatgaggctgttcaagaaatggagtaacttgcctacagatcaaacagctagtaagtagtagagctggggcttgaacctagcctggagatgtaaaccaccgttttagggatcactattttctctgagaatcttctgaagaattgctttttgaagttcagttgaccctctccatggaagaatgtatataagtacagtattttgcatataacttttagggtgtttatggaagtgatcgagcctagctccttcattttacaggtaaacatatggtgaatccaagagaataagagaattatttgctcaaagtcacacagctgaactgagactaggaacaagtctcttgattcctagtggtatgttcttttcacactgtttgagctttctaacctttgcaaacaggtaaaatacgttgcagcttttctaaaaatacaaatttttaaggtttttaaaaagaatgttatgagactcagatagtttgccttaaagtcataattccctttctctcacccactgtccctgtaatttttagtgtatgagtgtagctttaattttttttatttgataagggaggtgttagccctaaacttttaaagttaaaactgtcaacatgaaattttttccaaatcattattgtacaggttactaagtctctgtaggtatatttagcagtttggaaatgatcattgagttttacctaattataacttaaagcttttttcccctgatttctgttctagatgctattccaagttcagatcaaattcgagtagcaccatctttaaaaagccaaagaggctcagtgtggacaaagacaaaagcggcctttgagaactgggaagttgaggtgacatttcgagtgactggaagaggtcgaattggagctgatggcctagtatgatcatttctttaacttagaaaatgtgcataaatgcatataccactagcctctaactgttccctattacatattttcaggcaatttggtatgcagaaaatcaaggcttggagggccctgtgtttggatcagctgatctgtggaatggtgttggaatattttttgattcttttgacaatgatggaaaggtatatttattgtcaggactgttatccactttaatacatctatcaacagagttaggctgtgagaaataatagcttattcaatgctttcatcagtttgatagtacagaactccccaagctatatggtaaatgtgataattagtctttatatagctaggaatgtatcagtttaatttacatgtgcatgattttttgtacatcagcttgagggcatagtagagccctgactctcagaactttgcagtgacccctgctcccatggccctatttaatggataaatacaaatccttagacgtaggtggtgaaaacagtagtgtttaggagactctactaaacacttacataagcacatccaagtccatgactaatgctagctcacatattcatgtctggtcatatgttaatcattctttttgatcgggccaatttttctgatgatctctcctaaaacagttaagatcaaaatgtacttacaaattggaaacattagcttgtggcttaacagccttaaggttgatgatcttcccatcagctggttgtttctctattaattttcaggggttattgttagcaatttaaagaactttagtaattccttgagtgccaaggccaggttattttaaaattttgagtcctagaatcttagatatgtaagtcacttcatagtacatcaagaatgatgtagaatgctttgattaaagacattttttaaaatgttttccttttttttagaaaaataatcctgctatagtaattataggcaacaatggacaaatccattatgaccatcaaaagtaagtgtgtgttttttacattactcctgatttcagcttctttttggaatccttatgaaatacattgtttcaaatctgaacaccttccaaatgaaaaaaatactgttctttttcttgagacatattttgtaacttggtagaaaggttttattttatttggttctgttctgaagttctatctgtggaccatctcagattcaaccatggtatgtgtttttaatttaacctcaaattatttaataatatacttttgaaagtttatagactgttcctggctctcagtgatgccactaatcatgcatttttatcttcattaaaagggatctttaaaaaataaagttgagccttgattattaaggctgatgattaagcaatttatgccatcttatttaacttcaatattgtgttatttaaagactcagtggtttgcagagattctaagtgttcagtacagtcaaccctctgtatttgtgggttccgtatctgtggattcaaccaactgcagatcaaaaataatacaaattattttgtgtacgcaacaagaatacaaattttaaaatacattgtaacaactatttacaaagcatttacatcatattaggtgtgataagtaatctagagatgatttaaagtatacaagaggatatgtacacgttatatgtaaatactgtgccattttatataagggacttcagcatctgaggattttggtatccacaggggtcctggaaccaatgtcctatggatgttgaaggatgactgtatatttataatgtatataaattaggtatgtacattttttattttcacgtgtttgttgtggaggaaatagcttttaaccagtgaactgtaagaaaggtgacttatccatgtgcctgtttactgtttttctgccttagtgagtttcagccctggtagttcatcataactccctatggagctatttaaaatggaggtgcctaggccacctccttttgattctgcttcagttgatttggagtggaatctacatgttaaaagcccagagagtgattcatgttctgccctagggtagagattcactgccttagtctcatgtagtctcgtgtagtcttttgagtaaataacataaagtatctcaagactttttcataacttgatattattttagtcttcctgaatttttaaatattgaaaagctgagtgtcttgtctgttttcctcccccttacactatagtgacggggctagtcaagctttggcaagttgccagagggacttccgcaacaaaccctatcctgtccgagcaaagattacctattaccagaacacactgacagtaagtaacatctatttagagagaatcaaataaacaatgttacagtatcacttttcattttgaatttttgatagaaattaaatgcacttaaatttggatatgcttacatactcttcattgttactctaagagaacggaggtggcttcacagctcagtgtaagtggtcatctgttgtaaacccctgatggtatgtttccatttagtcagtaaatgtttaagccccctactgtatagcacatgtgagagatatatatatctatagatagatagatagataggtagatagatagatagacggataatctccaagccttcaggatacaaatatgagtaagacagatggactttctccccagagagcttatagcctaacagaggacacacaaatgtatcattcctatgctgtgtgataaatgctgcgttgcagacactatcaagcggtcctgtggttagaatcctgtaactgccaggtggaggtggggaagggcaggaacattttctcagagttgagctgtgccctacagggagatcaggaagttcctgggagttgggggaagagggtgtgtgtgtgtgcgagtgagtgggtgtactccaagcacagaaagcaggcataggcccttgagagagcttgaaatattttggaaaggcatgtagtttggtgtggctgggagatagaagagatcagtgagcagtgaggttgaaagggcagtaacaggccttgcacagcttcctgtagtttaacccataagaagcttttaaaaatgtttaaagggttttaagcaggaagtgaaattatcagatttgcaatttagaaagatgacttaggtcccagtattcttagtaccagttttcttggggttaggggtgaacacagttgttgagtcaaggagagttcctgaatatagccaattggacagctaattggtactatttactagcaaagaagcagcacatttgtttgtgttttatctgtttgggggaggaatgggaaatcagagggttggtaatgagtttagttgtaggtaaattgaggttagcataacatataggtggagatatctaactggcagttatgataactaagatcactatgcattgtaaactttgctttttaaagatgccattaatacctggttatataatacttaaaagtaaaaaaaatagtgtatgaatttttctttcacctaaatcatgagctagacttacactcctgggtctaaatctctgagaaagttagttctgtggaaaactgtattggcttagtcttaattccaagctaatttagagatcttagaatagagcaagtgtccaatgtattataattagcttgggtttgaattccactataattattcaccctgtacagtttcattagagtcatcagtaagtcttgcttacctgcatgtagcaaagcccagacatcaagcatggtgggtgcagactgtccgtgtgacccaacaccgtgaggctgtgagccctggcagcactccaaaacaatagccttgcaaaacgtactccccagaaagggttccacaattgatgagattggtcactactctgcatattagcacattaaagatttctttatgaaggatcctttataaagaaaggataaataaacctttattagacctcacatttcccagactgacttaactatggaattttttttcacctaatgtctatgagtgatcatggagctagtgttttcaggtacacgttttgaagagactggctggacacgtgactgctacttattggttttcacctctctgtacatctcagtctggtaataattccttttctttctacttgttaaagtcatacttagctttgagcacacaaattcagatcccttttctatcagatttcctaaacagctcataatgatctgtctctcctaaactcttagagtatttttttttctctaatgcttatttggccttgagatatgttgtactgatttgcttattaactatatgtatatctcttcttatcaatatgattgtaaacttctcacaataggcatatcctgtatttctcctagttcctaatattgtgccaatgtgaagtgctcaagaagtatttattttcatgagtacttgcaccctagcttgtcccagttgtttccacattggagggaaaaacaaagtaagaggaggttgaaagcaataagtgctgttggtgggggaaacacagccaaagcaagagatcttaaatattgcaagtgtagtctttaacaatggtttgaaaccataaggtgaataaggaaggttattgatgatctcataaagaagtaataatcagtggacagtttgtacctaggctttcagttacagtccttcctaacattcctgctaactcacagtacaatgaaatgtgttacgtcctttaaaaaaaaattggggccgggcgcggtggctcacacatgtaatcctagcactttaggaggccgaggcgggcggatcacgaggtcaggagatcaagaccatcctggctcacacggtgaaaccccgcctctactaaaaatacaaaaaaattagccaggctttgtggcgggagcctgtagtctccgctactcgggaggctgaggcaggagaatggcgtgaaccctggaggcagagtttgcagtgagccgagatcacaccactgcactccagcctgggcgacagagcgagaccctgtctcaaaaaataaataaataaataaaaataattggaactagacaatgaagactcatgctggattttcagtttgttagaattcaaggaaaaaaatactgaacaattggaggattttagtattgtaatttgaatgtaataatctacagtctttttaagactcaaaggcaaataacttcctgattgttgattctaatttaaaaggctctgtggaggaggaccagttgtaaatgatgtaaaatgaaataggaatattactaatcacaggaaacatattaatatgaaccaaatgctaaatgatcttttaaaattaattattttaaactaatttttagttcacatgtttccattctacagtatatagagagtaactcttcatattgacagattttattctcttgctgaaaatttggacagaataccagaacattttgcctgtgtgactgaatcttaagtctctgacaaaattttgactctagaagtaatgactcaagttcccttactctggtgccttgggccttctcctgcaaccaccctgaacctcagtgactgttgtttagggtgggactcgtgagaggattattagaaatgaaatgtattgaagaggctgaaccactgcttgactgggataatgagaaaagcattcatgtgtcaggtggattcctgtgcttgcctaggattctaagattctgttaagaaatttaggatcattccttcaaatatacattttgcaaagtagaaacgtacatctttttagttttttccttctctgccttgtcagtatgacttctgtcacttttgttctctgctaacctgtgacagtccagatacctcactaatttaattaagaggagctcactacttgttgagacaatctgtttaattctcaaccagctgcagataaaattgtaaatttaacctcttggttttagctgtcactgggatctgagaacaagtctgatccctctgctgcatgaaccattccaagggagtaatgatgactccctaggtcttcttgagagaaggcaaaccatattccattttagaaaggttttcatagaaagttatcagatttttctctctttaaacttttgacacatagtggggcaaaactcatttttttaagtaaaatatattgtatattgacaccaagtaggaaacgttatttaaaattactctttataataatgaaacaaaactgaatagtagtcataaaatggatcgattgaaatttattttctaatgtcttttgcaaaagctatagctatgatatgtctttctaggtaatgatcaataatggctttacaccagataaaaatgattatgaattttgtgccaaagtggaaaatatgattatccctgcacaagggcattttggaatatctgctgcaactggaggtcttgcaggtaaatcttgcagtctgatgatattaaaagtttgtgaggtgtgttttattgggaatagtatattagggatatgtagacttgtttatactaataactttttaagactgtttggaactttcccatcacctcttgtgccagtcttttggtctgttgagattgctaattttctacttacattgttcggtaggtgtacagttaactggggctgtatacaagtgtgtcaattacagcatcagtttgggtgctattttatagtgaaggagacatatttaaagtagaggctatcaaagtcagcaggcttaaaggctggagatcaaaccacatgacaattaactaaaatagcagtcttggctagtcacatccacagaaaggttaattgccaagtgttttaggatcctgatcattgtcacatcacatgtaaatgaatttggcaacctaaggaaaggttatttggtgactaaactttaaacaaaaccatagttaccatttttttccacataaggtgataaattaccattcaacgtcaatgccattttatgtttatatgacacattgtagttttaaatattttcaaatacatggattgttcctgacaacccagagaagaagggagggaagatcctattttccatatttttagaagaacttgccaaattttaggtgaaagaaatttctgaagatcgtatggccaattgatggtaagccccaggcaggactcggcctggatttctgactccaggttcagtgccctgttacccaacacagtttcttaagttacttagtctacactacagtattatagttttctttttaatctgtctacatctctagattccgtaaaaacagtacaaagcataaagattgctgtacgattgatattaattgctcttgattggtggatgtgactagccaggattggtattttagttaagggttaggaagtttgatttgctgagctggtgcttttagcataaacagcttgaatttgattttttgatatgattttaggtaagataaaattattaatatcttccatgtgagagaaacaaataagaaagtaagacaaaaggtggtatgcactcttaagaaaggttcagagacatataggtacccggcagtatgtggagaccaggattttctctcatttgtctgggacgttgtccatgaaggagatttgtgggaaaccatggaggatcttggtaccagaataaggagtttggacttcttttgacccttcatttgtttgttcatttcttatcaaacattgattaaacatctattatatgttaaacactgctaaatattctgatttagggttttaaaaagtgagttttggattatttctaatataaatctttcaggtgaattttggtctctaagctcacagagtgccattgcctttaccaaattagtgctaatttttgtcaattccctcactggttattgttatttaaaacaataaatattgataaaatacatttacaatgataaaagtaatctcctatggaactttttcagacttttttttttttaatttgtagatgaccatgatgtcctttcttttctgactttccagttgactgaacctggaaaagagccggtaattttacacatattttcaaaaactttatcagtttagtttgccttttagctgaacgttttggaagactaacttaggtttggatcttgtttctgccagttactgctatatggtcttgtgcaagtcactgaacctctgtaatgcttcatttcttttttttttttttttttttttttttttttttttttttttgagacggagtctcgctctgtctcccaggctggagtgcagtggcgcgatatctgctctctgcaagctccgcctcccgggttcacacctgtagttccagctactcgggaggctgaggctggagaatcacttgaacctgggagcgagaggttgcggtaagctgagatcaagacactgcacttctcctgcctcagcctcctgagtagctgggactacaggcttccgccaccacacccggctaatttcttgtattttttgctagagacggggtttcaccatgttagccaggatggtctcgatctcctgaccttgtgatccgcctgccttggcctcccaaagtgctgggattacaggtgtgagccaccacgctcggccacgcttcatttcttaattgctaaaacagaaatgtttgtactggccacctcatgatattgaaggattgagacagtgcacgtatagcaagtgctcagtaaatggtagtggttattattagaggcaagagtaggccgggtgtggtggctcatgcctgtaatcctagcactttgggaggccaaggtgggcagatcacctgaggtcaggagtttgagaccagcctgaccaacatggcaaaaccccatctctacaaaaatacaaaaaatagctgggtgtggtggtgcacacctatagttccagctactcaggaggctgaggctggagaatcgcttgaacctgggagggacaggttgcagtaagctgagatcaagacactgcacttcagcctgggcaacaaagtaagagtccatctcaaaaaagaaaaaagggccaggcgcggtggttcacgcctgtaatcctagcactttgggaggccgaggcgggtgcattgcctgagctaaagggttcaaaaccagcctggacaacacagtgaaactccatctctactaaaaaatacaaaaaaaattagctgggcatggcagcaggtgcctgttgtcccagctactcgggaggctgaggcaggagaattgcttgaacctgggaggcagaggttgcagtgagccgagatcacgctactgcactccagcctgggtgacagagcgcgactcttgtctctaaaaaaaaaaaaaaaaaaaaaaaaaaagagtaatttgctatcgtttaagtaaagaaggaatacatttttatgttaacctttccgctagtggtagaagagttaaaatgagaaaaataacatgtatagagatatcttaatgattttcttatctttttaatgatctattccaaaactccaaaaaaaagcccacaccagataaagaaatttcggaaaaggaaaaagaaaagtatcaggaggaatttgagcactttcaacaagaattggataaaaaaaaagaggaattccagaagggccaccccgacctccaagggcagcctggtgagttgtagcaaagctgacatgggtgccgcagcagggcttgaggctgttgatcatggacgcttgagtctctgtgttgcctagctcatccctgctctctgaacaggcacattccaagtgatttctggaaacaatttaggagcaaatctttagtctttaagagtcaagagattggcatttttaccagtgagaatgtggcttagtcatgtatgaaataaagagtaccatggttatttggaggaatgggaccgctagagtgaaagctccatgaggacagggattttgttaatattcattgctgtgaccactaagcctaaaaataaatccaaaacaatgctaacctagtagttcaggttcagtaaatattttttgactgaaatcatcaaaagtgtatatttttggttttagtgacacataattaccttatagtgtggagataatccttaaaatctatcaaaactgttgtgaaagtaatgtgacatatctgcttctcctccccatactactcgatagaatcctggactgtatacttgaaaattataaaatactagtctaacccaatgttattaagaacgtgagtgtgctaatgtcaaaaataaaacattttaaggccaaattgagggaatttatattatctgctagctttttatctgaattgttcccagtcagcataagtgatcaaaggtgtacttaataaaggctgtggctagcatttgaactctatgtagtatgcagttctcttaatgatcaacagtatgagtcagacttaatgaatttaaaaatgaaacataaaggtcattcttattttgaatttgttttaaacatcatcacataaaatttgtgagtatatcctgaagctgactttagtgtttgaaaagtattgtttagtaaattttgacaaatgtgtatacccatttaaccatcaccccgatcagtacacggaacatttttatcatcccagaaagttccctcatgcctccttaaagtcaacaaccttctccacagagcccatcactattcttattgttatcactgtagattagttctgcctattcttataagtagaatcacacagtgtaatgaaagagaaatatttttccattttaattttatttaactttttatgtatttaggaagagtacaagtgcagatttcttatatgcttgtgtcatatagtggtgaagtctggggttttagtgtactctcaccctaatgaacctggtactcagtgggtaattttcaaccttcattcccctcccaccttttgtagtctccagtgtccgttattccactccatttgtccatgtgtacccattgtttagcttttacttataagtgagaatgtatggtatttgactttctaagtcatttcacttgggataatcacttccagttccatccatgttgctgcaaaagacataatttcattcttattttatggctgagtagtagtctatagtatatacatacatatatacacacacacacgccacattttctttatcaagttctctgttgatgggcatttaggttgattccatatctttgctattgtaaatagggctgcaataaacgtataagtgcaagtatctttttgatataatgatttctttccctttgggtaaacacccagtagtgggattgctggatcaaacggtaattctaattttagttctttgagaattctccatactgttttccatgaaggttgtactaatttacattcccaccaacagcatataagcattccctcttctccacatcttgacaacatctgttgtcttttgactttttaataatggccattgtgacttgtgtaagatagtatctcattgtggttttaatttggatttttttgatgattagtgatgttgagcatttcttcatttatttgttggccacttgcgtgtcttcttttgaaaaatgtctgttcatgctctttgcccagttttttaatgggctttttgtttttctcttgagttgtttgagttccttgtagattctggatattagcccttcgttggatgcatagtttgcaaatattttttcccattctgtaggttagattattgtgttgattgtttcttttgctgtgtagaagctttttagtttaagtcccatttgtctatttttgtttttcttgtgtttgcctttgaggacttggtctaagttctttacctaggccaatatgcagaagagtctttcctcagttttcttttaggatttgtatggtttcatgtgttatgtttaggtctttaatccatcttgagttaatttttgcatatggtgagaagtatgggtccacttgcattcttctatatatagctattcaattttttctgcaccgtttattgaataggatgtcctttccccagtgtttatttttgttgactttgttgaggatcagttgattgtaggtatgtgggtttatttcctggtcctctgttctgttccactgacttatgtgtctgtttttataccagtattatgctggtttggttactttagccttgtagtataatttgaagtcaggtaatgtgatgcctccagatttattccttttgcttagcattgctttggctatttgggctcccttttttttccatatgagttttaggattttttttttctaattctgtgaaaaatgacattggtaatttgattgggagtgtctagaactagtagatagttttgggcagtatggtcattttaacaatattgattcttccaattcatgagcatgggatacttttccatttgtttgtgtcatctaccatttctctcatcgttgttttgaagttctccttatggagagctttccccttcttggttaaatatatttctaggtgtttttttttttttttagctgttgtaaatggaattgccttctagatttggtctgctagatcattatcagtatatgaaaatgctaccgatttctgtacattaattttttatcttgaaacattactgaattcatttatcaaatctaagagttttttggtggagtcattaggatttttgagatataagatcatatcattagcaaacagggataatgttacttactcatttccagtttggatgccttttatttttttctcttgcctgattgctctggtgaagacttctagtattatgttattacacgtaagagtgataaaagtggcatccttgtcttgttccagttcttaaagggaatgttttcaacttttccctgttaagtgtgaggttggctgtgggtttgtcatatgtggcctaatgttgaggtgtgttcattgaggatttttatcatgaagggatgatgaattttattgaatgtcctttctgagtctgttgaaatgatcatgtgttttgttcttaattctgtttatgtggtgtatcatatatatggatttttatatgttgaaccctccttgcatccctgggataaatcccaccttgatcgtgctgtattatctttttgatgtgctgtaggattcattttgctggtattctgtagaggatttttgcatctttgttcatcagggatatgggtctgtagttttctatttttttgtgtccttgtctggttttggtatcagggtgataccgccctcataggatgagttagggggaattctctcctcagtgttttggaataatttcaggagaattggttcttcttgatatgtttgatagaattcagctataagtccatctagtcccggctgttgttaagagatttttttttttactactgattcagtcttgctactcattattgatctgttcaggagttctgtttcttcctgtttcagtctcagaaagttgtgtgtttccaggaacttatccatttcctctaggttttctagtttgtgagcatataggtgttcaaatagtttctgacgatcttttgtgtatttgtggaatctgttgtaatgtctccttcttttctgattgtgtttatttggatcgtctctcttcttttcttgcctagtctagctagtggtttatcaattttgtttatcttttcaaggaagcaactttttgttttgttgatcctttattaatttttttggtctctatttcatttagctttgctcttatgtttgttatttcttttctttgctaactttgggtttggtttgttcttgtttttctagtttgcagaggaataatgttagattgtttgcgatctttccactttctgatgtggcatttaatgctgtaaactgccctcttcacactgcttttttcagttttggtttggtgtttccattttcattcatttcaagaaatttttacatttgtgtcttaatttcttcattgacaaagtgaatgttcaggagcatgctgtttaatttccatgtgtttgtttagtttcttaagttcctcttagtattgatttctagattcattccattgtggtctaagacacttgatatgattctgattttcaaaaatttgctaagacttattttgtggcctaatatgtagtcctgtgtcggagagtcttctatgtgctggtgaaaagaatgtatattccatagttattgtagaaagttctgtaaatgtctaagtccatttggtctaaagtccaatttaagcccaatgtttctttgttatttttctgtctcgatctatctagtgttgtgtgtgtggtgttaaattctcccactattattgtattactgtttttctctttctttaggtctcgtaataattgttttctgaattttgatgctctaatgttgggtgcatataaattaggattgttatatcctcttggtgaattgatccctttatcattatataataaccttctttgtcttttcttttttaagtctgttttatctcatataagtacagctactcctctcacttttggtttccatttgcttggactattattttccacctctttactttcagtctatgtgtgtctttatgaataacctaagtttcttgtaggcagtatatagttgtgccatgtattttaatccattctgccagtctgtatcttttagtggaacatttaatccatctgcattcaaggttaatattgatatatgaggctttgttcttgtcatattgttcattattttcaagttgtcttataaattctttgttcctttcttttttccatctttgtctttgtcatttgatgaaattctgtcatgttgccatttgattcttacatcttcctcccctctgtgattgttttataagaacttttattttatatttctgtttttatcatggtgaatattgcccttttgtttccatgtttaagaccgctttgagcatttcctgtcatgctggtctggtaatgacggatttccccagcatttgcttgtctgggaaaggctttatttcttcttcatttgtgaagctgattctagcaggatataaaattcttggctgacagtttttttttttcttttattagcactttgagaatgcccattcctttctggcctgtaaagcttctgctgaaaagtctgctgttaatctgatggaatttccattataagtgactaaatacttctctcttgctaattttaaaattatttcacattgactttagacattctgaatacaatatgctgtagtgaaaccctttttgcaatatatttttctggggattgctgggcctcctgtatctggacatctaactcttttgctagacttgggaagctctcatcaattattttcttagttattctccttagccagacaacaactgcagccatatgaacttgaactcggactaaggatagggcacagcccagcatgaaactctcaaaattgtgccttgtgcctgggaccagggagagcagggcccttcctagtcaggtgtcatgagcaagaagctgtaaggagtgcagtctgctcacatctcagtttcacaagagcccattgcagggcagtgggtattgtcctagatatgcataggagagcctgtttcctgtctctccttggccaggtggtagctacagccttgtcagcccaaacatagcctgagggtggggcacaaccctccattaaactctcagtgtttcaccttgggtctgggaccagagagggtagggtcccttccaggcaagcagcatgggcaagaagctgtggggagtgctgtctactcatgtctcagtatcagcagcacccttcagcaaggcaggagggaccttcctaggggtgcatgggagtgaccagtgtccccccttctctccttggaacattgcagcgactgcagccatgtctgtagatccccagtatctaggctatcaacagtggtgcccaactggagctgttgtaggctcaaatgcctgtgggattccatgtggtttccctttatggagcaacatctctgtgcaatatttaggcagttccatatgtccagcccacagccctagtgggtcagaggtttctcctgtagccaggatcataaaagcccattttggactgcagggccctggggttttctctcttactgtttcccatcatctaggagcccttctggtgctcagtcagctcctggctgggcaagctgcctcaaactctctccttattttggtgcttcccatttcttctctgatgaatcctagcattctctcctaggcaatctatttgaaatgcaagtatctacttactactctggtttttctccgtggaggaggtacatactacttgcatctggttagccattttgatccctcctgagattatccaagaaaaattgtttttaaataaaaaaatttaaacccagtttataataagtgttcaatcacctgaaatggcagaaaacaaataatttaatcattattgaattaattatttgcatattttctgtttgggagattgtaccactgtgatggtgatgtcctaattttgctgaatgttggcactttggtcacttacgttatttcaaaaactacatatgtgtaggtgactctgatcatttttatttatttccttttcagcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcaggtgggcttgcagaatatgcagatgtgccccatttaccctttgctggaagggaagtaaagaagaagggcaactgtactatgtgctcatagaatgtggattattcagcttgctcgtcattgtttcttcctccagattactcaacaagaactggatactgttgtgaaaactcagcatgagattctgagacaagtaaatgaaatgaagtaagtatggaaaagtagcgtttgtgtgttatgtgattttttttatcctaaatttgtgacttcaggtgtgcaagcactgtattgcaagatttctgcatgagggtaagaatcccgttctagattcattttacaaataggggaccataaatacagcaacttttaatattcaaaaactgcaaacatgtctaaagtttttaattgtttagagctggaaaagaaaaaatgttttggcatcttttaaagagatttgtcagttacttgacagagccaggtgtgttcttatatttataaaatataaaaagaatatgaaataatatataacacttttatgaaaagtactagaggaataaatatgtgtagcattgtaagactataatacaagcagacctgatgcaggaaattctttttgatggaatgaaaccattttgaacgtaatatgtgtgactacctctttttcattcccatcttttactctcagagagactggacagagttggagcagagaggagataattgtgtccttagaatgttgaacaataaatttctaatgagaatgattgacttatgcagataattaatagctttcaatgcctggagcagagataacaaaccatagtgtcatgtttccataacctaacatttcagagcactgtcccaaccgatagaacccttgacaaacaagaatgtcaaggtgagttctttaggactggagaattaaacaaggttagatcaaacagaaggtgattatacctgatgtctagagattaaaggcacttaacttataactgcaaatttatatttcttcaatttttctctttgcattttaaaaaatcttcataatctgaactcatgattgaaatatttatgatgctagatgaatagtttagctcttcaaatagtttagttaaatgaatagaatccttttagaaatagactggatcatgtaacgcaacctttttaaaaatctttttatttcgatctaattttagacctcagaagctacagaaatagtatgggaagtttctatacattcttcacccatctttctctaatttatataaccatggtttaattgtcagaaccaggaaattaacattgatacaattcaatcaactaaattaatgacctattcaaaatttatcagtttctccaccaaggcctattctattccaggatcccatccacaatcgcacattacatttagttattttttctctttagccttctgcagtctgcagtagttcatcttcccttgtctttcatgaccttgacattttccaagagcattaatcagttaataccttttgatttgggtttggttggatggaagttccacattttgataagaagatattatatattataatatgttatataatataattatatatattattatataagattggtaagatattactgatgatgttggctgtgatcactcggttatggtggtttcctattgctatctctactttaaagttactgtatttccctttgtggttagtattttggagaaggtactttgagactatgtaagtatccatttcaaccttctgctcattcattttagcatccattgatgtttcttgcctgtaacaagaaagtggtttttgccaaatgctgatttttttttaatttttatttttatgtatttatttatttatttttttgagacagggtctagctctgttgcccaggctggagtgcagtagtgcaatcacagctctctgcagcctcaacctcctgggctcaaatgatcctcccatctcagcctcctgagtagctgggactacaggtacatgccaccacacccagctaatttttctattttttttggagttgggattttgccatgttgcccaggctgatctcaaactcctgggctcaagcagtcctcctgcctctgcctcccatagtgttgggattacaggcgtgagccaccacgcctggccccgatgtttatatttcgaaataattccctccatatttgttcattggaattctgctgtcaggaccaactatcttttctctcccatttatttatttagttatttatttagatcagttcagactcatggatacttattccataggttacagtccaacactctccttatttattttgctgctcaaattgtttcaggtatggtcattctgagctccttcatgttggcatctttgttctctcaacaagccctcatctttttttgagcattttaaaaatttatggtactgctctatcttctagggtcatcttgtattttctctgccctcagtgagccctggttcctttttcttgagaaaggtatttgaaaaccaacctttgggcactaggtatgctcattactaccgcggtgccgttacctctaggcctcttactggacagagctagggaatatacatatgtataccaacccatgcatgtacatgagtctgtagttccgtgtctgtcaacctactcttgtgttaaaccatgagattatgcagatattttggattctggctggactgaacactacagagttaatttttaactttcccccttgtcttatttgaaaattcttcctccaacagggaaaaacctggttcttattatctgtatctataacatatttacttattggtttcacttgagtatgcatataagtacacacaaagtggtttcaaattgttagctcgtatccctgtgagaaagacatttactgacaagtttatgtaaagttccttttatctctagctttacagtatccagcccagatactcttttccagatagtttcttagtgtagttctctttttccctactcttttcattatggctgatattactcatttaggatccagctagattctttgttaatgtttatattcctcctatatcctggttgatttaaattgtttgtattttgggtatatgaatactatggttctaaggggcagagcatgtgtatatcgcttcttcatccttgctaccactttcccatcctccccttctttccagctgtttcccacccattccctcttggtaaccaattctgttagcttccggtttgttcttcctgtatttcttctgcatatacgtattttctttttcttttctttctttttttttttttcttttgagatggagttttgctcttgttgcctaggctggagtacactggtgcaatcttggctcaccgcaacctctgcctcctgggttcatgcgattcttctgcctcagcctcccgcctagctgggattacaggcacctgacaccatgcctggctacttttgtatttttagtagagatggggtttctccatgttggccaggctggtctcgaactcctgacctcaggtgatccacgcgccttggcctcctaatgtgctgggattacaggtgttagccactgcacccagcccatattttctgaagtccctttctttcttatgtgacgggtagcatattctagatactcttttgtgctttgcatgttttacttaacagtagtactaggacatctaaagatgtaactagttgtcaggacgtcctagctgtccagttgtattatccatagaatccctttcttagaggagttaacaatccttgcaaactcccacttactgagaataaatgtcatgcatacagtaagttaatataaaaactgagctcaagtttctgaactagtgctctggaactttttctttaggatttagcttcaaaaaaaaaatgtaaagagatagaaaatatttgcctttaatggaaagggtagtttgtttctttgtggatttttatattcttaaggaatcaaagaaattttttttagcagaaagagatcttagaaagcatgtagcttttctgtagcagttgatgcctcttcccacttctccatctcaaaacttcccttttaagatttctgatacaccattcactcctggtattctttggcctctgcttccatttagttatcttcacttgctctccttccatcgtcccttaaaaggtattcttttcaagcgttctgtccagccctcttttcacttgacctgtttcctaaaccaactatgacctccttcaaccacaattctatccccataggctcctcttcattttttgacactcagctaaatgcatctttctttgtagagctctagtcgtgcttctgtcacgttgctttcctgctagacaattcatctccacagggcagatatttcattcttcttgcaaagtttatatccctaatattccctggctcacagcacttatgaaataaatgttagcagaatgaacaggcaaatgaatgaatgactgagtaggagcaaattaagtgactcaatctttggtatattaaaaagacatttatacctaagcaagttcatgcttctgggaagcagaatttcttaaatacaaatatgtgacaacgttacatactctgtgaggttttggtcttggtattattttagttatattaaaatgttatgcttaatttgagtttaagtggaaaagcttagccccacaggaattttcttgagcatatgtgccattgaaagaaattttaatcaacacgtgacattgattcaaaagcacttgagatattttgtaactacttttaagtcttcactgctcatgtaactcaaacataattttttaaatgttatacttaacattctgtctgacatatagtgttatttttaagtaatttgagtctcttttttttttttcttttggtaaagctcttactttttaaactacatttgactccagtgaaataacttatttatttattcctccaaattgaaccataactgttgaatgcactcgtaggaaatcagaattgtgacccctgtcctcagggtcacaaagccattagcctcctactatatgctgtatgagtgaaatcatctatatgtgcagctacaaagcggacaagtctgtgtgtgtgtgagtgtgcctataggaaatgattgcgtttggcactagtcctttactgtacagctgaacacctagaaagatttattataacttcattaaaaatatcatccattatattcaatatccacttatactattggttttaacacagattacctagtagtattttctacatggtatttttagatgacctttagtaaaatataaaggcataatgtcgttttataaattattttccaattttgaacacaactcgatttttaaagatactttacctgtttttttttttaaatgatgtaatatattagacttgaaaagtaaaagtattggagatctgtgactgaaaaaaaaaaactttatagtgattttattgtatcaagagactttctgtttcagaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatggtaactttgtttccttttccttttataattataatctttaggaaaggaagaactcatactctactgcaagtattttaaccctttagttaatgctaatgcttatttttaatgtttaaggtagaattgtcccatttattgcagatctccatgtgtcctggttttctagttattgaaggtggaagaacagttcccatagcagtcatggttttttaatatgtaatatttatattatcatttcgtgaaaatattttctgatttccatgttaatgtcttctctgacccatggattgcttaaagtgtatttctttggcctatttttccgtcaaggttctaatctggtaatttcttgctatcttgttagcttcatttaccttcacccaggtttcgtgtgcttggattggattagatatgtttttgactctgctggttgtcttctataagacatatttgggatatggttggcccatatttcctagtctgctttaccagaagcagaaatcccaatcccttatattttatatcgcgttttatctttttaaaagctttttaaaacgtttgatgacctttagaaaatatactaatagattaataataatgttacattaaactgactctcccaaggtcagtagctagtaagtaggaaagggagaaaacttaggtcttcagcttctaatcttgtctcctttatattttttgataactctcttaactatattcctgtatatatgccttgaatatacatttttttcaaagatggcttaatagttttcttattgatcatgacctctcatccaaagcattattatctgtccccttagttctgtttgaggttatttttctcgtacattgtctttgttgcaatgaccaaattgatactgtgtgtatcaatttactgaagaactttgtcccacaaatataactatattgggaacaactaatcttagaagccattctctctgggtacttggatgaagtctttgttcctggtatttaattgcctccttataatagaaggaatactcagggaaatagggaaagaaatatttttcagaacaccagtgaataatgttgaatgatatgagattgtagagaatgaggactgagaaaaagccagtctgtttgtcaagtagttcattggtagggtaaccatgtaatttattgtctgacctgggacacttttgagaatgaaggggtgctaataatcacaccactacagcaagcgtgaactgggagtatccagaggagttgtctgtggtgacgctagtctcagtgacctcagggacagcaacatcatcatatactgtaatgcagacaggagccaggaggcagtgagttagtgactgggtagtaaaaaggtggaggccttccagtgtcaactactccttcaaaaacagttgtcagtaaaagttaaggggatagaaggttttctgggggatgaaaaaatgaaaatacttgtttatatagcaaacagttttataaagatttcacatttatttctttttccaaactgctattttgactaactgtaatagaaagtcatttgccttacagccatcaaatgaaaagccgaaatgcccagaactaccaccatttccatcatgtttgtctacggtccacttcattatatttgttgtggtgcaaactgtattattcattggttatatcatgtataggtaagtctcttgataaaatgtgacccaatatttttctgcatctgtttaattagaaatattcaactaagttatctatgttcataatacaattttcaccacctataaaattaagtttattgtgatttctgttcatttcagttcacataaagtgcacgtgtagaatatatgtttatcttaatgcgttgtatacttcaaaaggcattgatattttaattttaaatagtcctgtttctttccaaagttaagcgtatagaacttctttaagtgtttgtttctttttttcattaggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgattt

SEQ ID NO: 36381 - DNA, 42634 bp, Homo sapiens
atgatgagaggggtcttcagggaggtgaggtatcctctcttaccctgtggcctggggctgggaaggagctgggggcaggttggcgttgagaactgggttggtgtctccctccagaggggataaggcccaaggagagaacagtgtcttcagcaggcccctctggaacccaggcccctctggaacccagactgcgggttccagaggcggccagcagagggagcccacagcccaggcctgacggacccctcagctgcttatgtaactgggaaagctgggggaggagaacaaaccccaggcacgaggcacgtcacacacacagacacatgtccccactgtaatggagcggggatcagacagaaagacggctcccagaaacacacccccacagagccatgggcaaacacacacaagctgcaaaacagcgatgcatggtgtagattggagggcactcatctcatccattaaaaacacacacctaggctggtgcccgagggtggggtgagcagagaaaggaggaaggaagcccttcagtgagtttccaggccagactgagacacgaaggaggagggagcctgggtttgcagagagacctggcaggtatgcagtagtgaccatgagggaccctgatgcccggctgggctgtgttgtcactgccatcaccagcttcccacctgccctccatgtactaccccaggcatgggcctgcatccgacacccgtcctgtttcacatgaaacaggtctcatttcacctcaagatgacatatacacaagacaccaaggtgacactgaggtgtcatgagtattgttaaagataattgagacccacgctctgcccaaaagcagtttataatccagctgagatgtgacacaccacagtcacaaccaagcagacagctctcagagaggagcacgttcaaagacaggaccattcacatatgctgacctgtgtcaggcactaaatgtgatctcatttatcctcatgtgctattattatccctgtgagaaaactgaggcatagaaaagttaagaaacttgtccaaggttaatgcattagttactgtccacacagggattcgaaatggatcgcctcactgtggagcctgtgcttctaactcctgttatgttgctgcttaaagacaaacgtcactagggacacagttaaatatgggcttagcacacatgagtatacaccaagctgtagacacagatactgccgtggggacaaagtgacaaatacatcaaatacataagcacacatgctcgtcagactgtcagacatatagaaatggcacaagcatacacataggactcagctctctctcttttaaatgtgtatcaaccgtagctttgtggggagctaaggatcacacacaagaatgtcctgtgatttgtgtgtgtttataaagcattggcccatactgccctgatgagctatattttcccaccctcccagaagggaagattctctctgctgagttgctgagaggctcaagcagagtcagagacagaagtagtgcagaaacctaccctcgccctgataacaaactcattcagagacacactgaaacagaagtgcacacacaaagataaacacagagacattatgcacacccaaacaccaaacacactcacagaaccacaaagccatctcccccccgacacacacacacacattcgctttccaccctctccctcccctcttttctccctgagccaggcatctgcaccttcatggtgaactgtgtgtgtgtgtgtgtgtgtgtgtgtgtgtgtgtgtgtgtgtgtctactctctgaaccctcctctttccctggctaggcccacactcctgcccccattcttgaaccctatgccaaggggagcagcacagctgttcaggaatagcagagccgcgatgccactggggctttggcacgacctggccctgactcctgagggggccctgccagttctgaaccaaggattcgtgccagctgccacccacgctcaaatgccacacatggattcctcagagctggaatcccctcggtctcccttctgacctcctgacaagttctttgttccccagtcccatcgggtgggtgctgggagcctgggctccgccccagatgctcacccatcccacttctccattcccagtctgctaagagggaactgacagctcagatatatgtctggagggtagcgtgggactgaagcaacccccactgtgtgatattacttcttctctaccctgagcagcctagggtggggtgggggtcagccaagggcaggagatggcagtggtttggttagacagaggtttgtgggctgagtgttgtagatgagcctcagggggcaggaggtgggtagcaccaggtgactgccagtcatttacgagtttgtctccacccagctctgagtggggtgagaagggaacaattactaatacctacagagcacctacttcatgctgggcaccgttgcacacactctgtgcacattcattcattcagctttcacaacaaccccatgaggtgaatactacgagtatctctattttacagctgggagacagaagcacagaaagctcatataatttacccgaggtcacacagctagcaaatggtagcacccagatgcaaatgcaagctacctgatgcccaaacttcagtttcccaaacattcttcttcccttcttcctcctgtttccctagcctgcccacattgattcatacatacatgtgcatatattcaggcacacacatgcatatctggtgcctatgcaaccttctgaaataactttttccactacacagctccagcttccagcacatagtgagtgttcaataaatatgtgttgaatggatgaatgcagaattgaaggcccagggaacaatgagcgttgtgtgtgtggtggtatggggaaagagggaggggaaaggagggatttcacacacacacacacacacacacacagacacacacatacacagccctctgctgtgaataatgtcaaagactcacttctaactctggggtcccagcccttcacagctacctgggtgggaaaagagcaatgtaaccaggctttacaggattctctgaagtggaagaagtctcaactctctcttccaatcagaacagaggacaggagatgcagagagagctctggaagaggactcgaggcacacagccacctgggccttccagccaggcacagctcatcctgtgttttcacctctccctgccccatgcctgccgcgctgcaggctctcccctggctccctcgggacagtccctgcttcctctgcttgtccacctggactctccaggaacccggcaccccttggttattttggctgaagagtagacaattctccttttccctgttccaactgaaacaagggtggaatttttccaaaggctctctattaggaaagtgaagggaaaacaaagccagaaataaagactctgaaaaaacaaagaaacagatggaacagtgggggtgaccgagctggccatgggagagagcgggggcccagagttttgatgctaacgcgacccacccccttgctcccactgcaccctgttctcagctccttggtagagtttcccactctgcattgtaattacagtgcttgtttatatctgcctctccatcctggctgtgagcttctcaaagccactgttaactcttttttgcctttccccaaagcctacagagtttcctggcaaggagtagaagctcaacagacatttgctgtgtgactgaggaagtgaggacatgccgagtgacaagagaaggaatctgggcccttcctctcttgtggtcatgtcacctccacagtggacactgttagttcctctggagtccatcatacactagtcacttccatctacagctgatagaaagttcctcctcttatttcagaacctgaaccttccacccctcaggaaacaaccaggctggcttcctaagcagcctaggaagggctgagttctgtcctgtagggcgggaaggacgctggagatcagatcaagctgaaaaagaaatcacagtctgaaggccaggacattggaaatcaagggcataaaataattgctaaccttcactgggcactgtaattctcaaaatgactctataagttagagctgttaaaaaaaattgaagttcagaaaagctaaaaaatttgcccaagccaggcacagtggctcacacctgtaatcccagcactttgggaggccaaggccggaggattgcttgagcctaggtgttccagaccagcctgggcaacatagcaagaccctgtcactactaaaaatttttcaaaaaaacaaacaacgagccagacatggtgggcaccaactatagtcccagctactcaagaggctgaggcaggaggtttgcttgagcctaggaaggtgaggctgcagtaagccacagttgcaccactacactccagcctggacaacacagcaagaccctgtctcaaaaaaaaatgtgtccaattagtggtagacctaggatttcttctccgggcattctgactccacagcacaagccttcagccatgttgcgggccgcatctataccatacaaattattgtcctcagaaggagctgggagacaacaaagatgtagaggtccaaccagccagcagggcagggtgacagggaatccagctggtactgaggccctgagcactggcatgaaggatcccagctcctgaactggatagccctggggaaaggggactggccagaacgaacctggaaatcaggggatgagccaggttaccaatcaggagctcaggcgtaagaaataaagcttctgtgttttcaattaagtaaaaagcttgggggctgggatttcagaagcagacagcacagacctgaatttgccagctgtgtagcctgaatcccgttactcactttctctagcctcagtgtcatcatctgtaaagtgagaattactagagtaccgatctcattattttttaaggattgttgtgaagatgaaatgaaaacatgtgtgtcatggtgccccattatgatcaaagctagggcccacaggcgcagtgggaccagtggcaaaggagaggagacttctaaatgggtctctactgttcactgcttcctccatctgctgtctcagtttacccagtcttctttccccttccatctcccacaatccccttgggagaggataacctacgccctgcctcagcttcctcaccacactcctcaacgcttcacaggtttatttccaaactcaacctgacatggaaatggttttcccaaaggacacaccagtgacctctgagttgacaaaaaaaaaagtgaccagctttcctttccccctggcatctgaaatctgaaactgttagttttttgccccttaaaacttgttcctctctcagcttcctggcccctctactcggcctaattctccatctctctggcttccctaccttgccatcttccagatcctcttcctctaccataggtgttactacccaggatcctcagacctctgtcctctagctcccctgcctgggccatctcctctgctctcctggctcagtgttcccctccatgcaggggattcccatggcccatgccctctcccaagctccagtccccatttctatcaccccccacgtgccttcatctgaagccctgcctggagcacctcaaccttcatatgcccccatgcaaacttgcggcttatttcccaatctcctttctcccctacccttattttagttaactttgcaccaacgtcctcaccacccccaccatctccaacggcttccttccttactctgatgtccaatcagctgccaaatactgaaattctacctcccaaacatctttttcatccatccctgtctcctctctgtcttgctccagaccttcaccacctatagcccccatcagtctctcccttccagcccaacatcccgtccacgtacaggcacacaccctgccatcaaatgagccttcctagaacgcaatttcaatgagattactcccctgctgaaaaactttaagtggctccatattgtttatagcgatatttctcaaacttgcttggtggtaggaatacaggttcccactctccacgcccaccctcatgaatcagaatcttgaagaaatgtacctgttcttttatagttttaacaagcacccaggtgattcttatcatcagagcctttttaggaaacactagcaattagagtggcaattactctggcattcaaggccctccatgaaatggctccaacatctatttccagtagtaccgcccatattccttccttgtgcagagtgcttctgctgtctgtgcctgtgctcacattgttccttctcctttatctctctgagtcagatcctacctatctgtccaggcccaactagaatgccacctcttccatgaagacctttttgattcttccaactgagaaccatctcccccttctctgggctcccaccaccctctaaatgctatggtgagcaaccagcagccagcaatacctggctcaacacagatgcacaagagttggcactttttcttcccctttatcttctggagcactcctcactgtcaccactgcatccagacagttctggtcatttactcctggggacaagaacccaaaggagaagcttcagtgggtccttacagcatggaagttaaatgtgcaggctctggaaacaaactaaccaggtttgaaccgcagcccccctacttgggtaagctgaggatctatgtgcctcagttttcccatctgtaaaatagagttgtgaggactaagttaagtactacatgctgtcttcattagttctggagactgggaagtccaagatccaggtgctggcagatccagtatctggtgaggggtcccttcctggtttgcagatagccaccttcttgctgtgtaccccacatgatggccagcagagagaagaagaaagctctctcatgcctcctcttaaaagagcactaatcccaccctcatgacctaattatctcccaagtgccccacctcctaataccatcacatcagaggttcaatctgtaaattctggggagacacaaacatgcaatctacaataagtgctcactaaccgttagctatgatgagctacagatcttagggacaatatagttcagtggttctcaaatctgcctgttgattcatctggggagttaaaaaaaataccgatgcggctgggcgcagtggctcacacctgtaagcccggcactttgggaggccaaagtgcgtggatcacgaggtcaggagttcgagaccagcctggccaacgtggtgaaaccccgtctttactaaaaatacaaaaattagccaggtgtggtggtgcatgcctgttatcccagctactcaggaggctgaggcaggagaatcgcctgaacctgggaggtggaagttgcagtgagccgagattgtgccattgcactgcagcctgggcgacagagtgagactcagtctcgaaaaacaaaacaaaacactgatgcctaagccccaccttagatcaattaaaaacatggtacctgaagatgaggcctgggcatgggatgttaacatgaagctaagggtgagaatccttagctagtccaaccctccacccactactttattgacgagaggtaaaggacttattcaagtgcgcacagctggttaactgtagagcaagtcccacactgaaagcctctgccctccctctagcctaatccagagtgatttccaatacgatttccaatacgccattgcgcagcctttgctcccgcgtcattgggttgggagaatcatctaggcaggaggcagagccaggcccactcaacctcactcagcaaaagtagaggtaaagaagtggggaaagtttgaggaaatggaagtggggagtccctaaggactatgagcttgggaggacaaggtcaagaatggatggggggattttgtgactaaatggcatgagattctgagagaaaagacaatgagggtggggatcttgtttgccttgattgtaactgtctttctagtaccttgcacagaatatagcataaagtacgtgctcaacaaatgtttgttgaatgtctaaatgatgcaataacatcaaaaagcacatgttctgtttattaagtcacccagagggcactcacattcctcaagggggcagtggtgagaacatccagaggggagcacaaaagtaaaagaatcttggactttcagagacactgaggcacagaggaggccaagctccctgaaattccgaggagaggctgctatgtgggagggaggcagtggccctgtgtgccagatgtttgcagggcatcctgaactctctgagcatacagaatgccacaggggacaggcagataaacagagctgtatcctgggccaagtggagggggcctggtaagggaagagggaggtgggaagaaggaggctgggggccaagccagctgcctcttgatagggggagcggggaggcggggtgctctgggccagtggttggttcagatctctggccaaagcaaacctgcctcagggggctgggggacctctccctccctgcccggatggaatcaaaggctaacaggaaccctggagggtccagctgtgacccttgctcctcacactcagcagggcccattaaccccgtcctccccatatcctcaacacacttttcccagcccaaagaatctttgcaaacagactcccctggtatttgctgatcagataccagccaagagatgtcaggttttcccagtctcaccaccagccctgccttcctcccccaaagatacccagaccctgtcccacctctcacagcggtgctctgtaagaacccagggtagcctttgctcaaaccggagcccttccttttttccatgccaagagttaaagggattcgattcatttctatgagtcataataataaacaaaataggagcacctgcctccatgctcacaaacaagacaggacaacctaccctcttggatctccttctgaacccaggtctccaactgatggttctcacacaggtacaacctgcaggtaactcctgctgtttacctgagctgagctgtgcgctgaggcagaaatagcctggaatttggggatcatcagaactggagagggacctcagagattttcttttttttttctttttttgagacagagtctcgctctgtcacccaggctggagtgcagtggcgcaacctcagctcactgcaacctgcacctcccaggatcaagccattctcctgcctcagcctcctgagtagctgggactacaggtgtctgccaccacgcccagctaattttgtgtgcatgtgtatttttagtagagatggagtttcacgcattagccaggatggtctcaatctcctgacctcgtgcctcccaaagtgctggaattactcacagattttctcatcccgttccttgtcattcagatgaagatgccaaggtcagagtagagaagcctcttgtccaacatcacacaggtggttagtggcttcagcaggactagcctcagctgacttgactttcaggcaagagtccattgcattggaccacggtggggactgtgagaggacaggagggaaagcagaggcacagaatagcccaggccttcatgctcctgggaagggttgacatgggttccctgggctacaccatgggtcctttcctttttctcccttgggacttccacgtgaagaaggcacaggcagaacacaacatggagctatctgaatccagagagaagtaagaacgaaaggaggtgggaatgcagcacaggcagaggctggggaaaatgcttctgggtgcttttacatcctattttctaaattctatacagtgtggttttaacaataaagaggataataaaaatactctggggagagattaaaatgacagaaccagctgggtgtggtggcgcatgccaatggatgcacaactctggaggctgaggcaggatgacggcttgagcccaggaggtcgaggctgcagttgatcatgccgctgtactccagcctgggtgacagagtgagaatctgtcctttttttttaagggagagagaagaagaattgtttttttttgtctgtttattgttttttgtttgttgttgttgttgttgttgttgtttttgagacagggtctcacttcgattgcccaggctggagtacagtggtgcaatcttggctcactgcagcctctcaacctccctgggctcaggtgattctcccacttcagccttatgagtagctaagactacaggtgcatgccaccacgctcagctaattttttcgtatttttattagagacaggtttcaccatgttgcccaggctggtcttgaactcatggactcaggtgatctacccacctcagcctcccaaagtgctgggaaaacaggcatgagccaccgcgcccagccagcagagatttttagaatctactttgagtagactgaaaagaaagaccatgttgaaggaatggtttaacagataaagaaaaaaaataagataaaaataaaagaaagaccaaaaagaaaacggaggagcagatgttaaaggagagatggggagaaaattcaacaccatccttgtagtccagtgaggaaactgacacagcagcaggacttggacagccactctggggctctgagcccaacctttttatttatttatttatttatttatttatttatttatttatttatttttgagacggagtctcgctctgtcgccaggctggagtgcactggcacgatctcggctcactacaacctccgactccctggttcaagcgattcttctgcctcagccccccgagtagctgggattacaggcatgtgccaccactcccagctaatttttatatttttagtagagacggggtttcaccatgttggccaggatggtctcaaactcctgacttcatgatccgcccacctcggcctcctaaagtgctgggattacaggcataagccaccccacctggctgatcccaaccttttaacaggtcactataacctgagggagtgggaggacagagggctggagaggcagggagagtgagaagtcatctttcttggacacttgtcatggccagtccaggccttcccggctcccctcatctcatcccccaaggtgggctccctttggaagcagaaaaactccacccacactcccagaagacctcagaagcctgatagcagtgacaagaccacaggccctaaagaaaaaaagaaaggagagttagagggaatggaagaaggagaagaaggagagatgcccagaggggggttggcagccgagaggaggaccagaggagcagggctggagagctgggcccaaatcaggactgggggagagaagtggggtgccggggcgggaggagggacgatgggggtgatagagcctcccagctcttccttccctcccactctccctcctcctctctctctttcatgatcttgaaacaaccttcaagtctgggctggaggccccaggaggccagtcacttaggaaacaaaactgtttcttggagaccttgaaagcccatctgcagctgagcagcgtccccaccccctccctgtgcacacacacattctcccatggactctcacgtacacccacacccggcttcacatgagctccccaatggcccacatgcacgcacacacggactccacacttgatcttagccaaaaggccgagaagcgatgcgcactcacggactcacacgcacctctgtactcatgcttgcatacagacaaccgattcatagcagattggccacacatccgaatgagtgttgtcctctcccctgaggagctcctcctttggaatgtggtttggtaccaccactccgtctcatacctcacacaggacccaacgctcaggtcctcccagtcattaactagcacacatctgtacacaggcacatgcacactcctgtctctctccaactgtcttggtctctctctctctctctctctctctctgtcacacacacacacacacacacacacacacacacacacacacacttcttaccaaccaaatatttgattcaggaccactccatccccactttgcccttggtggatccccctcctgatctgtgactttctcagcccactccccagcccaggcatcttggccttccatcctcctgctttcaagtctttctttctctctcctttgctcctcttactccaagggccttgatccaaactggtactgctgactgtgtctgaagaaacagtagcccaacccaggcactccagatcaaacgatcaggtgtctacacctgttaatatcctggaggctgaggttcatggtggacaagaaggaggtagaccactccagagcctcagctctcactgggcaaggagggtggtcagtgatgcacggtggaagtataggccctgggtgtcctgcccactctttgatttctctgagccctaaatatgtgagcagcagcgcccctcgggctgtgctctcgcccaaatgcagggcatggcagggagccccagcaggctgtaggggcagaggaagggcacatcctttccggtattgagtttggccacagggaccagagccagggcctttggaaggactgggcagtactgggaggtgccagcaggggtgaggggtgggatgaaaactgttagagtgcttgaggtttgcacaccttcagattcggggactgacgttttctctcctatctcaggttgtgttctggagagggctgggcagaagattacccaggaattccaacccaggaacctacggaacaggcgcttcctaaaccccaatttatcatgttgttcccacagcccccaggcaagcctgccccaatgttgatctccctagctgcctcggggccactctggagtgactttgctttagacagtctctcctggtgtctaaccacaggctttcccgctactcccctctcactctctccttaacacacaggggctgaactggtatctgttcccttcattgtttcctccctctgcccattctctcccaagaccaaatctgagctcggagaggggggccatgagaaggccctgttggccccatcctacccaccctttctgactgtaacccagagagggaaggagcgtggaagtgagatgtgacctaccaggtccctgtaatggaaaatctcaactgcaggcccggagggggccagttatttagggaattcagatgttagccttgtgccctgagagtggatttgctagaggagaggctgataatccctctgcagggagttccctctggggccagagatggacccagcccagccagcaggcaccttaggcctctggccaaagccccccttccctccctcccttcctctctgctttctttgcactcaggacacttagacctgccccactccgctggcttcccctcactccatctctgtgcccagagaaacaggggtactccaggggaatcctgtcctctgactgttcccagtagaaggcgggagcagaattttttcttttctctctgccccttctgggttccccttcctctctgtgcccctcatcctttggattactcatcaaatgagcagcaacaacacccctagaccagctggtcctgtcctgggtcatctcgttgtccccagtttctagctggtataaggttaaagataccctttccagccccaggcaaagccttaggcatttctgggattgctcctgactctgatgggcatcctcactcctcagacatttccaatctcccccacttcactgcagagaggcctgttctccagcctcagtcctgcatgctgcagctttgcttccccttccccactggaagaaggaaacagtcgctctcctttcccgttcacatgtctgatatttgctatgatattgaccttcacacacatcttagaggttctgtattttcctctcttttgacttctccctatcactactctactcaggcatagattcagtctagagctcttcaacagcaatgaaacggtaaacgaggggtaaacaaaacccagagatgtcatcaggtgcctgctaggagtcccacccgttcccctctagccctggcctgcccctccctaccagagtcttgattctccttcaaaactttggagaggttacatctggcagggtttggggacaccctcttgcctccatctccaaacttcccgctgcctcccgagccacctttgactcctcctgggccccccttccaggtgcctcaagtgcagaggtcagccttcggttcaaattctatttctgggcttcagtgtccctgcaacctctataatagaaggaacagagtggtctatgtttctttctttctctgggagattggatgtagactcgggagacctgagttctggctctgtcttatcaattcaaattgtttaatctctctgagcctcagtttacccacttggaaaagaagagttaggccacatggtctctgtcatcctgggattctgagtcaactgctccccttcagccagatccaagggggcatatccccccaacctgggacccaggcccccttcccttgcagcctctctcagttgtgagtgccacaggccagagggggttgagaggagccaagggggggcatgccgtgggacaaacgggctgtctagggccagtggctaaaggggcgggaggggaggagtcctcagggatcctgtttcaacaaacgtttctttcggaggaggggaaggcgggggagagggggagaaggacctatttaaagctaccctgttgctttggctttctctgtctgccagggtctccgactgtcccagacgggctggtgtgggcttgggatcctcctggtgacctctcccgctaaggtccctcagccactctgccccaagatgggccgtggggtgagtatccctaaagagcaggggtcgcagtctagagggtgagggaggctgctgaggaaggatgaagtgggaatgggatgtggaaggagcgggagagaggagctgagtgggatacttggaacttgaaactaacagtctccaaactaccaatgtgtgtacagatcccacggcggtcacataccctagtgctctcctctcctctgcacgccccagccccctgcccacagttagacccacagcccaccacacatgccccctccatctctccctccaccccactcccacatctctagtccttccctgcagcagtccctcctctcactgcatctcccggcctcccagctgaaaggatgtttggcactgtgagtcctcctgtctttgccacctcctgaaaatatccattcctctgggagtcctagcctgagaggctgggggtccattttgaggttagagaggggcagtagagcatccggctcccagagtcaccaagtagttccggacaccagctccaggggccctgagtgccaaggacagctgggcggggtgtggggaggaagaatgatgacccagcccccaccccagcacccctccggatgtcccgagcagcattgtccgtgggttccaagccatgggctttgaggactttcccagaggctggtgacaggtgaccccccccccagtccacccgtccatggcattctgcagcaatggctacaccaagaggaagattaacaacaatggggcgggcagggagagggctttgaattcttggaaatgaaattcccatatggagaagagtggcccaatccttttacatgctgtgcctggctgctttccttttgtggaatactggcaaaagaggacacagagggaaagggcatgctgcggaacaggagggtatgaggaagactgtgcctagggggagccgtgggtgtttctgggcccaggaggagtcaggcaaggacatgttattgcacctagttgagcagctgggaaatcctgagcctggacaccagggttcctgagctagggttggagccataaatagaattggagtgcatgcatgtatctgtgtgtctgtgtctgtgtgtgtgtgagtgtgtgtccttgaccacgtgttctccataggcggggagtcctgcagttactcatggatgagtacctgtgtttgtgtctcagcaggcaaatttgtaaatgtacaagccttcaagcctgcacaagcataaatgtcactgtgtgggggtgcttgagagtctgtgagcctgcccttaggagctgtgaggtatgggcttcacggaggaagaggtcatagctgcaggaagatatactgtcttgggaccttcagctgcatcttgacatctctggctccccatggaaagggcatccctagctgagatgcaggacctctgagaagaggcaggggttaaaggatcagataagccctccatttcccccatccaagtgaagagagaaggaggggaggtagccccctaccctgctccatcttagagcaaggtagacccagctcaggaggtcttgcttgggaagtgatgagaccttgacttttccagtctgtctttttcccctagcacccccaaactccccttaatcaccatcctaagttgctgtgggtgatgcaatagcaagatgaggagcagatctgggctgtttaaactaagaggctgggtgaggtgggggtatttagggcctggagcttagagttcaacctaccaacgacccctgaagagggaaggcatctgacacccacaacctgttctagggatgatttttcctccaatcccttctcccctgcatctccactgcagaggcaggcttcactgtccccccattacccagtggctgtgaagggcagcgtgggagttgggggaagggacgacactggtgggagggagcccagcctgctccagctaccacggagaggctgagatggggggagcgttggcggattcccagctgcccccactctgtcccagcctctggctttctcaaaaaggactctctgttctccttcagcattcaagacccagagagggggacttgtggttgggggagggaggagtggagggaggttgggggggtccttgcttcctctctttctttcttgcctgggcagccgctggccccaaatctctgcaggctcctggctgcagagcctgagatctttgccaggacaggaggagggggaaggggcagtgtgtctcaagctctaagcctgctggagagcagggcgggagcttgggaaaaggaggcactgcgtggagctgcttagctcagccacaatccagcatgccaaagtgcatggaccagcaagtttttaaaaagcatgcattttattccaatttttatgaaatttatttcacatctgaatatacagaaattcctctgcaccctgctcttctgcccacagacccagccctgctcctctgtgtatgcctgggcccccttctgtccctgaagttcctgagggtcacactgaagctcagccagcctgatctcttgcctctgttcccttgattgcatttcttccttttctcagctctgtcccaccacagacagttagtgaatgtaaagcatttcaatccactcaattaaatgaatcctcttaggtcacctgagaaaggcagaggcagaaccactcacaagcctttccccaccccttccattgggctgctcggtctccccaagaagatctgcctttaggaggccaaaattataccagattcatagatgcttcaggtggagacaaacccacgattttactggtcaccttttctgagaagagcacttctgagcaacacagcctccaaaagctcatatctttttaaatcattggtatcttgggaacaacagtgttgacttctccttgcatcccccacccctacccttgcttctgattgtactggtcagacttctacctctcaagatgctgaattggcgacctcttatgaacaaggcagctgccatacttctgggattgctcctgactctgataagtaaaaaaggcattaccctggagcacaaaagtcttagggcagtgaagctattccatatgataccacaatggcggatacacgtcagtatacatttgcccaaacccatagaatgtacaccaagagtgaactcaaacttaaactatgggctttggacgataaagatgtatcaatgcaggttcatgattgcagcaaatgtaacactctgatgcagggtgttgatagtgggtgaggctgtgcatgtgtgggggcaggagatatatgagaactttctctacttcccactcaattttgctgtgaaccagaaaattgctccaaaaaaagtatattttttaaaatgcaaacaaaacccccaaaactgcattatcctgcaaaaaaaaaaaaaaaaaaaaaaaaaaagcaaacaccttggctgtggaccctacccaggtatccactctttatgggaaacaaaagttaacatcatagtgtgggaaaactaattcctgaaagcctagtgcagactttgcagaatccagtggagaaataggcaccaggtggaaactgagcagcccctctatgacaaggactctatttcctgagggaagtgggaggagagaagactggggcagaagaggaagtaagaaggtacctttttgggaacttttcatggctacccaggccttcctcagcctctatcctattctatcaccccaagagggcctcctcttagaaggaaagatttcccaccctgtccccaagaagttccctgtgagaccctggaaggctggtagtggtgagcccacaggccctggagtggaagggaaatcaggagcctcataagactacaattaaaatgtccatctgctcaggcgcagtggctcacacctataatcccagcattctgggaggccaaggtgggaggatcacttgagcccaggcaatatagtgagaccttatatctaaaaaaaaaaaaaaaaaagaaagaaagaaagaaaattgttttaaattagctgagcgtggtggtgcatgcttgtggccccagctacttgagaggctgaggtgggagtattgcttgagccctagaagcggagggtgcagtgagctgaaattgcacactgcattccatcctgggtgacagagtgagaccctgtctcaagaaaaaaaaaaaggccatctgattcaccagatgacccaggaatgtctagacttaaaaactatataaaatgtagttttagatttactctcagatacaatttcttatgttttgggacaaatggggctcagttcccatgttacccaattgtgctttgggggtccagtcctgtgagttgcctcccgtctagtaacgggcaggcctgcccagcaggatggagagggctcccagcacaccccatgtctccacttcctggacatgccctgactctccagctactgcctcctctcagtccatcaggcctgctctttccatccctaccattccaccaccagacctggctctcctctggacacgttcctgcctaatcccctggctccccaaagactcttgctcccccaagttcctgagtatttctacccctctctaagtaaaattgccatggtgttgggctaagacattcctacagagtgattctactccctcaacaaccccccacaaaaccctgtccactcccttccagaattttcccaaatagtgtaggatacaggttttcaaaatttttgttttgttttgtatttagcagcagggtcctttcaacaaacaaaatcttagcagaagcccaagcattaaaccactcaagtggtgcttttcagtcctgagcccctcacccttctctgaaactcacatgggagcccctggttctgccaatagtctacaaactgagggcctagggtccctcaccctccatcccccctatctcccccaaggcagccgctgcttttgaacacacacccccactgcctgggctccctggctgagtggtgggaatggaggccccagcccctctcttccctgactctctggctctcccttcctccctcaggctggccgtgagtactcacctgccgccaccacggcagagaatgggggcggcaagaagaaacagaaggagaaggaactggatgagctgaagaaggaggtggcaatggtgagggaactgctgggccatggaggaggggccccatgctgggagagctgtccctgcagcccattgcactcagagaaactccgtgtcccccatgctgctcaactcacccctgtgccctgcagtaccctcatatgcatcttagatacctcctccccaaagtaactcaccctcccttccccaggatgaccacaagctgtccttggatgagctgggccgcaaataccaagtggacctgtccaaggtgagtggaggggcttctagggaaggaacaaaagaggcaagaaaaccatgcagcatcaaggtggcaggagccttaaaactgtaatccagccttctttacagatgaggaaactgaggcccagaaacaaggactggcccaaggacatgcagctagttggtggcacagccagaactagaatttggatcccctgcatcctagcccaaagctctctccctgtataccctagaagccaggactccctatgacccaggccccagagggcctccaggcagggcccttccctataccccaagcaacttcagttgcacacagccttccacagagctgacagctgatgcacatgggctgacagcccattcctgtggttacagtgatttgctgggcccctgctacatatgtgacattgtgatagatgcgttacatacatttctctaatctttacaacaaccctttgagataggtattgcagacctgtttattaaacaaaggagactcagagagggagagtaacttcccaaggtcacatgaacagtaactggtacagtcaattgctaagcccttcaattaaaaatttgtttaaaaatcattaatcaaaaaatgctgggtgtggtggctcatgcctataattttaccactttgggaggccaaggcaggcagatcacttaaggtcagcggtttgagagcagcctgggcaacatggcaaaaccccatctccactaaaaatacaaaaattagcttggcacagtgatgggcacctgtaatcccacctactcgagaggctgaagcaggagaatggcttgaacccaggaggcggaggtttcagtgagccgagatcataccactgtactccagactgggcgatagagtgagactccatcttgaaacaagcaaacaaacagacaaatatttagtgggtgtatatctcctttatgggccttccctgactgctctttctaaaattctatgcccctattcctttaccttactttattttccttagtaacacttttctatctggcactaatatgtatttgtttattgtgtgtcacctctccagatcataagctcctcaagggcagggactttgttggtcttgtccatctctgcatccgcagagtgacaattgtgcctggcactggatatacatttattaaatgaatgaatgaatgaaaaaaaaaaaaaaagaaacggtccctgctttaaaggagctcaaagtctagtagcagaaaaaatgcaatcctaggattccaatgcaatatggtgagtgcagctctagaatcaagtatagaacaccatggggaaccagaaagaagcatctgaaccagcctggggctgagggaatagggccaggcaaggctttctgtggaaagtgacaggtgattgccaaagttgtgtgacactgacggtcaataatgtaggacttgagcagggtgtggaggtgcccacctgtagtctcagctacttgggaggctgaggtggaaggattgctttagcccagggttcaaggatgcagtgagctataattgcaccactgcgctccagcctgggcaacatagcaagaatccatctcttaaaaaaaaatctaggactctcctagaatccttgataaaataatctgaaggaagagagatggggaaaaaacagttgaggtgtctttccagggagcttatccagactgcctccaggggagatgttatggccctaaccataggtgttgtctcaatccaatataattaggggtcaagcccagtcaaacccttctcagccctcaagccctccaagttgcatcacaaatgccacctcctccatgtggtctctcctgatggtcccccaccccttccaaccaggtgggactttccttctgggcattcttcccatgcccgggagctgaagggatgggcatggtgactggctgggttggctccggatgcgtgcccctacgcctctccttgctccctcagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatgtgagcccacacgcccgacccgggaacagcccgtgactgtcctccaaccctgaacccccaacacagtggggggtgggcagggaacaaggccctcacataacagtcctacagatgcccctgcatcttaggctggaaaggggagaggcttctatatatatctgtaaagtactcctccgccaacagtgcatacacattcacatactcattaattaatgaaacaatctctccctgttcctccccgcttaagtgagcctgtctgtgtgcctgggtcttcatcccctagcaaagtcctaaccctgggaacttcctaagactttccctcccatttctagtcttaacaggcttgaggttggcagatcaagggggaggttagtgagaagggctttcccctaccatcatcactctcagtcacagacaaaggtctgggctgtcatcttggatggcactgcctgctcatcccaagtggcagctgcccctttagggttggggggaaggtcaggtccctgaaactctttctccttaccagctatatctgggtgtggtgctggcagctgtggtcattgtcactggctgcttctcctactaccaggaggccaagagctccaagatcatggattccttcaagaacatggtacctcaggtaagatggcagggctgggctctgggctaggctgtaaggttttggcaagagtccagctcatcttttgtcagctcccaggctctaagatagagatggacagaaaagatcctccagctttccatgccagcacctaattgtttatggggcttctccttctgcttgacggtgtgggagaccagcaggagaagaaggcaggggcagagacaagcatttcatgagctgcctgtggctccccacagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtgaggaggtcataccagagcaagcagttgagtctaaggagaaggctgtgtgcagagctgagaggggcccagtgaggtttaaaggtggagagacccaggtccaaatgtcaacaccatgcctatgcccctgctaaaccttctctcagtgtggggtgcttgtgcagtgcctccttgcatctgtgtgttatgaatgctctatgccccaggtatttctttgttgtccactttttagcaatcatgtattgaataccaattatgtgtcagctgctttatatatgttcgatgtgctatctgatgtaattctgaaagagtggtgtaatcatgcagggctgctgaatgtggccacacacgttgcatcctgaatgaccccaggaggtgcattttcataactacagtgttagtgtctccccctgtggttgtgcaaggcagagattctgtttacattcaccattttacagttgagtacatggaggctctcttggttaagcaagtaacccgaggtcacataagaagtcaggaggagtcagaattccaaaccagggcaggggcaatagatgagtaatgccataaatatgtgatgagggcaagtgtgactttgttcctcgtgtcatgaagattgagtgtggttggaggtggttcaggagacagctgtgtgcatacaagtggctctgccagtctgatgactatgcactccttcctcctcaggtggataactcatccttaacaggagagtcggagccccagacccgctcccccgagttcacccatgagaaccccctggagacccgcaatatctgtttcttctccaccaactgtgttgaaggtgagaagccaggctgccccctgtaggaaagagtctgaatcctgaatccatagtcaggatgaagggctctggtagtacttacctggcaaaagctctgccattggtggggcaattgaggggtcagggggccctgaatattatggaaacaccctccacagagcagggtattgactgagggcagcctgactccatgggaaatgtatctcccttccccagggagatctctgttctgtccaccccaagactgagtggatttcaaagctttcaggtattgggttaagaaccccttacgcatgcgcacacacagatgcacatacgctcagaaccaacctggattcttaggagtctttggatttgattgatgcttctattccttgtggttctgggcctcgctgcccccttcgataacctttgctttggccagggccccagggtctgggagggccaagaaggcattctggccaggtgaacacttggggcctacttcaggctgcttctaacctttgttacatcaaaagacatgtttcaccatgcacagactacccagtttgccccatccctgttctgggttctagagataaacaaaggtcaataagaactcccagagctgccatcacttaatggcaggggtccaagcacaactgaaacctgtgccctctgtggtaaagccagtgagcagagtcagggctgcatcagagaaggagtaggagggaagagacagaaagaggcctcactagaccagtggcctctgaaaatagggcaaaggaggcctcatatcccaatccacacttcccctgtccattactcatttctcctcagtgtattatgtttctctgtggtttttttcccttcttcgacaagttggaattccactgcttggaatccatgagggattggttccaggacccccttcgttaccaaaatctaaggatcctcaaaggccctgatatgaaatcgcataatatttgcatataatctgcgcacatcctcccatatactttgaatcaactctagattacttataataccgagtgcaatgtaatttttatactgttttgtttttaaatttgtattatttttattgttgtattgttatttttatttagctccaaatattttcgatctgaggttggttgaatctatggacatggaatctgtgaatatggagggccaactgtacaaataaaaatcaccacacattacatttcctaagtttgttttttgttttgcttttgagacaagatcttgctttgtcacccagactggagtgcagtggtgcaatcacagctcactgcagccttgacctcccaggctcaagcgatctcccacctcagcctccagagtatttgggactacaggcgcgtgataccacacccagctaatatatatatatgtatattagagatggggtctcactatgttacccaggctggcctcaaactcctgggctcaagtgatcctcctgcctcagcctcccaaagtgctgggattacaggcatgagccaccgagcctggccaaatttcctaaatttttaatgtactgagattttgaaatttacatttcccacaattgatttattcagaaatgcctagtaatacattcctattgcttactctgcaattggctttgaaaagaggaaaggaaataaatgagatatttgttgagcacccgctatgttccaggcactggcctaagtatattaaagcacaatctcatctaaatattaaaacagcaccgagataggaattcaaataaggattcaaacccaaatttggctggctccaatgtgcatgcttttttcaatacaccacccttccttcccagaagacccctgtaatgtcacacaagggttagcaattgcctggcttcctctatagagattcatgcctaatgttgagaaagaaaatcttaagactggatggaaaatccataatgagtgctttactttgtgttcataatatacttttggatggtatcaagtatgggaatgattttaccaaaatgccacaggcaatttttatttattgaatcttgtctatttgaactttgagattatttgcaagcttctccccaggctcgagtacaagagaaaataatttgctgttgtattgattcaaggattggcgatctatccagggaaaggaaggccaagtggggacaacctactgaatgtggcctccagatctgcggctttggctcacctatcctgtgatgattttccttgctcaggaaataggatgggactgcagtccctgggagccacaaggcacccaacctgatgccccaccatgttgcaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgagtgggtcaggctgaggtgccaccaggggagggtctcactactctttcctcagagtgatagaggcacagttgcttgtagcttctcactactttttccccctagagtcacttattggatgcgatactcagagatcacttaatacatggcttagggtatgagttgagaaatctcaggtggggctattcttaggcactcagtttctcttttggagcttgtcacggctgccttttctcacgatctgccagcagtctgggtctcattccgtccaagtctcctgtagaggctgtctcaaaggtcaccagtcactaactagcaaatccagggaccttttctcagctctcctccctaactctgctgctgaaacagatactgctgtccaccctcctaccattctctcttttgtcgattgctgtgatgtgtcactatcctggttcgcctctcctctgtcccttcctgctccccctacactgattctcaggcctcagctgtctgttcttcctacaccctgagcaagagccaatctcctcccagtttgcagtgtcccttctgtgttgatgactcagacatccctatgctcagctctgctctggccctctctggagctctagtcaaacgtcttaaaccccctaatgggcatttcatcttaacagatactcatgatctcaacacatctaaaattgaacattcattatttacagctaagtcccacccattcaagttagtggagtagaatcaggggaggaggaatggagccacggtctagggtaaggttatggccatctccggcttcagccttaaccttttttattctcctctttctctaccaggtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggtgattgggtgctccagagggggtggataggattagaggaggctgagggcagtggcgtggtggggtgagtggttgagataaaggctctaaagggagccacgctcctggttccccctcatttcctcccaggggccacttttgacaaacgatcccctacgtggacggccctgtctcgaattgctggtctctgcaaccgcgccgtcttcaaggcaggacaggagaacatctccgtgtctaaggtagggggtcaggacacacaccaggtatgttttgggggtgtctccaaagcctcttgctggccccagctttccttctcacatgatgtggctgccttgggggtttcagtgccgccttcacctgatcctccactcccttccctcccatgctgacactgaattcttgtctcttctggcagcgggacacagctggtgatgcctctgagtcagctctgctcaagtgcattgagctctcctgtggctcagtgaggaaaatgagagacagaaaccccaaggtggcagagattcctttcaactctaccaacaagtaccaggtctgcttgggttgccaggacagaggaagagagagggatataaatgggtgagggtggacaaagccaaggggaatcatcactagcaggagtgggggtgtctgagggtcatgttccctccccctgctaagtcccccaggacagctcatatgactgcatgtctgattgcaactagccccagctcccaaaccttactccatcccttactacaatctgtcactctctcaactcttcttcccatagctccgcatcctctggcctagccttccaactcttctaccccagtcagtgaaaccataattctgtaattcctttatggtgccccttagcctttaggcacctgttaaatgccaagaatgcaatctcagcattccttattatccatagaggtaaagccccctgaggccaggtggtggtggggatgctgaggagggagccgttcagcccctagcacagtgcctgtcttaacctgacctcaataaatatttgttgaatgaaagactgtcctacggaggtggctctcaggttacaagtgttggaactgtgaggtctaaacacccccctgcacaaggagattctctttgttgacaatctttgatgggttggggctacttttctaaggtggtttccttaccagctgctgctctatgccgcgctaccaagacaagtatggccctctctgtaactacctgttgtctctccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggtgagaggccagaaacaggaggctcagaaggggattcccaagcctctgcggcatccctggggtgggggactgtgggggcgtccaggaagccactctgcggatctcactgatcccttctgcccccctttaggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtactggcctcccatcctcccctccattctagcctcccccatgccagagttcaaggagctgcagtggctgctgccctggaaaggcccaggccacggtggcctccttcccactgactcagagaagaagctgtccatctgcaaggaaaggcccacccctgccttggggcactcacccttatcccttttgctcagagaggccagtgtcccatgcccctcctctccctccctggcacagctctttgtcccatctgcatgtgtacccttccattctgatttgaagcataatctggcactcctatcttgaagacctagttgtcctacccttcccaactactgcccaccctctctgtcaacttaggatgggattagcaggctcttgtatgctcccagtggctcagcccataaccccacagaatgcctcccactcaaggttctcttgttcaactacaattgcttctcactgaccactccctcctctgtgctatgtttgttcttcattcaacaaatatttactgtttactatgtttcagacactgtgcaaggtgcaaactctagcaccttgcacagtgcctgatacatagtaaacaatttgtgtcacatgacacatctagatgggacaatgagctgtgccagggaggacacatataaatcaggcactattctaagcactaaacctctatgatttcatttaatctacgcaacaaccctgtgaataagcaccagtatttttccttttttacaaagagggaaactgaggcacaaagtaacatgccaaggccacacagctagtgtaagtcatagagcaggtacttgaaccaaggcagtctgctatttcttaactatcataccaggagacttgtttctgtgggtgtatgtggtttctgaaccccataaccactctgtctccgaggcaggcatcattatccctgttaaaagtaaaacaaggctgggcacagtggctcatgcctgtaatcccagcactttgggggggtccaaggctggtggatcacctgagataaggagtccaagaccagcctggccaacatggtgaaaccccgtctctactgaaaaaaaaatacaaaaattagccacgtgtagtggcaggtgcctgtaatcccagctccttgggaggctgaggcaggagaatcacttgaacccgggaggcagaggttgcagtgagccgagattaggccactgcactccagcctaggcgacaagagcaagactccatctcaaaaaaaaaaaaaaagtaaaacaaatggaaactgcaagtgggtaagtcttttccccaaaataaaaccaccagtaagtgatggactgggactatgaagcatgatctgcttgaccggaaagcctgagctcctgctgcttggccaggtgcctctctctgtgatcagaaccatcacggaggcctgggcagaggacctctatgggaagtcagctcagggaagcattaattctgcctcagagaactggacgatgtttgacaaaaggaatgatatttgagctgggctttggaggtcaaagagtattctgcaaagcagtgagggagaggaaggcatgtcaagatcagggaacagtgtgtaccctggcgtggctagactgtacggagcgtgtgtaggggttggcaggggagaggtggcaaggagtactgggggttgagactggaacactgggtcagagccagttggaaggacttggcttaaatgccagacttgggctttatcctgcaggccacagagagccatcagtgtcacgggggaggttgagcttttaggagactacctggtttgaggagggactggatttggggaagaactggagtcagggagagacaggttaagaggccattgccatagttcaggcaaagaatgatgacctgaactagggcagaaacaaagggaatggagaggaatagccatgtctgagaaatgttttgagaacttggtgaccaaactggatatggaaggtgaggaagatacaggagagaaggggacaggatgaatagagaggacaacatctaaggtagggagcagtagcaggcttggtggggtggcaggagtagagaaaaggagttcaatgttgaccttaagcttaaagagtctataagataccccaggaaagacagatgttccagtgaacattggagtatggtttagagctcatgaaagatggtcaggactggagatttgaatctcattagcacaagggtgcaaactaaaggcttatagtatgttgtattatattgcccagaaagagcagacaggtcaagtgaagggaggagaatgaaatcctgtgccaaaccaacatttaggcacaagaggaaccagtgaggaggggagagggtggtaggaaccaatgccatttaatcttcatgaccacctagaaaggcaggaatcatctctgcattgtgctgagacctcagtgcttcacttgcctaaggtgctgtagctggagaaggtcggtgtttaaacttgagcccctcattcaactccaaagccactgcttcttccatcctactaggctgccaccctgagaggctgggaaagagcatgcagaggagtggagggaaaacaggaatggaggagtatgtggaagccaggggagggcagggtttcaaggagaagaggtcaacggtgccaaatgcctcagaggggtcaagtaggatgaggacggcaaagacacttttcatttttcaattgagaggcccctgtggcctttgggtggcagtttcagtgaagtggtgggagtggaagataaggcagtggggaccatggaggcttccttttcagtatccataggacttgccctgcaagcccacacatgcaaatgctatcctaacccaactctgctcacctcatagcctcttagcccatcagatgccagccaccctccccatcccaactccattcactctgcaacaatagcaatgaacattatggtgaaggtagggaccaccgtgctcaccagggaggatgtcagaggcagatgctcaaggtggtggaggcaggggtgttgtctccatcttattcctgttctgtccattacattgctgcagtgatcaatatttgacactaagaacctcatgtcctatatccaggtccctgtgcatttgagcaaattgtagcccctctctaagccttggtttcctcatgtgtaaaataaaggagttgttaaagggtccttccagctctgactgccttgaatcccatgaaatccaaaatcctaaaatatctcctaaataatcctaaagatttgaggcttctcttccaggggatcctcatgaacttgttactctgttatggatactttcctgcacttaagcaaactatctctctctaaccctctgaacataactcaacttgccattatctttcctcctcacccacccactcaaattcacacagacacacacaaatccccacctcacatacacacacatcccacacacacacatagacacacacaatccccaccccccacacacacatctcacacacacgcacacatacacaaatccccaccccacatacacacacacacacataccccacacacacacacacatcccacacacacacattccctctcacacacacacacaatccccaccccctcacacacacacaatccccacccacacacacacacacacatcctacacacacatacacacaccccacacacacacacatacacacacacacatacaccccaccccagccactcccctgcccacagacgcacacacacatgcccttatttcggttgggatctgccatccccagacatctcgctatctagctttctcttactttgggagaggaacaggagggggataaacccttaatactactttcctgttgtctcctctccttcccactaggtgatcatggtaaccggggatcaccctatcacagccaaggccattgccaaaggcgtgggcatcatatcagagggtaacgagactgtggaggacattgcagcccggctcaacattcccatgagtcaagtcaaccccaggtgaggcctctgcaggaagcccctgtgccctaatcaacacgtcctcttgcacagaaggcttgggtgtcccctgggagtatttggatagcatttctgggacctttataggccttacctctgacactattgtgactggttcctcagccctgagcttgtatccaggctgtgccactgaatacccatgtaaccttggagatgtcacattcccttcctgagcctccattttctcaccacaaaattaggatgccatctccactgctgtaggagtgggatgtgagtaaagaaactagcccagggcctagcaaactgcacttacaactgcgatgatcccatggtgaggatttagactcacattctcaaagagaaatgggggaagtgagtactgaggagaggagaactgaagcaacaggggaagcaggctcagcagggagcctgcaggctgcggtggtgaagagaggcagggggcaggaggggctggtacaggtgccaggggtcagctgtctctgtccccacccaccctccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcaggtgagcacagccacgggaggcagatgacaggcagggaccggggaggcagggacagggccaagacaagcatggagtgagaggcgaggagccaggcttgggaaggggtttcgtcctcaagtgtggccgtcttccctccagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggtgaggaggctgcatgggttgggatggtttgcaggatactgaagccggcacctctgttccctgtccctttaccccagttgaagaatcattccacaactctaggcagcccagcccactttagcttcccttgaacacaaaatcttcctctcttgggaagacaggcagccatgcttcaggggctgggggtggggaagagtccctctgacctccctgatgccctcagaatctccccacaggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtgagcgcaggaggtggaggaggggacaggcaaggcaatcgtgatggcacagtggcagggaggagaggtgcactggggcagtggccccagctgtgggggttacaggagacaggcacaggcctggaagacaatggggtctgaatacacgcttttttaactgtgtcaacgatcgtcactgtcgaagatcaattgcttctgtcatctcctacgtcccttcaaatgccctccctgccccatttcctaccccacacaggtccctgccatctccttggcctatgaggcagctgagagtgatatcatgaagcggcagccacgaaactcccagacggacaagctggtgaatgagaggctcatcagcatggcctacggacagatcggtgcgccaagccccgggcctcgggagggaaccccaacagggttcttttcccagctttcagaggaatgagccccaagcaaaattccaggacagaggccagctacccaagggtcagggacctccatctctggccctgaggggctgtgccccttctgcttcctgctctgaccctgcccctgcctttggccctctacccacagggatgatccaggcactgggtggcttcttcacctactttgtgatcctggcagagaacggtttcctgccatcacggctactgggaatccgcctcgactgggatgaccggaccatgaatgatctggaggacagctatggacaggagtgggtgagtggtgctgtgtaaacacagcgcacatgtgtgaaggtacgggaagctgaatgcctggcaggagtggccagtggtggccaactgggactggggctaggggtggatcaggagaaaccatgctaccttctggtcctaccctttcctccgacactctcatctgtctctgcccaccctccctccagacctatgagcagcggaaggtggtggagttcacgtgccacacggcattctttgccagcatcgtggtggtgcagtgggctgacctcatcatctgcaagacccgccgcaactcagtcttccagcagggcatgaagtgagtgcccacccccatggcacctacccacccaggctctgggcacactcaccaacccacacaggccaagcttccaactcagccctggaccagagctgtaaggagggcatcagattttaatcttccatctgtatatccatagataggtttcatatagaagagagaagccatgcttcaggctcctaattttgcattttgttattgtctctctccacctttcttctctccttctctccctcccttctttcccccatctcctacttgagtgccacctgctcctatcctttgcccagccctaaatccagtgtcttctgtgcccacccctcccctggccttccgcaggcagtctagtttatagcacttgcactgtggttctggaggccacgtgctgccgagggtcgggttcagcgcttcttgcagtgtgagttccagcgtgccaggcactgtgctaagtgcctaacacattgtttagccccacgatagctctatgaggtgggtattactgtttacatttcatggataagaggccccaaacaggttaaatgatgtgcccaaggtcaccaagatggtaagggttcaccagatctgtctctaaaacccagccctggctactacccaacatttctgtgctcacaccatctggcactgtttggaactcagtaatgactgtgattctattatgggtggtggttgagcgctgaaggtttcatgctggttccttttattttctcctaccataaacaatggccacaattcctcacatgaggttgttacagtttcttagtttggggctggggagggtggggagaagatgccaaagtgaagttaataacacttaagatccaagggagaataaagtgaaaagcctgttagataaataaaggtaacatgaaggaaggagattccagtaagctaaaaatactaatggaaaaaaaatgcaatttgaagagaacaaggagcagagagtctaagaaattgggtataattctggggcctgggacttgctatgcactgcagggatgacacacgaaggtgggaacatggccatagtggctgcatccagcccatcttagaggcaaatgggaaaaatggcaaatgaaaatcaggctgggtacagaggaagagtactaataccaccacaggcctcaccttaggtccctgggccactggggatcctcagagatgctatttgccttattttgaaaagctttatgaaaataaagcactcacctatgcgaaggcaaccaggcttactaatgtgtcattcttaggcaaaagccaagagcgcatatcatgacgtggtgatcggatgctgattcacagttctgtctggaagccatggatagttctaattaattttaaatggggaaatgtattcaatacttattcacaaatgtagcttgagagacaaacaattaaatgtggcctttacagaagaaaataaggaggtccttagtgagtgaaaatttggaaatcactggcttgaaccaaaaagaggtaccttgtgtaagaatacaaaagatggagtagccggggacagtggttcacacctgtaatcccagcactttgggaggctgagacaggagaatcaattgagcccaagagtttggtactagcctgggcacatggtgaaactctatctctacaaaaaatataaaaattagcagggcgtggtggcacacacctgtaattccagctactggagaggctgaggcaagagggtcacttgagcccaagaggtggaggttacagtgagctgtgatcgtccagcctgggcaacagagtgagactctgtctcagaaaaaaaaagtggagtaataatgtgactgaacattttccaggtctgtcactgaacatttcagtgacagaacattgcagagcttttcacgtgttatctcccttaattttcccagcaaccctatgataaaaaggtaaaatctccatttgatagagaaggaacgtgaggctcagagaaattcaacattgcctgcaacccaaagctagtcaatggcagaactgggaatagacaccacctgtctgactgcagaaactgccctgagaacctccttattctatcctgcttttcaattctgataaagtgaacatatattaaccacttattatgcagtgatcccctttacattctctgaattaaatatctataatgaaaccaccaccaggaactgtgggagatgctgagacggtagaagacatacatgggccctgcactgaaggagctttcaagcatcttgctggggagacacactttcatgggccctgtgcctggagcaataacaagatcatgagacaggccccatgttgaccaccgtgtctccagtacagaacacgtcacccaacacctagaaacaattatttaatgaatgaatatacgtgcaatagacaacattcggacgtaaactcagtaagcagaaaaacaaataacatcttcctttggttacataaagcatgagaagaggctgttggaagaagacatgcgactatgtcgtttagaattctctctcctctttcccttgcaccccaggggtatcccaggatctctgcctccatgatcccccttcacctgccacctcctttctttgcctttcaggaacaagatcctgatttttgggctcctggaggagacggcgttggctgcctttctctcttactgcccaggcatgggtgtagccctccgcatgtacccgctcaagtgagtgtctctttcgggcggcctgagtagtcatacggggggccttcagccccctccaggatccaagttctgatcgctttgaatgctcctttatgtgacagccaccaagccaacctctgatgctgctgacactctcctccattgctttcagagtcacctggtggttctgcgccttcccctacagcctcctcatcttcatctatgatgaggtccgaaagctcatcctgcggcggtatcctggtggtaagcccctccacattccccccagcaaagtgcaagccccaccaccagctcctccctccaggaccacacgcagactccactcccactactggttcctgcttctgttcctcaacaccctcagatcctggggtcccaggtcccaggagccctgactctttcgaacctgttgtctctgccctcttcccatcagattctaaaccccgcctaactcacagttggtctccgaggccctccaccttccacctgaaaccacagaacatcagaattagaagggcctttccaggtcacctagtcccacgtccatattttacagatagaggaggctcagaggtgaatctgttcagggtcgtaaagcaaagaatagcaggactggtactagaacccaggcctcctgatccccactcatcaaccgacaagttattgtttttcctacaagcgttttttaatcacttagtagaggttaaaatatgatggcttacaaaccaaatactgtccaggaatactgtttggtttgacctgtgccatattttgtgtgtgtggggggaggagggtggattaattggtccgatatagaaaatttagggtctttcacataaaatctgaattcgacttctcctgaagatcagaagagctgttaatcccatgtccacatctctgcacagcaagaatggacagctgctcccttagactctcgttcgtcacctgaagaggccctgtgggcgtttgcattttcaccctcgacctattctgccccagcctccaatgtgctaaatacaagtctcccctaaaggcaggttcaccctcccttcctttaacctatggccccagctcactggacctccttctcctccctttcaccttctttttttttttttttttttttttttttttgagacggagtctcgctctgtcgcccaaccaggagtgcagtgcagtggcacgatctcggctcactgcaagctccgcctcctgggttcaagcaattctcttgcctcagcctccagagtagctgggattgcaggcgcatgccactatgcccgactaattttttgtatttttagtacagacagggtttcactgggttagccaggagtcttgatctccgcctgcctcagcctcccagtatgctgggattacaggcatgagccactgcacccagcctccttccaccttcctaagccacttcccccagtgcccttcaccaggcttctccttccacctggcttcagcgacccaagcccctaggaaattgatctcttgcctccttttaagctcatgctgcaatctccactcccaatctctctaacaggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatg

SEQ ID NO: 36382 - DNA, 29172 bp, Homo sapiens
agcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccgtaagtccctgggggcgaaagggggcgccggggatgggggagagggggagggaggactgggcgcgccccccgccaccccgcgcgcgccccgacgaccccaccccgagcctgcccggcccgccactgggtcgccgcgcccgcaactcacttctctccgtgtccgcgccctccgcaccactccgcgccgcgcccggggatgtgggggccagtcccgggctccgcgacagcctcgcggcacctgtggttcgggaatcgcctcaagttttgcggggcgctttcgggaggggccgggggcggtggcggccgaggactcttggcgccccctgcgcggcggcggatgccattgtctgctccgctccttgcctgtcacctctcccgggcttggtcagtgatggagtgtggccacgggagtgggggggaggcaccggcgacggccggacccgaggaacgctggccccgagcccgcgccgcggctgagcccattgtttttaatgccagtctcgaggaattgtggtgccctgtgatttgcggcaaaatcaaagcgttggtttttaacacgagggaaggaatactcgtgctttgcaaccgggtttcgtcccatgttaggacataatttattttaaggagaatacattgttttttcgtcctgcaaagtggtagggcggatacaggaccctgctccagacagccttgagcccatactcttcgcaggcaaaccctcaccctttctggtcaccaagatctaggaatacgaggtccattcttttccaagttctggtaacgggtttgcagtaaatgcccagttgatgcttcacttcctgcccccttcgaatgccgctatcttcaggacttgcacgggaggcactttggtatcacctaataatgtccttatattttgttcccctgacgcattttaagtgaggtaataagaccattttaactttactaaagttgaattgccacgtcatacatttctagatatcttgttgatacctttttgggtggttacaaaaagcgacgataatttcttaccgaaatttagggcccatttttattctacattggttctgtaaatttcccctccccgtgttcaaattcaagatggtgtggtgaatcttgagaatcatgcttgaatcttatttgcagtaacgctgttaaaggaacttaacagtgattaaaagaaaaaaggatacctatgtgaattctgcctttaaattacctttgtagaaacaatacttctgtttgcagttgagatgaccaattggattacaaaaagcttggcgttaaaaatgaaacatgcagactaatcaacacatttgcagatcacaaataaatacatacaaattagtttaagtataaaacacactagaattcagcatccattccatctgtagatactattttttattttaaatgaagtatttcatgtaatgtttcaatgctgaatcttatttaataagtgtaaatcttattgtggccttttaaacgtttgttttctttttcataatacattaactcagttctagattttgtacatatttaagttggaatgctttaaaagtcagatgaaaacatacttttttattaatgaaaatttgtatttatgggatttttcagttaatattttggatcattctgttttgcttaaaatatgccatcataaactgaggagaacattccaagacataagctactgtctgcaagtaattcaccctggaactagaacggcctcaggatgaaaaatagcaggtcttctgtttctttcaaaagtacccaaaccagatgatgtctaccattctcttttgatgcatatagagagtgcgcaatgtatagcacaggtagaaaatagtttcttaaattgaaagagtgatctttatttttcttcaaaaatttcacttcagcttattacccatttttcttttttctcctgcacactccccttcaaacttaatgtggaacaaggtgggattggaaggtttgcatctagaggaagatctgtccaaaagaatttcttgctattttaattggcatagaaatattgatggctactaatcatttgtcatgtaaatgccccatcccccaaaacttctctgtgaaacacataatcttaactttattgattcaaagtattacatgtaatcttgattttatttatcttaacagatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaaggtataatttttgtttgtcagaaaggtgaaatagaatcaaatgttaggtcatttaggaaattgcagacttcagtgatgacatttataaataacgattaataaagatttagatgaaataggtttaaggtaaagctttgtgtttttaaaataactagtgttttgattgataattactgaggctgaaatgataaaggcagggaaatcctttgaaaactagttatataattaaaggcataaatgattattcatgcttaatcatctttatagaagagtttaatgaattcatttcattgcaggggaaagtagggtcagtattttaaattgtgtgagtaattctctgaattgagacaagtacagatagagtctaattctttttccccgaaaatctataaagtaatgactaatatttgacatgccttttatctgatttttagaatcttactcacgtgtaaataccttgactatgtagactatttcaatcacatagatgttttaaaaactttgtgtatacatgagatgtgtttgtaagtagtgtttattaacttttaagtacccttgttgctatggtgggggtgcaattaaatatgacagataatttttccaaggacagattttttaaaaatttgatgttacaaaatgactcatagattggcttttaacactaaaatttttttaatgctatacgtctttattttataaatatctgaaaccctgaataccctaaaataaatttctcaagattgttctaagtaggttaaaagaaataaactttcttcttttacagaacattttttgaggggacatttacttcattccccatttgtttctttttgaataatttgctgaatttaagataagagcatttctgcatataaaaagttctcttgtgtggggagtatacatggaagtaacagtatgggatacaatgagggtgggagagaagtctggttttcttctcagcttccctttattgcactccaaatatgggttggatattttgtcagggagatggctgggaagaaatggagattacaagacataagtttcttaaatactgaggactcctctttattattgaatgatctttggtgattttgtatctttgggtgattttgtatccagtgtttcgtttggtcttattaaagattatagaaaagtcatatcatttgagaggtgagagatgttttacagtgatctagtcaggtgattttgttttgttttgttttgttttaagctttttgccccatgggtagaaccttaaataaaatgagtggaagtgaggctgctccttgtgaaatcaggaatgaggatcctgtatcctggctcacttggcctttacccctctgcacaggagacagttcttgagtttgaaaactgccgttgttgatcaaacttcaattttataaagaatgcaaatttgggagaagtgacttgtctagggccatatgccagttagtgattgacatggggctgcaactcagatcttaagcttagaggcaaagattttaaacagggctggaaaaagatcaggtttacatatcttaaaagattgaactgagacaatggatgagggcaggaggggctgagactggcacctgcaggatcagtaggagactatgtgagatcctgaacccaggcgctagaaaggagggctgtcactaaatagccattatcaaataggtaggtttgataagacttggtcacctctagaagtgggaagaatatgggaggtcgaggcaggagaatcgcttgagcccaggagttcaagtccagccctggcaacttagtgagaccccgccgtctctacaattaaaaaaaaaaaaaaaaattagctgggcgtggtggcatgcacctgtattcctagctgctctggaggctgaggtgggaggattgattgtgcctgggagttcaagcctgcactgagccctgattgggccactgcactccagcctaggtgacagagtgagaccctcaacgacaacaacaaagcggagagagcagcgaaggaaagggaggagtggggtgatctccacatttctggtttgctgatggggtacaaggtgagctagataactcggcttattttggggtgagttgatttggggatgtctatgtgactttcattaagagaagcctgattttctggtgggatgtggttggtgtaagtatggaagtctggggaaaataagacaaagtattagatcaccagcattcaagtggcaggcaaaggagatgaagaagggaccttcagagtggaatgagaaatttcaccaatgccagatgttgcataaagttcaatgaaagtgaggaaggaatctggtagattttacagtgagcatttcatataatgccctttgccagaacattttcagtggaatagtggagatagaactctcgatgtaatggggcgaagtgtgaagaggtggagaaatttaaatagcatgtgtagactattttggggaactttgctgtgaaggacaggagacgaggtggtaaccactcatagacataggagtgggggacaaggtttttaaaaaagaaggtgtgagaggcttaagcttatttctagataggggaaggagtcccccgtgtggaggaggaaaataccagcaagggattcaatcccaggaatgggctgttatgggaagaaaggaaagcactgcttggtgttcatgcacatgtcactcagtctgtccgtgttgagccactactttttcttttgaaagctacaaagggtatctaatccaactctgatacttatatcaagcacctttaaataaaaggtggactttaaaaaaaacagctttattgagatatcagtcatatacaaaaggtggaatttatcagttctttctctatacgttcccccttccatttcatactgaaaacctcatctactctaccacttacggacatattttttgttggtataaacaggtggtttgttttccctactgctggaagcgaagagctttttaagcaggagaattactgcttagcgcctgagaaattctggactgggacttctgctgttcatatcagcaagtgatttttgttgtttttgttaaattatctcatctacattcttcatcctgagtatttggcatacaaattcccccttttgagaggggaatgatggataagaataatattagctgaaaagacagactgaaaatctggggacttaagttctgttccctttgtaacgttagctagttttatgactttaaacaagtcactttgtttccttatctctaaatgctcttgaagatcccttcaagacagaatactgtgcttttttgattcctgttttgtgtagcattttgtggaagagtcactggattaaggtcttttaaaattaatttaaaaacatatatatctccaaattactagcttgataatttgttaaagaatacttactgattttctttactaacaaaagaatttttaatgacataccagtgggtattgagaacacttcagctacattcacccacagtcagctgatatttagctgatatttagctgactgcggagaagtcatgtgttttgaatataagaataggcactttcagatgttctctgagtgccagtaattagagtaagccttaatccactgtgctaaaaataaccaaacatacctttcttcttactagtctattattaattttacttcagatttagacttacaaataggcactaagagaacaaaatgagctcattattgatttttttaaaaccatttggtcctaaatataggaagtacacttcaggttctcttggtaatcttttactaaatcagtatggcatattttacttctcttcaaagctcttaaaatattgtttcgagcacattttaatttttgccaggtatgggattacgttaatgcaattgctggctatagtttttaatgtaaaacttgggctctagagtcaaattgctgttcctaggcaggttactcaaacctgggtctcttatcaatgcaaataataatggtatctcatggatacggttgttgtgaggattagagtggtaaaatatgcaaaagccttagctaacatttaatgtctcatgtagggcgaggattcagtgaatggtacttaattattatgtttctgtttttttcctgccctaagctttctggaaagaggtacattattatcctgatagctatctgttcacctacaccaaagaattcattaatttgattattctttttccattccgagtgaaagtaaacattactggctggggcttagacacattgtttctgatgatttttaaattaatgcttccaagtgattcatgcagtttaggacctttgactagtgtttaagtgctttttatttgtaagtaaagaggcagtactgtggataaggagcgaggatggtacgagcattagcttgtttaatagtagcatgaggaaatcttaaataaaaggaattttacttgaaactgttagtaaactttgtataataaattatttagcattctgttcctatcagctagtcatatctggtttttaatctaccatttttatgtcagtccctttaatgtttagttttcttaaatcagggaatcttatgtgtcatttatcagtttcctcaaattcaaagttctatttaatgagcatgggttagggaggatggagagttggaatactctattctcttttaaatagacaaacaaaaacagtaacgatgggaaagagagggagcactttgttaaagttggcattgatgccctgttttgtcttccatgacttattcccttcacaatgatgataaatgaacacatgtgaatacctcctctcaataagactgcagtagctccaccattttaaataacttactgagtgtggaagtcaggtagagtagacatgcacaaactcatgatatatatgccaagtgagtttgtatgatacagtggaaaaaggcctggagttaaggtcaaaagatcaggtttcttatcccagtactagcacttgtaggcgctgtactcttaagcctcattttttttttgtctttttttaatctgtgatcaaggatgaaagatagtacttgctgttgaaaacatcaaataagatgaaatggttttaataatgaaattaatgctgttgtgtgaatactagttattttcatactaaggagcaagaattcattgagtctcaaaacaggttgtgttattctgtatacagtattattttacattaatgctacgagcagtaactgcccattgtgttttctaaaaatcatttaagtgatcttcagtgaaaattataatctccactgaaatgttctgtgtttagcctatcttaggtttttattttctttcttttcaaaagccttaagtacatgtaaaccattttaaaatgcccttttaatcctcctcaaaggacttgctatgcctcagggttgaagttttgcttccttgggtcaagcataacatgattccatatgctagaatcctaatttgaaggagaatataagtttcccaaccttattccctcttctagggtaaataaactacacttcagttcaacagtgtagaacttggtaaatttgagaacaggcctctgtttcccttaagtgataggaactttctgttctctttctctaacttctgtaataacgtggagctgttgttcttttcgtatggtttattctgcaatcctagaaacctttttaaaaacaattctattctgttagaagtcaagagcatagttacccttgggggtgggaggttgtgactgggagagggtagcagaggagtttcagggttcagtagtgttcagcttcttgatgtgggtgctgatatatagttgagttcactttgaaaatttattgagcttgtaggacttaaggtcttctctgtgtatatattatacatattccaataaaatatcccaaaatattgacctcaccttggcattatcctcaacaagtcctccttcagttggaaggtttgttttcttctctgtacttacagtttgaattaatctgctatatattttgttttaattaagtaaacttaggaaaaacctgggtctgctatgttttaaaatgcttatagaaaagaacctgaaaggaagaagggcaaaatcacttattctaagtggtatgattattttgattttttctttatacttgcctatgcttttcaaaatttctgttatgcgtttattacttttgtagtctatgagaaaaatctgtactgtcgtgaaagaagaaataaactgtataaacttggggcttttcataataggatatgaaaatatatttagaaaacatcattataggataacagtttttttcacatttgtactttgttacagatatgctagtctgtatttttgctgtgctattgaggatcaggacaatgaactaattaccctggaaataattcatcgttatgtggaattacttgacaagtatttcggcagtgtgagtagtattttattttaggaaattgaatgccatagtatattttggaaccttttctctaacaagtttattttttggttgtcttggggattctaaccgcgggagagggtgggaatgactatttattagtagaaattattaagttgtccatattgggaacatgcagagcccagtcttatttagcttgtaggaatatgttttcaagtacttgagatttggaaattaagcttacttaaaccagtgatacttagtcatttttagaaagagttaagattgattcactctagttcgattttattcactacctgatagtgaataagcatcttctgcttctgcaagttttaacaattttttcttttcttttttcttttttttttccttttcaggtctgtgaactagatatcatctttaattttgagaaggcttattttattttggatgagtttcttttgggaggggaagttcaggaaacatccaagaaaaatgtccttaaagcaattgagcaggctgatctactgcaggaggtaagctacttattctcttcactaggcactagcatgttttgctcttgctggggaagtctcattcatcattcttacagtttcagaaagtactctgaagcatgcttgtcatgtagtgtccatccatgtgcagtttattgactggaatatgtgtcagtcacgtcaactcagttatctatggatggatggttcagtttggagatggtctatcggtcaggcctcttcccaatggccctttttggaccctaaaacactggagtctaaacctttagaggacagactatttgaagaagggaaaagattggctgaaagtagcagtaagttgagaactctccatctattgcttcaaattgtttaagataaccccctttttcattagtgtagataatcaggagttgactatgagattatgacattttaattccaaattggctcatatttttacctcatgtccattaaatgcaaaagtagccaagcaaatgatagtgttttctaattatactttttgtagaaacttccaggttttttttgttagcaaaactaaacagtatttgcatttctctttgctcttcttaaataacaaaccatgttctgtcaaactgcattcttgtcttacctccatatccccagatgtgtaactcccttttctttctaattaccatagtcatcttgggttaattgtgcagttgatgctgatgtaccttctatttctgaagcttaacatttcatagataaggctacctttttccaaaaacttaatgataccttaattcagataccaaattgaattatgctttagagctaattgtgatttttatcatatggaaagcttacagcatgagaagtgattagtaaatattgaaaaatgaaatgtgttttcactaaagtagttgttaagtgtgtgtttgcatgtatgtaaaagtcttgaatatttttggctcactggttcattttccagaagcattgaaaatatgattttgtatttccagtttattttagtcccttctttgttacatacatgtttatcagtttgttcttgtctttttttagtcaccaaaggtgactttcagtcccattttttagccttggaggcattcagttttaagggagtgaaataaggggagaagagtaacttactttctccattttaacttcttaactcttggactctgtgaggaagggaaagctgtttgagaatctcactgcatcagtcactgactgggacagttgtggggattgcttgaagttgagatgacatcatctggatagacatctactaaatgtgagacaatgcattgtacacttaatgatcttgtagttatcagaagagtggttaaggtgcctgcaaaagtgaagtattagattggcagccctggtgccatctactcttcagtagtgaaatgaacacagaccttttgccttgtgtgtacagtttgccacagtggtttaccaattgattggaaatgttattctggaggtttgtttttaatatcaggtgcgctgactataagcatatactctactgttgtaaaattggtttttaaagttagtatctccttattttgctgttcactaatcagacttttttaaaaattaggtcaaaaccaggattagaaattgggaatttttcatataggtcttcccttgatcactttcatattttgtcacagatctgtattctgctctgtcagaacctggcatttcttccaagtttttctatcattttctgattaattacattggctttaaaatgtatttaaagttattgaagttcaacttttaattttaatatttttcctggagagtaattttttgtttgtttgtttgagatggagtttcgctcttgttgcccaggctggagtgcaatgacacgatcttggctcactgcaacctctgcctcccgggctcaagcgattctcctgcctcagcctcccgagtagctgggattacaggcttgcactaccatgcctggctagttttgtacttttagtagagacagggtttcaccatgttggtcaggctggtctcgaactcctgacctcaaatgatccgtcccccttggcctcccaaagtgctgggattaaaggtgtaagccactgcacccagctgtgcctggatttttaaatgctactgggaaattgctatgggccttagaatatgacagcaatgttaagtttaccttagagcatatattcagtatttaatgtactaggggataagaacattattgcagatccacatttatttgtgtgtgtatatgtacatatgtatatatattcccctatgggagtattttaatagttaatattgtccttctgtttgaagtactatttttatgtctttttttttttttttttgagatggagtttcgcttatcacccaggctggagtgcagtggtgcaatttcggctctctgcaacctccgcttcctgtgttcaagcaatcctcctgcctcagcctcccaagtagctgggactacaggtgcacaccaccatgcccagctaatttttgtatttttagtaaagacaggctttcaccatgttggccaggatggtctcaaactcctgacaggtgatccacccacctcggcctcccaaagtgctgggattacaggcgtaagccaccgcatccagcctatttttatgtctttaattggggaaagtaagtgcaaagagaaaagcataggatgagtatggttggtcccatgtaaaattttccttacccccttgtaacctttgtttaaaataaagaaatgagtactgttaattacagttccttgtctttagaagaaagctgtggtcctgtttctcttctatgactacttttacattgctttgtacacaaacgaaactgagtaccacattgagacattgtctatttagcagtctgagtgaaccatttttcttagccatgtaggtcttggggaagcagtaggtggtggtccattctgaatttagagtgagaatacatcgtaggttaaggccattatgaagccaagctcaagtctgtgtggagcagtaaggcttcaggttattctgttctcttcatcaacatactctgagaagaaatgcaggaatggcaagatgcatgtttcctaaaaatagattcatttatatttttgatgcatgatacaagtttacatctgtgggagagtatttgaatattatgttcataaaatagcaagtggaataagagaaaaagcactccacaaactgctggaaaactttttgttttggataccatgacaacaaaaataattatgatggtaactaacgcttgagtgcttgtatgtgaggccctgggctcagcagtttgctttaagcatcctgtgctaatcctcaagacaccctgtgaaaggttagaggtagcctaatgagaaagtggaatctcagtgaggttccatgactggtctgaggccacctggttagcaactggcaaaaccaggattctaaacccagatctactaggcttcacagctgtgtaaaatcttaaccactgtgcacttcccctaaccccagttatgtattgtcttggtatatatattttaaacgttctgttttagatatgaacttctttgtttctcagtcatatagtgagaaattcataattctcccagaggtttttctgtgtggaaaagagtagatttcctaagacagtgccatctttgacttcttagactgcaaatttttattgtccagattatcagcagttggaattttttattggatatgtagatataaataatatttttcaacctatttcttgttggattgatcaaaatgcctggatttataataacttttttggtcttatagtttggggtatagcattcacttaatcaatttcatgaaatgattttgcttccaaaattgtaaatatagctgtgaagatctaaattcagacttacatttgtagtagaagtcctaattggtcaattttaatctactttttcatgtgtcattatttttctgtttagtgtcaggtcttttacttgaattgattatttctaagcaccaaagatgactttgaacttatcatgtacttatctgttggcttaaaggtgtatacacatctcaatgattttgatttttttttaatttgtgaaatatacatttctatccttaagaatgcttattttcttcagaaaaattaaaaaaaaatttctcttacccaatttgtataaacacatagtttaaggtagtccttcattttatagccaaatagggaagagggtcagtggatacagattttctgttagcatattacagttagtaataaaaatgtaacattaaatgtacattcaaataatagttgctaaaatattagcagatattgtgattagataataaagatatcttttttattttacttcattacttggtaaataaaggattagttttgacatttctagaccaaacttcatgtttattccttttggtgtttggttgtatgaatacataattagatttgggggtaaagcccagaaattggcccgttatccattttttaatgtttggctgtcttaacatgccactggtactaaagatgattcttaaattattaaagtacaacatgctgaaattgctaaattgatattctttgcaatacttggaatacttttccccaccacctattttaagctagatttttggagggatatggtggggggtggtgatgtagttggatttatttaaacacacacatatataatgacaaaggaaataatagtatggctttttttctgtaaagtcaagcacttaccagtttttctctgctccttaattttatagagccagaatgaagaatggggaggtttgtctgaggatatcttatgataaagagcagtctaaggctttagtccctttgatccccaacttatttattggtaactactaaatttaccatttttgtggcatggataaaatggagtgctatgcaaatactgttgcacgtgagatgatttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgttggtattttttctcactaaagtaatctgtgaaatgcaaaataagtgaggtaccaaaagcaagcataatactcatgaatttgcttttactttgagatgatccactttatgaatagatttactggatttgcagttgtttatctgcctcatctagaaagtggtactctacggaggattagcgctgctaaaattgatttgttttagtgctgggggctgcatgatatatcttagtactatgctatatttttgtgaaagtaataatctgtgggactgcatacaaatggaaaggtaagaatcttaggagaaaagtgatttcttttaaaaaatgaagcttttgtaacttaaaattattttaataagtactttttgaagtattgaataacatatcttttaatatgaagttttggactttttaaaggtcagctcttgatataattaagaatatttgggctgagcacggtggcccaagcttgtaatcccagcactttgggaggccggggcagttggattgcttgagcccagaagttcgagaccagcctgggcaatgtggtgaaaccccatccttacaaaaagtgaaaaaaaaaaagactagctgggcatggtggtgtgtgtctgtagtccaagctaattgggaggctgaggtgagaggattgattgagccctggaggtccaggctatagtgagccatgatcatgctactatataccagcctgggtggccacagaacgaaactttgccgaaaggaaggaaggaaggagggagggagggagggaaaacagaaaaaagaaagaatatttgggcatgctagtccaacttgagaatatcttaaattgttttaaaaaaagagatgcttccaaatatgtacaagaatgtcatttaacagcaaaaagcattttgatataaatcctcttagatttgcttaaataagacaaactcgtgtaactcctttgtaattactactgttcatgttaaaaccttcaagcctcttttaaagttaacaagactatagtcttttattgccagcgtactttagtttttttataggtaaacttaatcagggtttattataacaaattctggacaaatgaagtttgattacattaatgcttgaaatggaagtgcttgaaaggaagggcagaaagcaggacaaatgttgcctttcattttacatttaataagaaacaatttggccaggcatggtggctcacgcctgtaatcccagcactttggaaggctgaggcaagcggatcacttgaggccaggagttcaagaccaacctggccaacatggtaaaaccccatctctacaaaaaatacaaaaattagctgggcgtggtggtgcacacctgtagtcccagatacctggggggctgaggcacaagaatggcttgaacccaggaagcggaggctgcagtgatccgaaatcaggccactgcactccagcctgggcgacagagtgagactctgtctcaaaaataaataaataaataaaataataatttggccagtgtccttactctctggttctcaggttgtagtcattttgctttatgtgtttttgagccttttttcttttcatacttttcaaaattttgaggattttccgcttgctatttctattctattcttttcttaaatgctgatcctgacctagtaatttgatttcatgagccctagggttggaacctgcacagggacctgcaaagggaatagtctgtggtgtcggtggtgattttttttttaattaaaaaatactttctgaaaaatgtcacgtttgagtccttttttcacctactgacattttcttttgtttcctctgagggcctttttttaaaaataaaaattcccattctggaaaaattagcaaatacaggcaaacacactagaatataatcttacccaccaactagagccaattagattaactcagtggttcccatggagtgggagtggtgcagttgtgcccctctaggggacattgggtaatgtttggacacatttttggttgtcacaattgggggtgcagtgctaccggcatccagtaggtgaagaccaaggatgctgctgagaattctgcagtgcacaggacagcccccttagaacgcggaattatctggcctcaaatgtcagttgtgcccaggttaagaagccttggtttaatttaacactatggagtaaagattccatttacatttatagactgctatatcttttcaatattatatgtagaccacagtataaataagtggctaaaaattaatcaaaaatgcaaaaaatcaagaaaggataaatgtgcttaagaacatacaaatagctataaaaatcattcctaggccaggcgcggtggctcacgcctgtaatcccagcactttgggaggccgaggtgggtggatcacaaggtcaggagatcgagaccaacctggacaacatggtgaaaccctgtctctactaaaaatacaaaaattagctgggcgtggtggtgcgtgcctgtaatcccagctacttgggaggctgaggcaggagaatcgcttgaaccagggagtcggaggttgcagtgaagcgagataacgccactgcactctagcctggcgacagagtaagactccgtctcaaaaaaaaaaaaaaaaaaaagtcatctctatgattcaccaaaattacctctacataatgaccagttactggggagataatctatggttgactttagaatccaccctacagcaaggcttgtaggatgtcactctataatttaatttcctcaacaacagccaaatctgttaacttctattaaggtaattgagtttttatgtggaaactgaattgagtataccctgcagacagaacacctttgaattttctgccaatctccccagccactttagggatttgttaatttcttaaaggaggaatagttcaaatgaccagaatttacatatatagacttttgttgcatatatagactttttgttgttgttgttctctggcatcctgttagccttaaaggttttacttagtgaagatatttagtagcatttgagtatttgaaattctgtgattccaagaaatcttttacctttgaaaaaccctaatttagggtattccaaggcaaatacaatacagcatgtcctaaaacatgcttaaaatatttctttgcagtctaaaattatatttgctagctgggcacagtggcacacttccataatcccggctacttggaaggctgaagtggaaggatcccttgagctcagaagtttgagaccagcctgggcaacatagtgagacccctcactcttaaacaaattatatttgctaagttaattattctgcttttttttgtttgtatatttgttttgagacagggtctcactctgtcaccaaggctggaatgcagtggcaccaccatggctcacttgcagccttgaactcctgggctcaagtgatcctcccacctcagcctcccgagtagctgggattacaggtgcacaccaccatgcccagctaattttttaaaaattttcagtagaaatggggtctcgccatgttgtcagggctggtcttgaactccgaggctcatgcagtcctcccaccttggcctcccaaagtgctgggattacaggcgtgagccactgcacctggcctctgcttttttattttaaaagcacaactaactggtagataaagtgatttgtctttagtatttgataactaatgggttttagagtgttatttataagatgtagtaaattatcctcatcattatttttaagacaaatttataagacaagtgtaatagaaatagatcaacagcacaatagaaaaagatggcagaaaacatgaatatgtaattcacagatgaaagcaaaacaaatggtccttttattaagggaatgcaaagttaaaaatcaactagacccttttttgtttgtttcttcttggattggcaaagaggagcacttaaaagctgtattttgttttggaggattagtttggttatgtctactaatgactaaatgtgtacatacattttgacccattagttacacttcaaagaattttatccaacaaaaatgtactgagacacattgcttagtataataagccattgaagcttacccaaatattcatcaatgagaaataggttaagaaaattatagtacaaccatacatgaaactgatgtagctgtaaaagaaatgagatcgatttttttttgtaatgatatggaaggatactcaaagtatatcaagtgagaaaagatctaggaacaggatattattattattattattttattttttgtagggacagggtctcaccatgttgcccaggcttaggagcaggatattagctaactcgtgttacttctgaaaatctttgaagctccccctgctcttttttccagaagtgtaaaaacaagcatgtatttagtattacacatttttaaaaaatgaaaaaatgctgctgtgtgaatgaaagagtatacatcgtgttgctccagatggtaaaactagagtagaatttactaaaataaagtttcagcacgtaaagtaaagcacttctctgctcttggccattttagacactaaccatctggagcaaccatgtaactcttgccactcatagctaacttaatgtaaaaaaaaaaaatcgcttgactttcttagcacttcacaaatgcttgtaagactgacaccaggagccctgtcatctaaaaggcactttatagagtgctttcaattcttctgttttttcattcattgctcaaaatagatcgtagtgagataagatagtctctggccttcttggtctttggcacaaggaagagggttccagagttgagagtaaggactttgcatcctttgccatagaatttgattaggggccataaaaaggaccattgtgttctagaatgtgaaggactaagcataccactttatagtgcaaggaataagtgaagaagtccttttataagaaaaactgcagtagagcaataacttgaaattacacttatttatatttacttttcattaaatgtaaattattttcttttaccacattgtactactagaaagagaatcaggagtttaggcattcagtcatagatattcgataccattgatttacttaagcacttctcatgtcaacaagacttaagcctgcagataattcctattttatcagtgttcgttatagcttccctgttggttttacttgtgagtcataagcctagtatggtgaatatctaggaaatttcacggtaacagggcttgtcttaggttttgagaacaggtgtaacttgacttctctctgctgtttgtcatcctacacttcccactacatctggtcctttttgtagggtgttgagaacaacatttttcttcatgcaggggaaagtggaagtgcatgttttctaagaaggacaaataggaatagaataaaagaaaaagtatattggggctgggcatagtggttcactatgtaatcccagcactttgggaggctgaggcgggtggatcatgaggtcaggagttcgagaccagcctggccaagatggtgaaaccccatctctactaaaaaaaaaaaaaaaatacaaaaattagccgggcacagtggtgggtgcctgtaatcccagctactcaggaagctgaggcaggagaatcgcttgaacccgtgaggtggagattgcagtgagctgagatcaagccactgccttctagcctgggcgacagagcaagactctgtctcaaaaaaaaaaaattatatatatatatatatatatatatatatatatatatatattttggaagggagaatgggagtggaatcaaaaacattggtctcggatgagaagagtctttctcattggttatgtggtgataatggggtaaagctgtagactttttttttctttaattcatgagtaagatgagcaaaattgaggaagtgtcattttcttggccttgagaaatgacatcatctaaaggagaatcgttgggactggggagaaggggaggggtgtatagcttgaggacagtgtgaggagttggcagtagacttggtggggagcaaattagtgaggagcaaaaaagatttcctgggattgaaagcccgtttcaggttgaaataatacattgtcatccttattcaaagaataggtctccagagaacctgtactaaggacaatacatggtttatagttgtacaatacaactggattaaaaaattttttctcactgttttcattctgacctttattcccacttaattgaaatcactggggttttagtgttttaagaaacggatagtttgctgagtattatatgtgactatttcctacgggtgcccaggggaagaacaagatagtaggcctaggcctgcacagggtcccttgtgtgctatgacagactttactctcaccctccctaattcctaattgatataatttttatgtgactcacaagaggtactggtggtaagaggtataaactggaatttataattgaatctactttctttgtatctgaaagaaaaatattttggttaattatgggcatataatttagctaaaaaattaccttaaatgttaagtggtccttaaggcatttataacagaactttttcagaccctagaagtctaaactgggaaattatttaaaacgttattaaagcaatttaaaatggtaaaaataatacatttatttttgtgcattttagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgtttgggaaaccacctcttctcttttaatgagcgtaagctctcgatggttggtttttacatggtatgatagaaaattaagagagaaaagaaaaagatgataaactataatataaaggctcaaagaactggtattatttaggcaaaaggttatttgacagattggtattatttaggcaaaaggttatttgacagacttaaacttttcttgttctctctccagaaaacagagactatgtatcacagcaagagtttcattgggtttaagaaagcgtactagaatacgtgctggagtactgacatgcatcaaaatgtagtaggatatataaattcagtttgtaatgacaattttgtcaagtttgttatttatattttagcattacctgaaaagtctaattacattaaatcccaagggatagtcccaattacttcattaaactggtattttcatagggaattttgcttggataatgatccattattggggcttataatttattttttacacagaatatggaaatagcttcagaggttcattgacaataaagcattcattaaatactgtgaatcactaatgccattgatacagaagaatttccctatgaaaatgagagcttctgtgagaaaatgaagtagttgggagtttaatttcttattaatatgattttaacttgctgcttcattccactatattctgagttgggggaaaagggcagctatctctttaaaatatttaggaattctttgaggattaaaatgtaactggcttttgtcctcagatacgtttgtaattaatggttgtgtaagtttagggatttgttagatatttttcttggaacagtttacatgattttgtagttcaacatttcaaagtttcaacttgaataaatattaaaatgaggatactttaaagacactcaaataagcaattttaaacttgctttctggtggggatataatccctttgagagtctgaaggatgatgggctgtcaccccaggaaaatttgcacatcattttgtttctaatttcagggaactctcagagcccctagaagtccttctgtagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagtttggtcttcaaatatggaggttaaaaaaagaaactattttgtgtgattatcttacaatctgtatgagctaatgtgttctaatgtatcacataaaagtatatgtgaaaatattacaagaaactaaaattaatttgtaccattatataatatttaaggttaaaacattcagtattaagaaattttgtagtgccacatttattgaatcacatttgtgctatataataatatcaaacaatccctttaagaacttattagagagctatgtctgaagtctgttctgcaatatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatattggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtacttcgtctcatgtgaatgactttttcttttccatccctcataaaataacgttttatattttcatttttctaggcaaattttttaaattgtggttaaaaacacataacacagaattcaccatcttacgcagttttaagtgtacagttcagttgtgttagttaagtttattcacattgttgtgcagcagatctgcaggactttttcatctggcagaactgaaactctatacccattaatcaacaattccccatttctccctgtcccccagcccctggcaaccaccattcgactttctgtttctataaattttactactttagatagataatagtttttctgggtagttttgagctacaatttcagtgtgaacatgtgtaagttccattttatattatcaccacaatttattttaaaactctacctgtgcaagtctcacaagaataaaatgtgtaaataattctttgaaactaggccttttagaaaggacacatattttcaataatgcatatttgataagcagtatgattctctacaggaaatgctatataagattgcaggcagtgagcacatggggaaaagtctgaccagctccacggagtagctgtggggcatttttacatggagaagctgagaatgtaaactgtagaattcaatggaggcattatttaattgatacattcaaggctacatgaacctttaaactacttaacattacatggaaataattattttaaatttttcttgaatatttatgagatttagatgtcattctcagtgtatttaatgcttaaggctaaatataaatgaaagggattggcttacatcactcttgggtgttacatcatttccagtggactttcttaaaaaactttatcatgaaaacttcaagactcacgagtataggaaatagtataaagaaccctcgtgtacacatcactgagcttcaagaaccatcaacttaatactgtttccccaaccactccccgcatttttgcctcagtatcttagagcaagccctagacatcttgtcagtttgtctttaatacttcagtatgtgtccctaacagataaagtaccatgccccacaaaattaacaggaattaataattactatcttatgcctggctcaatttttcctaattgtctgaaaaatgcctttttatatttggtttgttagaatcagattccaaccaagactctcacattgtatctgattgatgtgcgttttaagtctcttttaatctttaacaaatcgtctgctttttcccgccttgccattttttttttttaaaacgaggtcatttatgctgcaggatgtcctaccttatggatttggccatcatactcatatggcaatgtttagctgttcttatatccctcatttctatttagatctgtaacctgactagattgaggttcaatttgagggggcaagaatacttcataggttagactctttttaaaaaaataccttttttcgctaaagctgatttttacccatttttattactatgcagacatactaaaaggtcatcatatgagctttataagtagaattggtgtatagtacttgcgtttaataataaatgctaaatcatttcgatttcaattgtgtaactatatcacctaacatttttgaagcactttctataaattaggcagagccttaattcacttaatctcaacatatgaaggtaagtactattatccatgttttccaaataaggaaacagaccatagagtttaagtaatttacttaagattacaccatgaagtgctttacatgcaattaatattctaaagatttatggtttaatataatttctcttctccttgctttgtgctgtaccatgattaggatgcgaaagtaagtttattactggatgccaaaaatttatattattttccatcattaaaatatagtgttgccttttaattacaaaattcgttgctagtaatacctgaaagttggcctccttggtcctttattttgtgatttgcaaaatcagccactttggaaaattattaaataattttttcctggatatgcttactttgttttgacctcctttgacacttaaaaaccagtgctggttgctacatagaataaaaatgcctttggcccatggcattctttgcatatgtggcctctagtgatgccattggttgcactggggaggtctgggaagatagctgtttctgaagacttgccgctgtggacacagttaactaaaaactccaagaggaagacatttctataaatgcatgtgacaaaaagcatggaacacaacagtaggcgaagaactgtgggaactcggagggaagaggttttgaattttaccactaagataacttatctttcatatatataattgagtagcagtgatttcataaattgccagcaggtttgcactgggcttgactgctttttgcatgacagcaacggcatctagcacattggtaggtaattagcaggtacttaatgaatgctgaaaacgtccttttgtggtctccaattttgagggcacaaaaccctaaataaccaatggctgtcaactagaatgctactgtgacacgaaattgctttcttgattctctaaaacaagcatgttcttccatgtcaatgtttcacattctcaagactccctggatctgcttaccagagtctcacattttccctccacaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacataccttttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 36383 - DNA, 8743 bp, Homo sapiens
ggaggccagtgcgcggccgcggtgctctaccggcgtgtcgctccgccccagggagagccggcgctaccatggaggagtaccatcgccactgcgacgaggtaccgccccttggctacctgggagcgccccccactcccgccttcctctgcgcggggctcttgccgggtggtctcccagcgagggcggtcccaagagttggggtgcggcgtcctccgagcccgggtcctctcccctgggcccgggatccgccccgcccgacccgttctccccaccccaaagtcctgagattcggggtgggaggggtggccaggagcgcgcggatcagacggtggggtcggggcagggttgggaggacgaggcctgacttgggtgcgaggagtgggcatggggtgacgggcgccgccctcctaccgggcgggcctcgaaaacgggtcttcccgctgctgcctccgtcccttggcttcctcagcgcgggtgctgcagcccccatggctcggagtctcggggtcctggtggcactgccattcccgctcccggtaatgcttgccaggattaggcaaggaggtgctttatggattacgagcccttgcttactgactcaggctttcccaaccctcaccagaaacccatgatgtcagttgttatctccctgttattgatggggactccaaagaaaagactaagttgtcagaccactttatagtactaaagtgatattaatcttgagttatcaagtattttcataatctttaatttgggaaaggaatttttgcctagaaatttttgcctagcataagttaaaaacaaaattgaaaatagtctactaagcattctcttcatatggaccacttcattctctcacttagctgaaaccatttctatattcttatgacacataacatcctcatagtcacctcttgcttatttcctacgttttacaatacaatgattcttaatctaggatgttcattagaatcaccagtataaagcacttttttaaaaaaaaatgtagacttgcaggctctgccccagacctcacgggaggtaggtagggaaagcattcagtatttttaagtgtttaggggcaagattggccccttctgtagacctgatgccctttaacactttaacacctgtctaggccagcctaggatattctgtgtagcgtcatacttgtaagcctgtgttgaaagcagctttaccttttgttttccctttaggttggcttcaatgctgaggaagcccacaatattgtcaaagaggtgagtcatacattttgtttctcttgaagcttgctgcactggtggagatttttaaaagctatattttgagtttcagcacaaacttagaaaccttactgttaaaagaagaatattttgttttgttttattttattttattgttttttgagatggagtctcgctctgtcacccatgctggagaacagtggtgtgatctcagctcactgcaacctccacctcctgggttcaagcaattctcctgtctcagcctcccgagtagctgggtctacaggcgcccgccaccacacccatccaatttttgtatttttagtagagacggggtttcaccttattggtcaggctggtttcgaattcctgacctccggtgatccacccgccttggcctcccaaagtgctgggattgcaggcgtgaaccaccacacccggccaagaacaagattttaaatatttatccactaactctttataggggtccttctatattttgttgtgtgctatcagcatcttgaggcttattctgaaagagatgcttaaggattttcttagtctagaaaactggtttaaaattgatgccctgtcttttggataaaataacttttattccagaaagcaaacattattttaaatgttaatgctataaagtatatgtacgcatatatatgtacacacgtcaacttttataatgtaaagtatatgtataatatatatgtatattgtataaaatagataacaaaagccctagaaatatctgcctttgggcatgtacacttttttgcccaatataattggaaaaaatgatcatttaacatattttaagcattgatatgatagtgaatcaaaattttaagaaaaatatttgaaactccttttaggcaaatagaaaagaaattacctttgggaattaattctggcaggggaccgttcattattttagaggtatcacatacagaccacagtgtgggaaaggtattttttgacacccaggtctggccttacacagctagaattaactcaaggtctgagaggaatagacaggcacctgaaaatcctgccatatttgaatacttcagaattatgcattctatctatgtagcctgagagtatttaattattaaaagtagaaagcaaaggtttttaatacctttacaatgtaaaagcacaaatgagggaaactgggaggtggaagagggagtggaggtaatgagaagggagtgatcttagttttcaaagtggcaagtcaggaaagactgtccttggttgatggaacataaaagaaagaatgctgggctatttgggattccatttaaatagtgccttcttccttaagttctgaaccaaatgaaaagaaaaaagagccattagaaagagaacaaaataccacctttattattgataaaaaccagtttgatgattgtaccttgttttgctaactcccattcagttcagccctgggaagagtcatccaagagaaagtttgagtcagcagagagaaacacttgttcaggctggtgcctttcattggtttgggtggagagggaaggagaaactaaagcccaagttcaacacatttgggagactcccaaatgagatgttagaacaatggttatcacccaccaaccaggtaactcattccacctccatggggaggaataactgacaggacaagaggccaggaatgttaaagaacaatcctctgcgttgaagaaaacatccagagtggaaaagaaacatgtttctaacagtgtaaatatatttaagttaaaaaatcgtgatttcactatattgagagaagggggcgggtggtctgagggaaccaaattttcatctatcatagtaggagttacatggatgttgcctataattcataaatcaggaaatagtgagataaacattatttggagatacataagtaacccttggaagaaataaaaacagttgtacactgatgagtttcctctggggaatgggactggggatgggaaaggaaagggtgggaaggaaactcttcattctaagcttttctgttctactggatttttcaaaccatatgcctgttactttaatattatatcaaattaaaagaatcatgctttttcaactgggaaatacatactcggcagtggctaggtggtgctagaagtcactggatgcattttagaacatcagtttttcttgaatatttgtgagagggagttaagtaatataaataatataactgaaaacatttttgaataaaaacaaactctgatgcattatgtagtcaaaacaagcttctcttgaatttttatatgaaatatgagactgcaaagaaactcagctttgctacaggttacttgcagctaaatgtctatctttcctcttcccatgaaccaaccctcttctgccattgaaacatttccattgagacattggaaatgcctgagaatgagcaacattttaaaacagtttagcacttcctagatgattacataatttcagcagttatttctgatttccttactgatcttattttcttattgatcttattttctttcctttgatttcttgctctgagcccctatgctaatatgtttttccttctgaactcagagacacccatttatcagtaatatgcatacattttctttagtgttagtaatagaaattgcttccccaaaaaatcgtcgaagaaaaagtgagctacaaatgacttagaatttagtctaaagtgtatttgatttaagatacccagcgagtatatcaaaaccaatattgcttcaacaacatttgttgaatacctgctaagtgcccaggtcctgagtttagcactgagaatacagagctgtttaaggacctcattgtctcatgggcctccatgttaatgtaattaattaggctagatgttaattaatagtaattagcagggctatttacagtggcacccacaccccatggtgttttctgctgtttagagcaaaacttggagtggtcctactaaataacctgaaagaaaaatgagtgctcttactttatccttaaggaaaggtgatctcaagagaggaataggtttgtccaaaggtcaccagcttaggaatggtaaagccagaattaaaattctattcccctgatccttaagccactacccttcctactttgtcatgttattgagctttctaggagaaaaatttgagccatattacttttgtcaaccttgctaaaatatttcatttctcttttcatattttatcattagtgaagattttatactatccaacttaagattttgtattagtgccttcataaatctttactgtggtctaattatagtaaataaagctgcatgtgtgtgtatgtgtgtattattaagctagattctaaaaatgaattaaatgagtctaatgatagtaaatgaagctgcatgtgtgtgttagattctaaaaatgaattaaatgagtgctttattatccaggctttatcactcaaatataaaatataacagcagcaatatgataatagtagttaacattatttatatgctaactctgtgctagtcctgtttgagcacttggtattcattgtctcatttcatcctaacaacaacctgataagatgatgctgttatccttactataaggattaggaaaatagggatttgaaggggttaagtcacttgctaaaggtcacatagcagataggtgtcaaagtaggccttaaaacctaggattgtgatactagagccagtgcttttaatcaggtgtcagaagtggatgaaatcaagcactatgggaaattatgatatttgactttatctttctagagcatctttatttactttcagtggcaagtgtgctagttgtttcatagctaaacaatcacatagtatgaatgagaatataatcagttgttgtttcatagctaaacaatcacatagtatgaatgagaatataattagtatacataagaattatgtttttaaattagtcccatcctgtttctagcatgtgagccctagttcaaatcccagctgtttcaaagctacttgttaaccaattgatagcaccttttaatttccccaccataatttttatgacataatttatcattagtcttccttgtgttatagatattcgaatttttttattagcttctctgctagattaagttatttacacagaagccatgacatatttatctttatatggcccatagtatctcatagagtgagataatgcaagtggaaactctttcaaaactcttaagcaattagagacagtgcataatcaatgtttaccaagtgtatattttctaagatgccttattgagctataagtatattttatgttttgaataaatttttactgcaatttgtgtaaaaattgttctttttgaacaattttactgactaaattaactgccctctgtgcccttttagtgtgtagatggggttttaggtggtgaagattataatcacaacaacatcaaccagtggactgcaagcatagtggaacaatccttaacacacctggttaagttgggaaaagcctataaatatattggtaagtatcagtatccttcctcactagttcacttgcttttgtcattgtgattttctctgaattttgagaaggtatatgtacaatagacatttaagttggatactaaaagggtataaaggacttctgatttactcattcaaagataatctataataatacttaaaagatgaagatctttcactactcaaaggcagtttgagctacttttctttggtagcatcaccctttgcatttccatcagttctttctttccactgagacccccccttagctcaactgtgtttctttcggtagtcccatgcctctttacctgtaattccacacagcaactgtttataaagtggagtatttcctgcatttctgtgtctgaattctgcccatggtacaaagcacagaatttgactgatatttttcctgcaatacaatcaccaatggtaatgacaatggtcagaaaaccaactgaatccagtggggtcaaaatcatgatggtagataaagatgagagtcttttatttttttttcaatctatttgctgaacgctttgttttctgttttttgtttgtttgtttgttttttgtcttgttttcggcttgtagagctctgaactcacacactttgaccttggttctcttttcctttgtctgtaagtgccctcattctgtgactttatttgcagtgacctgtgcagtggtccagaagagcgcatatggctttcacacagccagctcctgtttttgggataccacatctgatggtaagagatcttaagctgatttacacaaaatccaacttttagcaaagtcaaactgcactttttaaccaagtacttatttaattctgattaaattctgaaaagactatcaacagtattgctttgtacctagtaacaagtataccttcagaccgatatgaaatgtgaaaacttaacaggttgaaggaaataagatattaaaacatgtgaaaaatgtatgtgtatatatatatatatatatgtgtgtgtgtgtgtgtgtgtgtgtgtgtgtgtgtgtgtatatgtgtgtgtgtgtgtgtgtgtgtgtatatatatatatatattctctgataatttttatgttttgctggtatttcaaaatcctttttttgtgtttcaggaacctgtaccgtaagatgggagaaccggaccatgaactgtattgtcaacgtttttgccattgctattgttctttaactgactaaaaatgttgggctaaagccattaacttaagaatttgtcagtgtatcctttccaaaaagagtaatagttgtttactagtgtgctagatgaaaagcgtgcaatatgctttaaagctatcaacaaaaactgaatattataagcaagcaatatcatagtaattggcagattagctcatattctatacagcatcgtttaaataggaaaaatttaatgctagcaaaaaataaatttagaaatatggcatgacatgaaaatacaatcttatatttacaccagcttttcactaatattttgtacctaaggtgatggggaactccattcagataataaaattctctttcagctagagaagttaacaggaataaatatatgaacaaaaaagctgcaaggataaatgtggagaaaatgatgagaattagctaacatttttaagtttttttaaactttcttcccctcagttgtacttaatatttagtggaaagtaataatttttttaattttctatcaactaatagtatagtaacaactatgattaacttgtttactttttctgaggattagtaaatcaattttttttaatttcaaatttttggatttacacttgagggtaaattaaatctggtaaactgaatttcctagttaaataaaattagttgcagtatatgatgaacagtgtatgactcaaacagctgccttacaattcactcattccatgtggaacaaacatttatcagatgcctattatgggcatatgtctctgctaagcaccatagttgtcaatgtgctgtgcaaatgctaagttccttttagcaattgttcagttggaagacgtattaatatttggggaaggaaaagaaagtagttgttttacaagggaggaaaaaagtgaatctggttacacatatggaagtaagcaaaatgaaaagcacttattgctttctgacagaattatagatgtaattttaagagttgctcctagcaagttaaaagtgcatataaaatatgcaactcttagttaaaggccttattatcagtcttacctatacaagtagtaaattttgtcattgctttagttacaaccatctgtaaataacttaaaagacttattatgtggggttcaaattgagtggaataaagtatagattaaaagtatacaatccttagcacgttatctcagggcttatgaaatgtaattaaatttattaagaaaatagatgaaaaattagggtacacagctggccaccaaatgcgaagtcaatctgctacttaaccctgaaaacaaaatcagttttgcatattaccactaacactaatacatatagagagcggaaccataactcattgaattttggagaggaataagcttagcgttaatattgacaatattaaggcaatattcttgtaggaatactatgtgcatgtttgatattttgccaaataacaataattaataattgttcaatgtttaagaataatattaacaaaataaaggagtttaatgcagtgatctttgtttttggcacatcaaaaattctcagtcattattcatgtttctttatgctgctggcttttgtgccctggaagatcataatagtgaccaaaatatacatgcagacttgttttttattattgttgtttaagcataatttaagaaaaaaaatttttacctggtgaacttgctatctgctctgtttctagttaaaatataataaatattatcttcctgtgctgta

SEQ ID NO: 36384 - DNA, 5244 bp, Homo sapiens
ctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgggtgccgggggcgcacggggcccggggtcccgtcctcgccgcggggctttggagccggctgcagaggctttgttagcggcaggcgaggctccctcctgcgccggagccgcaggtcgcgacaagttgctgtgttcttagaagtcgcggcggtggcctggcgcgtggatgcggactccgatctaagggcaggcgctgatcagagggtcctcctggctctgcctgcggggagcggcgcgtttgcagcccagcggggagcggggccggagtctcggcctcgacgccgccgcttccgcaccctgggggctcgggcggccgggaggaatcgcagatcctggcctgtagctgccgcgtgccctcagcgtgtctgtgtgagtgcctcagggtgtatttctgtgagtgtgtctctgagtctcagtatccctaaatgcatttttgtgtctctgagtgtcgttgtgtttctgaaagtgtgtctgaacctctgtatcactcagcgtatctctgtgtctctttgaatgtatctctgaatgcatttctgtgtctctttctgagtctttgtgtctctgaatgtgtgagtctctgtatctctgatcttgagtgtgtctttctgaatgcatttctgtgtctgtctctaagtgtctttgtatctctgaatgtgcatctgagtctctgtgtgagtgtgtctctgcgtacatctctctgtgtgcgagcgagtgtgtgggtctccctgagagtttaggtgtccgaggtgtgcagaagtgtgtgttgtgttgcttttcagcagccgggaggagtaggctctgtcagcgtctcactgccactcacctcatattttacaaacaggaccaaaaaaaaaaaaaaggcagcgggtcagtttcttctttcctctgcaggctttcaccttttagaaagaaataacccgaactgtctccgaatttcaaggttctcctcacctccctgctgtgaaatctacctactgttctgtgaacagataatttttttaagtaggaagcagtttagtctttgcagccccctacttctctttaattgctatgtagcaggcatgaggttaaagcataagctagcccagcgaggatgatgtgctacagtatttatttattttggaaggaagggtgtaattaaccctaaataacagcccttgtggcttgcagaggggagcctcctggccctatcaaaggcgggcagaacagggagggactgaggctgacatgaagtcacagataccgaaactatgtgcctgataatgatataattaggggatcagagatttctgacggctgcggacttcaaaagctttaaaagaagccagcagtctctcctgtagccatcttgactaaagcagacatttttgtttaatcactacatacagtaacgagaaggggacagaaacagaagggcattgttccacagtttcaaaataccagtcccctttctggccttttgcatgccacaggaagaaactttatgaacgacagaaatatagttttaatacagtggtacaaaagtccattctccttgcttaaaatgtggctccaattaaaaaaaaaaggtagttagaactttcccagttacctgtcaaaattttattaggctgtttttaggtcattgaaaataggctctcataaacatttaagcagcattttacttgtattcagtcttccttttctgtacaaggtctgaagctaatagggtcaaaatgggcttttaatctgttttatttatactttaaatctatatatggaatttgtcaaactagggatatgtagtcatcaccccagaagactggtgagctttatgtggaaaataaagtgagcttggagggaggaggagaaagagcagagaagtggttctgcaaagcaaggttcttacttgaagcagagaaggaacttgggcccaaccagtgcagatttaggagcaagacccctagctttggactgttaagggttgccaaagatctgtgtttagcgggctggttttccttagaaccgaagcattagcagcgtccggtgaaaactgagcatacaataccgtggtctggaatttggacagataattaaatgagacaccttactggggcgttcagagagagggggaagaataaaggtaagggtgggaagaggtttgtaaaacagcagatcccggtgtttaatttcagagtggaggtttcggatcttcagacgggaaactggaagaggcgtgtgcattagtttagtttactcgctgtggcatgtgacagcgaccagggtccactaggtggatattgtattagtgagaacttgaagacccagattatttcaacgagaaactgatattaaagcctccaatcttgccctgcgacaaaatgtgaacggagccatgcaactcacaaaataagtttttataaaggaaacttttaatcacttcctgtagaaaatttgaggtttccttaaggatttttcattcaaccagcagaggattttcagtttcagtgtttccccttttagatcacatgtcgaattacatgtaaaacttgtgaggaggaggaggagaagttagccttgcagttttatactccccccaccttttatgactttccatttgggctgaaagaaattgactttggcaagcaaaccactaattgtaaactgcctagttcctgttttacaatatactgactaaaagctcctctgcatgaaaagatctttataggcaaaaagtttgccttttctagagaggttgcaaatagctgcctagtttcatagttttaaaacctcctgacctgggcagtttctagattgttgtgtttctagttaataactttataaggtgttagctaaagctcttaactcttggtgcagtcctgtgggatagtaaacaattcagtagttccgatcaaatatttatactgacaaaatcaaaaagcctaacatttttatgttgtatggtcatgtaggattaaaatgaataaataatgtgttataccttatggtaggagaaattatactcattactatttccttcaaaaagcaaaagtttttttaaaatgactctaaactcctcagaaacctgctattgggattactacattgccaaaatgacgtttaactggattgaaacttacgcactggctgcaggaagggcttctccaggctctgtagactggagccctcagcttggatgatctaaaagttcatgcctttgaatttgggatttagcagttgcctaaatagttgctttatctggtctctggagcagagtttgaggtggtttctcattgttttcaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggtaggtggaagccgtttctaaccagaatgcctgcctgatctatagacttgtgacagccacgactttgtatgtctgctattgattttgttgttaatgtaattagagacaccagagggagaagcctggctggatgcaaagatgcatcttgattgagtggcttttatgtctgagcattagatgtctgtctacataataggttttgcctgttttttcaacattttgaagacattaaaaggccattacatctcagtaatgacagtctgtaaacaaatgcgtttgtaagcttcttcagatagttttgcaatgttttctaaatatcgttgatttaattgtaagcttctttttaatggaattcttggttaaaatgaattgatgattatgaatatccctaggaggagttagcatggagtttgatcattttctttgtactcctttaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctga

SEQ ID NO: 36385 - DNA, 1914 bp, Homo sapiens
ctgggaggaggagttggaggccggagggagcccgcgctcggggcggcggctggaggtaaccccttgggccgagctggaaaggcgggccacctcggtcttcgctcctttgtggagctctggcagtaactcccctccctctctgtttctctgcaggcagcgcaccgagttcccgcgaggatccatgacctgacggggccccggagccgcgctgcctctcgggtgtcctgggtcggtggggagcccagtgctcgcaggccggcgggcgggccggagggctgcagtctccctcgcggtgagaggaaggcggaggagcgggaaccgcggcggcgctcgcgcggcgcctgcggggggaagggcagttccgggccgggccgcgcctcagcagggcggcggctcccagcgcagtctcagggcccgggtggcggcggcgactggagaaatcaagttgtgcggtcggtgatgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgatggggaaggtgctatccaaaatcttcgggaacaaggaaatgcggatcctcatgttgggcctggacgcggccggcaagacaacaatcctgtacaagttgaagctgggccagtcggtgaccaccattcccactgtgggtttcaacgtggagacggtgacttacaaaaatgtcaagttcaacgtatgggatgtgggcggccaggacaagatccggccgctctggcggcattactacactgggacccaaggtctcatcttcgtagtggactgcgccgaccgcgaccgcatcgatgaggctcgccaggagctgcaccgcattatcaatgaccgggagatgagggacgccataatcctcatcttcgccaacaagcaggacctgcccgatgccatgaaaccccacgagatccaggagaaactgggcctgacccggattcgggacaggaactggtatgtgcagccctcctgtgccacctcaggggacggactctatgaggggctcacatggttaacctctaactacaaatcttaatgagcattctccacccatcccctggaaggagagaaatcaaaaacccattcataggattatcgccaccatcacctctttcaattgccactttctcttcttttgaatttgaactctggagttactgttctacagtttggcggggacggggcttgggggttttctcttttgtttgtttccctttctttttccttttttttttttttttttttttgttggctttgcgttaggatgctctgatctgacatttgacatgaacacaaagttgctagatgctcttgttgacttccagcagatgggatgggggaaacacagcagttcttggtaaagtcctttgtaataatagtttgatttttttatttcgagagaatctttcattttcctatgtatgcttttttccttttttgcccagtttccttatcacttgctgtagatggcttattttgcattcatgcagactatgttgcaagtctgtttcatctagtaaactgaaaattattgcttaatcaaactgccgtttgtcttttatatttaaggccttccccccccttccttatgagttctaacttagtaatttcaaatgtgaccttttatatctaagaccagtatagtaaacttagcccacagtggcaaataatgagtaatattgtaatatgttccagttgcacctcagtatgttaaacaggtaatgtaagaagttctctgaaatgtcagcaagtaagttctgaaacacatcatgcatgagtaggaataaa

SEQ ID NO: 36386 - DNA, 46333 bp, Homo sapiens
caaaggccaggcctgacggaagagcccagccttcgccgagggccgcagggagccagagactcgagcctgcggttccagccccgccgcggttccggccccgccgcgatcccgaggcctgcgcatgctcggtgctgcgcggggctccctccttaccgcaggagctcctcatcgagaaacccaggtaagtcctgccccttctaccaggtcaaggaagaggaagaggagactaaatttgagagatagagtattttacctgaaaacatttactcaaccaggtaaagattttcattattttcattagcactagtgggaagctgaacttcaaatggaccacatgtttacactgaaacaagcctgtatcaatgagaagaaatggaaatattgtaacaagattaaatctagcctttcccctgctacctgggaggtgaagaggagcaggtgcgcttctaaacgagcacgcatagggaaaatgcactctaaattctttgcacatctgggaggtggtatgagtaatttttctaacttgctgcatcctatctcctgtgtgttgtatgaagtgaaagactgcatttaagattaagtgggcccccaggacctggcacaggctgtggttccttatatcgagtggcatgactgcattccggcctttgccgttgactcattctttgcccttgtcaagtttcctagcctgagtcggtttttccccttctcgttagagctgatgataaaacagacttacctagccagggcaacacagggagaccctgtctctacaaaaaataagaaaataaaatattagccgagtgtggcgtcacacgcctgtagtcctatctacttgggaggctgagacaggaggatctcttgagctcaggagttcaagactgcagtgagctgtgatggcgtcactgcactccagcctgggcgacaaaacgaggctctgtccccaaacaccaaaaacctcacaaggctcttccaggtatgagataatatattgaatgtcccttggtgaattcagaaatgctggggataaaatatatgtaaatctcaaatacatccggattattaatagtgtaatgtctacaaagaaatgctcattgtctcgctagcattcttttatttaatagagtaaaaaagaatgaggatttttaaaaaattaaattcacggaactgtttttatgttaaaggatgggaacatggcttatgaatatttttattcttcttggccctgcccttgtacaataaagtttgctaactaccattatctcatttgccactcattaatccagagagatttatttagaatcattaaagtttctcaccccaaaatcaggttgagatttgattcgaattttattaaacctgacatctttataatattgaaactttcaggaaaatgatagtttcctttgcttattcgagttgttatttttctctgagtagattttggagttctcttcatagagtctagtattctttataaagattattcttgagaattttataaggtttttttttggcctggacggtggccaacgcctgtaatcctagcactttgggatgccaaggcgggaggatcacttgaactcgggagttcaagaccagcgtgggcaacacagggagacctcgtctctataattttttcaattaaaaaaaaatttttttctgattacaaatgagacttttctctccttcatggttttaactgtttatagaagatatatcgtcaagggaattatttttacaaattcattctatggctgccgtaataaaaataacaagagtgatacaaaaagtacagttgtatcttaaagtattgagcagttgccaaatggcaggcactatgtcgtgggttttaaatgtattttctcagcaaatcttcacaataatcctataaattaattatagttattatcctaatgtgtagatgaaaaaacaaacccagtgagatgacataatttgcctaaggtcacagagttcattactaagcactaattaattctcttaggttttctagatacacaatcgtatcatttatacaaaatgacagttttgtctcctcttcccaaggctgtgtgtccaatttttgttctacactttactgaactggtcataattatattacaatgttaagtaattattctcacttaaatacttctaaacccttttccattcagtggatatgagtatatgatgctgcagtcaatggaaataatgatcacaataatccctaacacttactgtgaacccaggcagtctgagtctagaattgatattctcatttacacaactaattcaagagctactgcaccttattatagcatgttccaggccactctagcatgatccacatgtttcaaaccttctccaccacctcccttcagttttctggctttgtagccagagttcatctctaagtctagccccagttgggttggtgatcctgtttaccgtgaatctaatcttgtactttcttatgacatacttctagtaacggtcccttggctctacccagtgaacttaaagaggtgacccatctgtgtcctctctagacctcagaaccccatcctatttaagtccagtttccttttaccaacagatgaagtctctctcaacattcctttcaaatatctttgaaaacagaaaataaggaatttcaagaattttttttcatcaaaaccccataatattctatgccagcatggtggtgcacagctgtagtccaagctactctgaggctgagatcagaggatcacttgaaccaggagttcaaggccagcctgggaaaagtaaagagacctctcctccccatgtctctaaaaaataaaaatattgaaagacccaatgtccaatgtcagaaagatcaaggagaaagtgatacttttctacactacacttctaaattctttctaaagggcaatttgacaatgcatgtaaaaaattttgcatattccttgactcagaaatcttacttattggcctccttctcctccacccctgtcaccacctctgtcctggagaagaagccatatttggtctccctcaatggctgagacagaggcaacgcaggcaccatgatcccggctctgccttccggcgacccggagctcattgctctcatcctggagtggctcaagagccaggcccgtttggcagcttctgtcgatgctgcctggcccctgtggacaccaagccagcttaccaaaaccagaggcagaaagctgagggttcggtgtccacacacctggatgagcagaactggaatcttatgatgcgcaaaagcctattgcgaaatggtcagaggcagagtgagattcagtcagggacattggaagctggagtagacagggttatttctcaggcagaggatccaaaattaaaccacatcctcaggccaccaacggaaggagcaagtcatgagttcctgggtgcccagaagacagcaatggtgccagcaccccctttagagcccgcagaccaggaccctccagctccagcctagggcggttctcaggaacatgcccaacgccttttgaaagctctatttaattatcggtgaagaagtgactttggttacataagagtgcaacttcagaatgaagataggccaaggtctcactgatttcaagatttcggccttgactgtgggcagtgtccaagtttgaatggggggcaagtttggcagtggggatgttgaccaatttgtcccctgcattgtgctgccatttggtcagcctgtccaaggatacaacacccggtagacactacagagagataaagaaacactatagtaacttgggattgtcctaaaacagacttttatacttgaacgtggagtctctgtgtggactttagagtttgtgctctggaatataccaaagctacagtttgagagaaagtaaccagtcccaaagataatttcaaagaacaataacaatataaagggtggctgggagtaggtatttgatggtgcttatttgatattgtttctcagagttgcaaactggaatgtagaaaccactagcatcagatatctagaaagttgttatgaccttcttgtacatgaatcttctagccagtttcctttcccttgtaagaggtaacaaaacatggaaccctaaaatgtgtgaggaagcttggacgttaggtataaagaaaaacatttgcagctgggcacagtggctcatgcctgtgatcccagcactttgggaggccaaggtaggtggattgcctgaggtcaggagtttgagaccagctggacaacatgatgaaactccatctcagctaaaaatacaaaaatcagcagggtgttatggcacgcgcctgtaatcccagctacagaggctgaggcaggagaatcacttgaacccaggaggcagaggttgcagtgagccgagatcacgccactgcactccagcctgggccacagagcaagattctgtctcaaaaaaacaaagaaaagcatttgcaggctctctgtctagggcctcttcctgtcctgcaagggctagtgagtctggggtgtgtttagtttattctcatgtttgtaatttttaagaaaagcgagatttataataaggccgggctgggtggctcacacctgtaatcccagcactttgggaggccaagagggggcagataacctgaggtcaggagttcaagaccagcctggccaacatggtgaatccccatctctactaaaaatacaaaaattagccgggcgtgttggcgcacccctgtaatccaactactcaggaggctgaggcaggagaatcgcttgaacccaggaagcggacgctacagtgagccaagatcatcccattgcactccagcctgggtaacaaagcaagactttgtatcaaaacaacaacaacaacaaaaaaaagatttataataaaatcaaataaaatttgatactctttttaaaaaaagaaatctcactcggaatttatcataagtaaatcattatggataagcaaaaatatatttttataaagatgtttatttaaatactatttatagtggttaaaattttgtagcactctagacgtccagcaaggttttatttgttttttgttgttgttgttgttcgttgtttgtttgttttgagatggagtctcatgctgtggcctggtctggagtgcagtggtgcaatcttagctcactgcaacctccacttcccaggttcaagctattctccagcctcagcctcccgagtagctgggactacaggcatgagccaccgcgtccggctaatttttgtatttttagtagagatggggtttcaccatgttgggcaggctgatctcaaactcctgacctcaggtcatccacctgcctcagcctcccaaagtgctgggattacaggcatgagccaccgtgcctaccctgtttgttaaataaattctactacatccagagaaatatttcattacatggaaacgttcatgatacactgttagattaaaaaagtatatcacaactcaacatgtaaagtataatcccatttgtatttatataactatatctatttttgtctatataactgttattgtaaatttagctacctattcgtgtatatatctatcattgagatcacacaaaacaaaaatagatatttccaaatattcatttcttaaaaatggaattattaagaaatatgttatatttcttctttctgttcactgttttctgaattttctacaattgacatatatcacttttggaatagtaaaacggttattctggccgggtgcagtggctcatgcctgtaaccctagcactttgggagaccaaggtaggaagatcccttgagcccaggagttcaagaccagcctgggcaacatagcaagaccccatctctacaaaaaaaagtggggagttattcttaacagctttttgttagttaagctaaaagcagagatacaaaaaatatagggcttacatatgatcgaagttggtttttttttttcctctccccaaattgtctatcggtgaagggcccagtgttacaatgaagctgtactccacaaagttactcaggggtcctgattttgtgctgctgttatctaggttggtgtcttttccacgtggtagaagctggctaacctccacttccacattccagcccaagggaaagtccaaggtaagtagatatttctttaagggggatgacctggaagttgcacacttcattttcactcaccattggcttgaacctagtcatgtgaccacatcagtcaagaaggcaggctgcgatctatagtctccagctgtcagccatgtacagttgtcccttggtatccatgggggattggttccaggatgctacctcagaaattaaaatgtgcaaatgctcaagttcattatataaaatggcatagtatttgcatataacctgtgcatacccacctgcatacttgtaatcatctttagattacttataatatctaatacaatgtgaatgctatataaatagttgttatactgtattattcagtacagatgcaactatagtaggcctaactacattttctatccacagttggttgaatctgcacatacagaacccatggaaacccagggccaactgtgtgtgtgtgtgtgtattcagctaaaatttagggggaaaggattattactaaagatgagtaggaatagtgagagatggactcattggactcttatttagatattaaaaatctaggctgggcgtggtggctcacgcctgtaatcccagtactttgggacgccaaggtgggcggatcacctgaggtcaggagtttgagaccagcctggccaacatggtgaaaaaccatctctactaaaaatacaacaattagatgggcgtgatggcaggtgcctgtaatcccatctactcaggaggctgaggcaggagaatctcttgaacctgggaggccaaggttgcattgagccgagatcgtgccattacactccagcttgggtgacaagagcaaaactccatctcaaaaaaaatttaaaaataaataaaaatgtacaatagttataatactgtgattctggcacaggaataaataaaaagattaggacaaccataaatacactggaattcatataagattaaagcatataagttaagatggaggaaaataaactcaataatgttgagagaattggaaaaccatttggaaaaaacaaagttagattaaatgacaaaattcattccacataaaaacttaactttctgtagggaaatatagatgaaaatggcaaccagattatgacccctgctttagttggtcccccattcgacagatttctggaccttattgagaataattatcttttccttgaccttcagcaaccagaactgcaaaccatacaccacatatagaagacaccacgcttgtattaggtcaggagaatgctttttatttttgtgtgtttgttggttagttggttggttagttggttttttctatcctttcttttgaagcagtcttttttatgttgatcttctttttgttgatcttctttattgatagataaaatgtacaaaactaataatccacataatgacttctaatttccatcactggactacccttggtgtgtatctgattctatatgctccatataaaaattagtctccaactcaacaagaaaaaagcaggctgggcacggtggctcacgcctgtaatcccagcactgtgggaggccaaggcgagtggatcacctgaggtcaggtgttcaagaccagcctggccaacatagcaaaacccctcctctactaaaaatacaaaaattagctgggcatggtggtgcctgcctgtaatcccagctactcaggaggctgaggcaggagaatcacttgaacccgggaggcagaggttgcactgaactgagatcgtgccattgcactccaacctgggtaacggggcaagactccgtctcaaaaaaaaaaaggaaaaagaaaaaaggaaaataacctgatttaaacacgggtttgtaatcatgtaaatgctcaattaaaatcaaacaagtggccaggcatggtggctcaagcctataattaaagcactttgggaggacaaggtgggtggatcacttgaggtcaggcagagtttgagaccatcctggccaacatgatgaaaccctatctctactaaacatacaaaaattagtcatgcttgatggtgggtgcctgtcatcccagctactcagaggaggctgaggcagaagaatcacttgaatccaggaggtggagtttgcagtgagccaagatcgcgccactgcactccagcctgggcaacagagtgagactccctctcaaaaaaaaaataatattaataaaaccaaacaagaaagaaaaagagtggaaaacaaaaaggaaacaaagaataagagcaatgaaataaaataaactacaattaaggtacatgttaatccaactatatcaatgatcactttaaatgtgaatgatctaaatacattaattaaaagacagagactatcagagtggataaaataacatcacccaactatacgttgtttacaagaaactcactttaaatatgcaggcacaggtgaaaagtaaaaggatgaatacagagatgccacactaacactaatcaaaagaaagctatggtagctatgttaatttcagacaaattatctcctgcaatatcttggaagacagttcacatgtcaggcccttagcccttagttctaggaggggtgtttaagaaatatcaatatttatgtattttgactgctttttgctgcttttagccaagttctgtaagactgatgaaccaaagcaagaattagccagttagaaagcagactagaatggaatacatttcctcacaggaggagtttgacagtgtgacttggttctaatcaatgggatgtgaggagaaattatatacagtcatgtacctcataacattttggtcaaagacagactacgtatatgatggtggtcccataagattataagggagctgaaaaattcctgttgccttgtgacgtcaaagctgtcctaactttgtggtgcaacacattattcacatgtttgtggtgatgctgatgctggtgtaaacaaatctactgtatttgatggtactagcacttgataataaatgaccaagttacctgtttatgagtttactatactatatatatacatttatatatagtatataaaatatatatatatttgagatggagtttgcgtcttactatactatatatatacatttatatatagtatataaaatatatatatatttgagatggagtttgcgtcttactatactatatatatacatttatatatatatagtatataaaatatatatatacacacatatttgagatggagtttgcatcttgttgccccaagctggagtgcaatggcttgatcttggctcaccgcaacttccacctcccaggttcaggtgattctcctgcctcagcctcctgagtagctgggattacaggcatgcaccaccaaacccagctaattttgtatttttagtagagacagggtttctccatactggccaggctgatctcgaactcccgacctcaggtgatccacccatctcggccgcctaaagtgttgggattacaggcgtgagccaccgcgcccatctatactatatttttaattgttattttagagtgtactctttctgtttaataaaaaaattaactgtaaagcaacctcaggcaggtccttcaggaggtattgcaaaagacggcattgttaccatggaagctgaacactccataagtgttattgccccaaagacctctcagtgggaaagatatacaggtgaaagacagggatattggccgggcacagtggctcacgcctgtaatcccagcactttgcgaggctgaggtgagcagatcacttgaggtcaggagttcgagactagcctggccaacatggtgaaaccccgtctctactaaaaatacaaaaattaattgggcgtggaggtggtcacctgtaatcctagctactcaggaggctgaggcaggagaatcgcttgaacctgggaggcggagattgcagtgagcagagatggcgccactgcactccagcctgggcgacagagtgagacaccgtaaaaaaaaaaaaaaaaaagacagtgatgttgatgatcctgaccctgtgtaggcctaggctaatgtgtgtgtttgtgtttcagtttttaacaaaaagtttaaaaagtaaaaaaaaaaaaaaaaaaaaaaaaatttgatagaaaaagcttatagaatatggacatgaagaacgaatacattttcatagagctgtacagtgtgcttgtttttaggcttagtgttgtgacaaagtcaaaaagtttttaaaaatttaaaactttataaaataaaaaagttatagtaaggtaaagttaatttattattgaagaaagaaattttaaaaaataaaatgtagccaaagtgtatatcatttataaagtctacaatagtgtacagtaatattttgtaggccttcccattcactcaccactcactcaccgactcactgaaagcaacattcagtcctgcaggctccattaatgttaagtgccctatataggtggcctttttttttttttttttttttttttttttttttttgagacagagtctggctctgtcgcccagtctggagtgcagtggcgtgatctccgctcactgcaagctccacctcctgggttcacaccattctcctgcctcagcctcctgagtagctgggactacaggcacccgccaccacgcccagctaattttttgtattttagtagagacggggtttcaccgtgttatccaggatggtctctatctcctgacctcatgatccacctgcctcggcctcccaaagcgctgggattgtaggcgtgagccaccgcgcccaggctttttttgtcttttatgccatatttttactatacatgttctaggtttagatagatcaatacttaccattgtgttgcaatcacctgcagtactcatatggttacatcactcctagtagcatagaagcaataggccataccataagcctaatgcatgtagtcggctctaagtttgtctgagtacacgcctaacacctgaagacacatttctcagaatgtctccccgtcgttgatgcatgacagtatatcacatattgtactattgaaaaaataggcatggctgggcgtggtggctcaggcctctaatcccaacactttgggaagctgtggcaggagggtcccttgagcccagagttctcaaccagcctgggcaacatagtgagaccccgtctctacaaaaaaaagttttaaggctgagcgcagtggctcacgcttgtaatcccagcactttgggaggccagggcgggcagatcacgaggtcaggacatcgagaccttcctggctaacacggcgaaaccccgtctctactaaaaaaatacaaaaaattagccgggcttggtgtcgggcgcctgtgatcccagctactcaggagctactgaggcaggagaatgtcgtgaacccaggaggcggagcttgcagtgagcagagatcgcgccactgccctccagcctgcacaacagagcgagactcccatctcaaaaaaaaaagagttttaaaaattagccgggtgtggtggtgcacacttgcaatcccagctactcgggagactaaggcaggaggatcactggagcccaggaggtcaaggctgcagtgagctatgatcacaccactgcactccagcctgggtgacagagcagtgctctgtctcaaaaacaacaaaacaaaaaaaggcacacctgccctcgtttcttcctctctttccagtggcctaaatgttgagaggtagagagaattaaagcagctatcttaaactaaagagggcagccacgatggagtgacaatacagaaggggtctgcgtcaccaacattgtggcgcttccgcagccctggagtgcttatgttcacactgtgacacagagacaagtcaaattctttcatgtttatttgggtctatgtgagagcaactcaagctgcgacctaattaatgtaggtttatgatcaagtacatatctcattgtattgtagctatttctctaattatgattattttattataagtaatcatcagtaataatatcagcaaagtaagttttttttgttgtttttttttaatgtcagatgggtaatgtgccaagatttgagggaggcatatctcacacgagagtgtgaaaacacaatcatcatgttattaactacaaaggatcacatgcagtcaagtttttactgtaatccatgggtgggaagttcagccacaccttgcaggatctgaaacaggaaatagagaagccatcagtaactgaggtcattctcatatcagcttctgcaaaccagatttctctcctgtgatattgtgaaatactacttggtcttctacccatttcctggcaagcaacttctaaaatccttggaatctccttgtgtgctaatgaattgacctttgggtgggtgggtaggggctactggatagccccaggatagtggttgccactggattagagggtaggaactttcagccccacccccagcctcggggaggagagagtagctgaagtttgagttattcaccaatggccaatgatgtaatcaatcatgcctacttaatgacccctccataaaacccccaaaggatagaagttggagagcttctgagttgcttaacccttggaggtgctgggagggtgatatgcctggagcgggcacagaagctctgcaccccttccccataccttgccctatgcatctcttccatctggctgttcatctgtatcctttctaatatcctttataataaacaggtaaacataagtaagtgtttcccaaaggtctgtgagctgctctagcaaattaatcaaacctgtggaagggccatgggaaccctgatgtatagccagttggtcagaagtattggtgacaacctactacttatgatgtctaaagtggggcagtcttgtgggactgaactctcaacccgtgaggtttgatgctaccttcaggtagatagtgtcagaattgaactgaattctagaggatgaaactgcctttgcaaaattatgacagcaagagaaatgtgacatggctaactccatcttgcttctatcctcacagactggctgtccttgctcatacctgggcataggccaagctaaccacgggagaaatttagtttatagtttacgtgatgatagccctttccaaaaactaaactacccttgtaaaactgatgaacatcatgaagttaggaggatgagaggggcctgaattctactaagatgtgggtgtagttaaataattaccagccattattccgaaagtcataagatttgcaacttccccaattaatcctgtaaataacatcactattgtagagtttaagattggccttttgggacgtcttttcaggcttttgcatttctaagtactggatggccccacccagaccagtgactcctctggtgggccccacccagaagccaactcagcatacaaggactgttttccacacccctatgattgcatccccagccaatccgcatggccccgtccctagcctcctgcctaccaaactatccttgaaaaacccctaacctccaggcatgctgggatattgatttgggtgatgactgtctcctgcgtggtgccagcatcgtgtcaactgaactctttcttgactgcaatgccatgggctcagtggattgggcctgtgcgggaagaacccatcaggcagttacgaggacatccaactggtgtgtgctggagaatctcttgcggaattgattgcttgcttggtgtgtcaggaaacccgcaccatccccctgccctgccctgcccccgccccatatttggtcacagcagcatcctacgttgtgagagtatagtaggagaaagtgtttttacatgtatccttttatctattttgtttggtatatggccatgtataagtgagcagtcccccaacttcgaatttcctgagacacactaagactttagccctaatctcaggcccagttctggctagggtccttttttttttttttttttttgagacagggtcttgctctgttgcccaggctggagtgcagtgacacaatcttggctcactgcaacgtcctcctcctgggctcaagtgattctcacacctcagcctcccaagttgctgggactacagatgcacatcaccacacctagctgatttttgtgttttgtatagagacagggtttcactgtgttgtctaggctggtctcaaactcctgacctccagcgatccgcctgcctctgcctcccaaagtgctggcattacaggcatgagtcactgcccctggcccagctagggtccacttattcagtcaacccatagactgataatggagaatgttctcagaaaagactggtgttagctgtacagataacctatgggcctaatatatgtctgtcttccatatttgtattttgtttgctaatactgtggagaaagaagcaggaattcccattcattgctagtggaaatgcaaattggtacaacccttgtgaagtagaatttggcaatatctaacaaagccacacgtttattttttgacataagaatcacacttttaggaagttgttctgaggatatagcttcaataatatgaaaatacatgtgaacaagattgttctttgcagcactatttagaattgcagtccaaatgccaaacatgagaaagtaattaaaccatggtacagccaagcagtggggtactatgcagcggtaaaaaagtaataaggatgatctctttttttttttttttttttttttggagacggagtttcactcttgtagcctaggctggagtgcaatggcatgatctcggctcactgcaacctccgcctcccgggttcaacctccacctcccgggttcaagcgattctcctgcctcagcctcccaaatagctgggattacaggcttgcgccaccatgcccggctaatttttgtatttttagtacagacggggtttcaccatgttggccaggctagcctcgaactcctgacctcaggcaatccacccgcctcggcctctcaaagtgctgggattacaggcgtgagccaccgcgcccagccaatgatctctataaactgatacggagtgatttccagaatacattctccctttttttttttttctttgagatgaagcctcactctgttgcccaggctagagtgcagaggcacaatttcgggacactgcaacctccaccccactaggttcaagtgattctcttcctcagcctcccgagtagctgggactacaggtgtgcgccaccacacgtggctaatttttgtatttttagtagagacggggtttcccaggttggctaggctggtctccaactcttgatctcaagtgatccgcctgcctcagcctcccagagtgctaggattacaggcgtgagccactgtgcctgagccagaatatattctttttttttttttttgagacggggtttccctctgtcacccaggctggagtgcagtgacgggctctcagtttactgcaacctccacctcccgggttcaagcaattctcctgcctcagccacccgagtaactgggattacaggcaactgccaccacacctggctaatttttatatttttagtggagacaggatttcgacatgttggccaggatggtctcgaactcttgactgcaggtgatccgcctgcctgggcctcccaaagggatgggattataggcgtgaaccaccacacccggcctcagaatatattcttaactgaataaaggaaaatgccaaaaacaatctatggctgccgttctcaaaacgtggtggccacacccctgggggtacctgaggcactttcaggtggcccatgaggttaaaactattttccaaataatgcattgtttgcctttttcactgtgctgacatttgcattgttgatgtggaacggatgcagataaaactgctagcccttcacaaatcaaggccatggcaagctctctccactgccacacactctgggggctggggggagggagagacagttttacttaagaatttccttgatgaagcaataaaaattggtaattttgtcagaacttgaccctgagttcacatctttttactattctgtgtgaccaaatgggaggttcacaggagcacttccgacgtgcatggcatatgatggtgatcttgtgcaacagtgtttctgcagttgtttgagttgcaagatgaggtagccattttttcatgaacatcatttttaattttttaattaaaattttttttttatttttaaaaattattttggccgggtatggtggcggctcatgcctgtaatcccagcactttaggaggctgaggcgggcagatcatgaggtcgggagatcgacaccatcctgaccaacatagcgaaaccccatctccactaaaatacaaaaagattatccgggcatggtggcacgcgcctgtagtcccagctgtttaggaggctgaggcgggagaatcacttgaattcaggaggtggaggttgcagtgagccaaaatcgcaccactgcactccagtttgggcgacagagcaagacttcatctcaaaaaaaaaaatgttattttataggtcaggcgcagtggctcacgcctgagatcctagcactttgggaggccaaggtgggcagattgcctgagctcaggagttcgagaacagcctgggcaacacggtgaaaccctgtctctactaaaatacagaattaaaaaataaaataagccgagcatggcggcgtgcccctgtagtcccagctactcaggaggctgaagcaggagaagtgcttgaacccaggaggcggaggttagagtgagccgagatcgcgccactgcactccagcctgggtgacagagccagactccgtctccaaaaaaaaaaaattattttatagagacgggccttgctctgttgcccagtgtagagtgtagtggtaggattatagctcactgcagcctcaaacttctgggctcaatcaattcttgtgcctcagcctcctgagtatttgagactacaggcacgtgccaccaggcccagctaattttgtaattttttttttgtagagactggagtctcgctttgtttgtccaggctggtcttgaacttcttgctcaaacaatcctcccaaagcattggaattacaggcatgagccaccatgctcagcctgtggaacaccatttcaaggtgaaaccggaaaggcaaactactgctagttggacatgggatttcacagttattttctcaactatgagtgaagtaagcctaacattccaagcaaaaaaaaaaatggatagtaaatgttgctaatggaaagattcaaaatttaaatttaaatttaatttggaaaatctctcatccgctaccatgggctttaccgaatcgagtcagagaagatagtaaatgaagtaacttcttttatgtacaatgaaatgtgtcaacatttggaagatgtatatacttcagtgaaccattattttccaagtgaccaaagcatgatgttacaaaatcacgcatggttaaaaaacacaatcaaagtacaagatagggcaatgcattttaatgttaacaccacaaaaaagtttgtgaatgtgatttcagaatccacattgcaactaacttctgagaaacaatcactattgtgttttagtgttgtcaaagaggaacaaacacaattacctgaaaaggctgaggctgggcacagtggcttgtgcctgtaatcccaacactttgggaggccaaggtgggtggatcacctgcggtcaggagttggagaccagcctagccaacatggcaaaaccccttctctactaaaaatacaaaaaattagccaggcgtggtggtgggcacctgtaatcccagatactcgggaggctgaggcaggagaattgcttgaaattgggaggcaggggttgcagtgagctgagatcgcaacattgcactccagctgggtgacagagtaagactgtctcaacaaaagagaaaagactgtgaaaatactcatcctttttccaactacatatctgtttgatgccaagttttctttagatgcttttaccaaaacaatgtatttcaagagattactagaggaatcagatatgagaatccaactgtcttctattaaaccaggcattaaagagatttgcagaaatataaaacaatgctatccttctttctatatttttatttgataaaatggagtttttattaataaaaatgtgaaatgttacttatattaacgtgtcatgaatttatattattattttacatgtatttaataaatgcgtatttttacaatttctcagttttggtttagttttgttttgttttttctttttttgagacgaagtcttgctctgtcacccaggctggggtgcagtggtgtgatattagttcactgcagcctccacctgacacaggctcaagcaatcctcccacctcagcctcctgagtagctgggactacaggcccatgccaccacacccggctaattttttttttttttttttttggtagagatagggtcttgccatgttgcccaggctgttatcaaacttctgagctcagcttatcctcctgcctcagcctcccaaaatgctgggattataggcacaagccactgcacccggctagttttagtgtctaatgcagtaaatataatagatatagtccacataaacaaaagctttttggctcttcagtagcttttaatagggtgaagaagtcctgagcctaaaacaatctgagacttactacttattgtataataacaaatatacacatgtctgtatgatctgaaatgaccgattccagggctggggcagggagaatacgatatgaacctggaacattttgttatgccagaaaataaaaaaaccctgaaggagtgatggaggtaagtcgaaaggataaggcacccaatttgaggagctcccactggccaaatccaagataatctgagcacagaaataaataataatagcaggtctggcgtggtggctcgcacctttaatcccagcacttcgggaggccgaggcaggcggataacctgaggtcaggagttcaagaccagcctgaccaacatagtgaaactccgtctctagtaaaaatataagaattagtcgggtgtagtggtgggtgccggtgatcccaactgttcatgaggctaaggcttgaacccgggaggtggaggtcgtagtgagcagagattgtgccattgcactccagtctgggcgacaggagcgagactgtgtctcaaaaaaaataaaaactaaaactaaaataaaataattaaatcataaataaataaataaataatagtaatggatttttaacctagtgaataaagtagggctccacaaatccatactgatacaaataagcaaacaaacaaatggagaaggaaaagcttttccacagagtagaaaaccaacaaataaatgtagaagaaacgatggatgataaaactaaagggtaaaagtttgaggaataggacatctatcttgtttcaaaatagggagaaatattaactttattattatttcagatggagaggcctggctgacaccaccttaaccaagtcatcaaagttaatcatcaaagttaacattaccagtaaggggacaagcccacattaaaatcacgtgccacctaataaaatgtactaagggccgggtgctgtggctcacgcctgtaatcccagctctttgggaggctgaggcaggcagatgatgaggtcaagagatcgagactatcctggccaacctggtgaaaccccatctctactaaaatacaaaaattagctgggcatggtggtacacacctgtagtcccagctacttgggaggctgaggcaggagaatggcttgaacccaggaggcggagattacagtgagccgagattgtgccattgcactccaacctgggcaacagaacaaaactgtcaaaaaaaaaaaaaaaaaaaaacactaagaaagctaaggaaggcgaaatatcaattttgtgatatatctgtccaaaatgcacagcctcaatctaatcatgaggaaacatgggactgccaaagtgagggatgtgctataaactaacaggactttactttcaaaaatgccaaggtcctgaacgacaaatacagaccattctacattaaaggagactaaagagatatgcttactcaatacagtgcgtgatcctacatcggatcttagtctgaaaatttttgctttcttataaaggacattatttgacaacaaaaaatatgagtatggtcagtatactaggtaatagcattatatcaatgttaatttcctaattttgataattgtaatacattctctggtgtataagagaatgtccttgttctcaggaagtacacactgaagtatttagggcacaaagggcaacatatctgcagtttactctcaaatgattcaggaataaaagacatatatgggaaacgattatatgtagtgtgtgcgcctgtgtttgtctatatggaaaataatggatcaaatctggggaatctggatggtgaagagtatatgagatttctttataccattcttcagacttttctttttttgtttgtttttttttttgagatggagtttcacacttgtttcccaggctggagtgcagtggtgtgatctcggctcaccacaacctccgccgcctgggttcaagcaattctcctgcctcagcctcccgagtagctgggattacaggcatgcgccaccaagcccggctaattttgtatttttagtagagacggggtttctccacgttggtcaggctggtctcgaactcccgacctcaggtcatccgcccggcttggcctcccaaagagctgggattactggcgtgagccactgcgcctggccttcttcttcttcttcttttttttttttgagactgattctgattctcactctgtcacccaggtttgagtgcagtggagcaatctcagctcactgcagcctccaccttctgggctcaagcactccttttgcttcagcctcccaagtagctaggattacaggcacatgccaccacgctgggctgatttttgtatttttggtagagacgggatttccccatgttggccaggctggtctccaactcctggcctcacgtgatccgcccgcctcagcctcccaaagtgctaggattacaggcgtcagccaccacgcctggcccttatgaattttctataaggctaaaatcactttaagattaaaaattacaagacgaaagtaatacaattctgatatattctataacatggccgaaggttgaagacactatgctaagtgaaataagccagacacagaaggacaaatattgtgattctacttttatgaaaaacctagaatagtcaaattcatggaggttaagacggaaagcctccatgttagaatgaactagaatacagaagagaagttactagggactgtggggaggagagaacgatgacttagtgtttaatgggtaaagaggttattttttattttagagacagggtcttgctccatcacccagtctggagtgctctggtttaataatagctcaatgtaaccttgaagaatttaagttttgccagatgaaaagagttctgaaaatggatagtcatgatggttgcacagccaagtgaatatacttaatgccactgaactgtatatttaaaattggtcaaaatggtatattttacgttgtgtagtatattgtaccacatatacaaaaaaagtaaatgagggttcacagtcccaggtttatactttaactacaatatcagcatgtcttccccagaactgattacaaaatgcagtttcattctataaaaacatttaaggaacagcctccttccctaccagagatcttgtaccatcttgccagtcgaagtgagaaacagcccatttaaataatagctatgggccaggtgcgctggctcatgcctataatctcagcactttgggaggctgaggcaggtggagcacttgaagtcagaagtttgagaccaccctggccaacatggtgaaaccacatctctactaaaaatacaaaaattagctgggccttgggccgggtgcggtggcttatgcctgtaatctcagcacactgggaggctgagatgggtggatcacctgaggtcaggagttcgagaccagcctgaccaacacgtagaaaccccgtctctactaaaaatacaaaattacccgggcgtggtggtgcatgcctgtaatcccagctacttgggaggctgaggcaggagaatcgcttaaacccaggagacagaggttgcggtgaggcaagatcatgccattgcactccagcctgggcaacaagagctaaactgcatctcaaaaaataaaaataaaaaaataaaaaaaattagccaggcgtggtggcatgcgcctgtaatcccagctactcgggaggctgaggcaggagaatcgcttgaacccaagaagcgcaggctgcagtgagctgagattgcaccactgcactccagtctgggcgacagagtgagactgtctcagaaaacgaaaataaataagtaaatatagttatgagcaggctcaggaggtaaacactacagtaattagacaacatcgaagacttcatgataacacttcccaagcatgtttggtgacccgtgaccctcaggaaccaagcattttgcaagttcttccctttcacaccctttgacctctgcaatgtgaacaggaaaaataaagccaagtaaaatagctgacttatacagtcttcattctggcatggacctggcctgaagtgggttcacttctcattaaggttactcattgcttttttacagtataagcaatggtaaagtgtctttcatgctttaagtgtctgtagtaatttgtatgtaagtgtcaaataccaaggcacagtcaatcttgtcttatttttaaaaacttaaagtaccaagtgaaaaactcatttccattttcaaaggcacaattaaatttcaggcttttaatcttttaaaaccctatatatatttttttttttgagatggagtcttgctctcttgcccaggctggagtgcagtggtgtgatctcggctcactgcaacctccgcctcccaggttcaagcgattctccttcctgcctcagcctcccaagtagctgggactgcaggcgcatgctgccacgtccggctaattttttgtattttagtagagatggggtttcaccggtgttgcccaggctggtctcgaactcctgagctcaggcaatccgcctgcctcggcctcccaaagtgctaggattacaggtgtgagccaccgctcccggccttaaaaccctattaaccagactctgtctctaattgattctggagaaaattgcaaacttcatcttcctcaactgttgccacatagtcatcatttcttatagaataaggcactgatcccatctcaatctagtaacttgacctcagtgtatcttttgaggtttcccttttgctattccttctgtagctgtcaagttagactcccaaactttagaataaatccccaataattgctcggccacagaatgtacgcattttcaaaactttgcatatgcattgatgagttgctctctcactagctgtgaacaaaaggtctccttttccccaaactagttggtaagggtttgtgataaaggaggactaaatatatatgtatatatatttagggacaaggtctcactctgtcacccaggctggagtgcagtggcatgatcatagttcataacagtctcgaactcctgggctcaaacgatcttcctgtctctctgccacctgagtttctgggattacaggcgtgagccagtgcacctggccttccttcgatttttgaaattcccaagctactcattttttctcttcctctgaacgcctgagcacgttcctcttttattctttgtttacttattttcacaccagcaaggttaatacttcacacatagtgagccctcaggaatatttgtcaatatttgtcaagtgagaatatcactatttcagcaactttttttattaacttaaaaaataatgcctattgctttttatgatgataaaagtaagacagtaccagctaattgcagaaaacttgcaaaaggctaaaaacagtgaagagccataatcccacaacttgggcataagcattatttacattttggctgacaaatagtcaaactttatccagcagatgaagctgaatcccagaagagaggcacaaaattttaatttgtgttttgctttgtttctgtgaacattcaaataatgtctggagtggatgtaggttagaatgtaaatctataggccccagattaaataaaagaagccctgaatgtagccgggcatggtggctcatgcctgtaattccagcactttgggaggctgaggcaggtggatcacctgaggtcaggagttcgagaccagcctggccaacgtggtgaaagcccgtctctactaaaaatacaaaaattagccggttgtggtgtcgcactcctgtagtcccagctacccaggaggctgaggcaggagaatctcttgaacccgggaagtggaggttccagtgagccaagatggtgccactgcactccagcctgggagatagagggagactcaaaaaaagagggctgggtttggtggctcacacctgtaattccagcactctgggaggccgaggtgggtggatcattccaggtcaggagttcaagaccagcctggccaacatggtgaaactccatctctactaaaaatacaaaaattagccaggcctggtggctcatgcctgtaatcccagctactcgggaggctgaggcacgagaatggcctgaccccaggaggcagaagttgcagtgagccgagattgcgccactgcactccaacctgggtgacagcgcaggactccatctcaaaaataataataataataaaataaaataaaccctcaattttatttacccagaaaaaagagtgccaactctttttgcacatcctccaaaccttctcaactgtatttttcaagaacaatcgatagttgacatgacttctctgtgtgtggaggtgtgcgagcatgggggatctgcattcttatcctgcagataatcaatgaggaatgagtgtaaacgttccattcctgtatacgttttcttgtttctagcttaggccacctgttaccagataaggatttcctagcagtaaattaattaaacctttacctatcttgaagtccaacaatacataatttatattatttttctcctggactaaaatttattttgcatttttaatgattaccatttgcaaaataataagtgatgtattttgggagtgggtgagggagaaatgggaacagaaagtgtatattgaagttatattagagagaaagcttttttctaaacagcaattttcgtatgaaaaacagaggttatttgttaattgtatttcaaagctacacggaagggcttgtatttctggctgggggtggtggttcaaagagatgcttcttggaaactcagcaaaatgatgacagaagtcaaagcacatatggttatagaatcactaatccccttggaaaatgcattttgtgatcagacaagaagtgacaagtggccgggcacggtggctcatgcctgtaatcccagcactttgggaggccaaggcaggcggatcacctgaggtcgggagttcgagaccagcctggccaacatggtgaaaccccatctctactaaaaatacaaaaattagccaggtgtggtggtgcacgcttgtaatcccagccacttgggagactgaggcaggagaatcgcttgaacccgggaggcagaggttgcagtgagccgagatcacgccattgaactccaacctgggtgacaagagcgaaagtccgtctcaaaaaaaaaaagtgacaagtgactaattaaatagaagttagtgtaggttgttgttgtattttttttccataaagaagctgatagaatcaatatatcattttattagttgaaagcgcagtgaacctaagtcaagcaatctagaccctgcttttgaaaaagttggtttagtttttaaaaccaaatgggattctcgtgaagcaaaaaatatttagtcacaaattacagatgtgtgacttgcagtgaagggtcatgtgtgcaagagttatgagagatgggagaagagagagaaggtgagggagggaggacaagcatgcagataagttacctgaaattctcctacttttttcaaacctaaaggtcagaatgttatgttttaaaactttgtaatatggctgtttgtgtttctatgtcaccatctggctgtgctggctaaaaacagctccatgttggatgtatcaagtccttctagacttcaccccccatcttccattcccatcatttcatacacacaaacacacacacacacacacacacacacacacacgagaaggaaatcattagccattactttttctaaaagttaattttgtctagtcaataaagtaaaacaatgttcctggagatctcaaagtgagatactgatttggtgaacatgtttcctgaaccaaaaaaaatcaaggcgcgtagtctgaccggtgcaaacagaagtggaaataaatatttgagagtaggactatccagaagagaagttttccttctgtgattggtctaaaataagctagtagaactaaaagcattaaagttccatctaaaaataaaatggaattgttctctctgacaagaagaaattgtataaacataggaatataaatagctagaaagaaaaagacaatagagcataattctgggactacttggccccattagtaaacaaatcatttagaccgaggaataaggagttactgatcaggcaagcaggatcattcactatgagagcttatccagaagacatatgatgtctggaatttgctttaaagtaatataggtgaagacgaagtgtgtaagggagaaggtgacactagatgggtcatgaattgatcattgttgaagctgggtgatggttctttggggatttattacactaggatctcctcactattggatatatttaaaattttccataatcaaaagtaaaaaaagcaaaacaaacaaaaacactctggacacaacagagtccttgtttctgaagtcacctcactattttaatttttttttttttttgagacggagtcttgctctattgcccaggttggagtacagtggcagatctcggctcaccgcaacctcctcccaggttcaagcgattctcctgcctcagccacccgattagctgggattactggcatgctccaccatgcttggctaattttgtatttttagtagagatgggatttctccattttggtcaggctggccttgaactcccaacctcaggtgattcgcccgcctcagcctcccaaagtgctgggattacaggcatgagccatcgtgcccagctctaaagatttttttaaaataaaatttattcaggactagtagacgtgtgtgaattgttgcctgtctcagggaaaggagaaaagaaaaataggaatggggccaggcgtggcacctcatgcctgtaatcccagcacttggggaagccaaggtgggcggatagattgagcccaggagttcaagaccagactgggcaacgtagtgaaacccggtctctaaaaaaaatacaaaaatcagccaggcgttgtcgtgggcgcctttggtcccagctattagggaggctgaggtgagagaatcacctgagcccaggaggtggaggttgcagtgagccaagatcgaaccactgcactccagcttgggcaacagaggaagaccctgtctcaaagaaaaaaaaaaaaaagtactgatttagacatttatttcacccttgaaaaggagctctactagtctactctgtaaccccgcactttgggaggctgaggagagcagatcccttgaggtcagaagtttgagaccaggctggccaacatggcaaaacccggtctctactaaaaatacaaaaattagccaaacatggtggttcatgcctgtattcctcattacttgggaggctgaggcaggagaatcgcttgaacctgggaggcagaggttgcaagtgagccgatatcgtgccactgcactccaacctgggtgacagagcaagactctttctccaaaaaaaaaaaaaaaattacctgcattaggattaacatttccagttttgcagatttggtcatccaaatccaaagccatttgggttggtaaatggtttgacagtatttgttcttatttcttgtaaaaggcaatgaatagttggctcccagagtgtcattaggggttattcacatttgctgatgattaaccactaatggctcttggactccagacactgacttcaacttaccactttccgccccgattagaaaggccttccccagtctaaacacaactgtgtcccatttcagatgcctgctcaggtttttatacaagatttgtgaaaaatctcctttaacacaaatgagaacgaaacgtaaatgtccgataattgggcattggtacataaattatatccatagttacaatggactattatttagttgttaaaaacggatgtaggctccctgagtcagtctaagattgggctggtgtcttcctctccacacttacatcactccaaaggtagtaactgttaatctttctacacttatccttccagaaaaatacaggcatacaaaaattttatgcaaaagggataatattgtagagttctatacctggcttttaaataaaacaacttaacatctattaataatctttccatgtcagttcagtctgatttactttattgttgtaatgacagaaaaacaaagttttcatgtccccccctccatgttttttggttatctggattcctttttaggtaaaatacaaatctacaggctgtccaactttttaaacacagagtttttcttttctacggtttgtataagcccttcatgaattaagtcaattgggcttatgcctgaatgtgctacaactatttttccaagtttcttagcttttgaaaattttatacaatttttccttaaacataaattctttctaagaaacaaagtacttataaacatttatatctcatcatttcttgattttgtgctctggttagaaaggccttccccactccaagatcatacatttactcatgctttcttctagaagtgtgtgtttcacccttggcactactgacattttgaacaggagaattcttggtgtgggggctgtggtgtgcgtggtagaatgttgggcagcatccctggtctctatccactagatgccagtagcaacacctcctctccagctgcagtcaccaaacatgtctcccgacattgtcaaatgttccctggaaggaaaaattgccacatacacaccctgctttgagaaccactattctagaatatacataggtgcattttaaattacttttacatttcattcagatgaattgtacttatgttaagggagtgaaatggagatttagctttatttttttaaccgaaggtagtcaattatcccaattcaatttatctctgatatgaaaagccacctttgccaaaatctaaatccccattatattctaatctgcctccttattgtttcttctttattatttctccagcataaaacttttacatttaaattatagacttcaaaatatgctttaatatttggaaggcttccccagtgttcccctataccagctcttctctttcagaatttccccagctgctgtgaggttttaatttcaatgaactgtggcattgtttcatcaattaaaaagaaaaagaaagccctgttggtattttaatgaaaatcactttgaatttaaagactgatttggggagaataaacatctttatataactttcactattggatcttgctagaaagaataagttgtcttttattttacttgtcttcctttatgtctctcagtagggttttaaagttttctttataaaacttgcagaaatttctgtcaattttattcctagatatttcatcattttattgctattataaatggctactctagagctttgggaagaagtaactgtgataaatggaaatgtggatgaattagccctttaatggaaagaaaaggaataagttaaaaactggtacagtattctgaaggtcttttataatataaatatagtacttagtccaatgatttttttttaaacaaatggggacacattgccttcttgcatttataatattagttcactgctttttgctctttgtcagatgagcttttaagctaatacaaaaataggctgtcccttacttatcattttaaaaagaaaagaaaaaagaatatacaaaaaaaatcaatacaatagaaaagttggcaaaagttatgaacaggattgtgcagtagctcaacttgtaatccaagcactttgggagactgagatgggaggatcccttgaaaccaaggagttcaagaccagcctgggcaacatagtgagaccgcatctctacttttattaaataaataaaaaatctttaaaaaataatgttatgaataagcaagaagaagaaataaaaatgactaatacatacacaaaaatgggctcaccctctcaaagaaatgtgaacaataaaaacatttggttccatttacttacctgggagatagacaaataggaaattgattgataatattcagcgttagtgagggcacaaagaaagagatctcacataactttggtgagattttaaataggtaagatcatttggaggcaatttggcaatatctatcaaaattctgaatgaaacacgttttgatgcagctattccacctcccagaaactcctacagatatgctcacagaagccccaaaagatctgcatacaaactaacattctgttgggcccagccggttcattatcagtatgccccagtacacaatcagaaggggctcttctaattggctgatgcgcgtattctatcagttgttaaatatttcaaatgtaattgcactatctttttgtgctgagttacacattggaaacaattaaatgctcattactaagaaaataaatgaaaaagcaaattgcagaatattagtattgtttagattattggctcatgggttatactggcaggataaattaattaactcccacagactacaacttcttcatctgtaaggtggggataataatactttttttttttttccagatagggtttcgctcttgtctcccagactggacaacagtggtgcaatatagctcactgcagccttgaacttccaggctctgcaggctctaactctgtgcactacaggtgtataccacgaagcccagccaatataatatgaaaataataataatgagaactttttttttgagatgtaatttcgttctgttacccaggctggagtgcaatggcgcaatctcggctcactccacctcccaggttcaagtgaattctcgtgcctcacgaattcacttgaaattcacttgaattcaccatggggtttcaccatgttggccaggctggtctcgaactcctgacctcagatgatctgcccgccttggcctcccaaagtgctgggattacagacatgagccactgtacctggccatgagtacttcttagggttgttttaagtagtaaataaaataaaagaaggaaagtatttgcatactgcctggcatgctgtatacaataaatgattgtattctttcttttttttttttttttgagacggagtctagctctttcacccaggctggactgcagtggcacgatctcggctcactgcaacctccacctcccgggttcaaacgattctcctgcctcagcctaccgagcagctgggactacaggcgcgtgccaccactgtgccaccatgcccagctaatttttgtatttttagtacagacgggtttcaccatatgggccaggctggtctcgaggtcctgacctcatgatccacctgcctcagcctcccaaaatgctgggattacaggcatgaaccattgcacccggcctgtattcttattttaaattattcttatagtctcactttcttttctttttttttttttttgtctttttaaaattttttaactttaatttacatttggtggtacatgtgaaggtttcttaaataagaaaacatgtcacagggtttgttgtacatattatttcatcatccagataagcccagtacccaaaatttctgctcctctccctcctcccaccctcctcactcaagtaaaccccagtgtctgatgtttccttctttgtgttcgtaagttcttatcatttagctcccatatagtctcactttcatgcattattcatttgataaatattgggtacctatgatgtgttaggcactgtattaagtacataaaggttttgtttgtttttgttttttgttgttgttgtttttgagacggagtctcactctgtcacccaggcttgagtacagtggtgcgatctcggttcacttaagtgcataaatatttaataatgaaaattttttaaaaataaaaaaacaaaacaaatttaaaaaaagatttaataatgaacatacatttgagtgggaggtcagagggaaaaaaccaagccaacagtcaagtaagcaaaataattgaaaactgtgatgttatggaagaaataaaggattgagctagatttgtggttctgaaccaggggtgatcctcctccccatggggatttctatccccatggaacatctgccaacatatggagacatctgtgtttgtcacagcttgggggaaggatgccactggcacacactggttagtgtccagggatgtcactaaatatcctacaatgcacaggacagccccacaagaaagaatgatccagccccaaacgtcaatagggctgtggttgagaactcctgagccacacgatggcagcggggctacctaatttaggtcaggtgatcagcgaagactcctctaagaagtaacatttaggcctagccttgactggtgagaaactgccagaggatcaacaagtggtgaaggaacatcccgggcagaggggacttgggaacaagtaacaatggaaaacccattgcctttgtgcataatatacaaatgcctaaatgaagaatggaagggggcagttaccaggtcggccatgtctcacttagtatattctctcttgcttgaattttcagaactttttttgtagttaaaaaatgagaagaaggccgggcgtagtggctcacgcctgtaatcccagcactttgggaggctgaggcgggcggatcatgaggtcaggatatcgagaccatcctggctaacatggtgaaaccctgtctctactaaaaacacaaaaaattagacgggcgtggtggcaggtgcctgtggtcccagctactcgggaggctgaggcaggagaatggcgtgaacccaggaggcagagcttgcagtgagccgagattgcgccactgcactccagcctgggtgacagagcaagactctgtctcaaaaaaaaaaaaaaaaaaaaaaaaaaaaaagagaagaaaagcaaaaaaaaaaaaaaaaaaaaaagcgcagacagattggaagagagcttcttgtaaaactggaggtagatttcagagcacaaccccccacagtgttcaggaggccctggcgtccctggcataatctgaggttagtttctgccctccacatccatctgaccttctgaaatgacaagatttcccagagaccacttgatttataatcagataatttatgttgggtacccagttttatgccttttaactttgttatatttggatgtgttaagtgatcttgactttttaaaaaaaataactaacatcactagtttgggcattaagtgagattaaataagtgtttcataaactgtaaagaataatacagacacagatgttgagaataaggagagtgaagcttgtgctcaaggaattatctttccgtttttttgtttttgtttttgagacagagtcttgctctgtcacccaggctggagtgcaatggcacgatctcagctttctgcaacctctgtctcccaggttcaagcaaccctcctgtctcagcctcccaagtagctgggactacagtcacacgccaccacgcccggctaatttttgtatttttagtagagatggggtttcaccatattggtcaggctggtctcaaactcctgacctcaggtgatccacccacctcggcctcccaaagtggtgggattacaggtgtgagccacagcgccctgcctatcttttcgttttatcccctggattccaaaactcatttaggtaaagagaagtgatgacttggctacagaggaaaaaggagggccgggaagggaagtgcaggctaggaaaagtgactaaaaacaaaagtagtagcaccagttacactattcatgcaaggaagctgaggagaattatcctgatggggctgataaaatcacctcaagatggctctaggccaccccaggttcttaagacaatggtcagctctttcttaagcagtccaagaccctctgacctgagatgtgactggatgattacagacctcttgtccagtgtttagagcctagctgtctgcatattttataaagatatctgccttccagagactggaagtgaaagagatccaatgactgggtgagtcaccctttctccacctagaacacagtccttgatggaactcatgctttatcaattgttgttgagtagaagaaacaaatacatcctccaatcttcacttggtggacctggcatcaaaaaataatcatattaagtgcgtttattagtacacttttctggcttatctgcctttccaagtttctatttgagttcttgcctttgaagggtttgcaggctgtgaaaagtaacttaactttttaacaactttctttgcttggccttgaggcagcttcagaagataagacgccaaaaggaactatgtgtgcctggagagaaaaaaaataatggtgaaaaacgtttatcagtagcctccgccagcaccaagcaacgcctcaattttactcaagcaatttcccaattcaagtaacattcatatgaatcagcaaataatatgtagcaaatttgaatctatatactttaaaaaaaaaaaaaaagcactggaaagaatcttaaaagtcattgaatccgttttatagcaaggccccgagactggaagggactgacagagctagaaatgaaacttgtttttccacctcgagaaaaacgaatcaacaaaaaataccctaagcaattgctggtatctgaagcccacttttttgaggctgttccctttgttacgttgcgctgaccctaggcactttcttcccagaatgcaccaagaatccgaaactccaaacaagtttgagatcagcgttggctggggggaggcagtgggggtgcatctacgggagcggttgggctgtaagctttcgctacatcacagaattgtgccagtgtttctctttggagtgcctcgccagctttaacaaccgtttggatatgacttgctcgggcaaaagttgtgcattggcccgatcaagcctgacttctagccaaggtgagttcacatctccgttttttcctccccctaattcgaaagaggctttcaattgtctccgcccctccccccttctcctggaaagtttgttttcaagctataaaccctttccaattctcggttcccatctcggttgcctgagaatcgcagtcattagccaagtccacttggacgaaagcaaagctacctttgtgtacataatgagagccaccgcgtggccaaggagaaccacggggaagagggaaacatttttgtctcgagctggctaaagcgggcggggggggaggtagggttaaaccgaccgaaggcgtgttttgtggagtggcttcgaaagcggccgaggcagccgaagccgctttcgaagttagcaaacaaagcgtctccccagtaaccgcccggttccagacgaggctcctgccactcaggccgcggagtcgcagcgtcgcccagcccccggctcctcctccctgcgtctctcctccctccgctcccggctccccagcggataggagccaccaatcccagccacagacaacccttcaaacgaaatagcgaggcggccccctctaacgggcggcgggggcgctggccccctccctgcgccacatctgtcccgcaccgggcgcagcagctgattcatctgcagccaggtccgggaaggaactgtgctcccggcagttgcagggcagcgtccgggcgggtggcttgtccccaggaccgcgctccccccgagccgttttaggtgtgtgttctcttctgtcccgagcagtcagcaaaccacagaagaaaaaaatcgtaaggttgctgccttcttagagagacgctttttttccctgttgattcattttagtcctgtaattggaaaaaccacccaggctttttaaactctggcctccacgcattctaggggcgggggtgtctttttttttttttttttttttgagggagggtggcaggctagctctagttcctgaaacagacgctccgaagtcgagttagttatcccttggccgtcttagtactcctcgggtttaatcttatttccacagagtttcttctgccgggatctccaccgaggttaccgaacaaaaacagcacagagcccagactggaggcagacccgggcgctgtctctgctaggcttatttacgtttagggcttttctttcctttttttaaagtgatgggggaagtctcattgtgtggcatgtgacagttcgtttgcttcaaaacaacaggacgtaaccacgcgaaaactagaaccagaggagggggcatgcgtttcttcaagtcagccaaacagcatctggtctttgaaagcgcaatttcatcaagaaactcctgttggatccctcctaactgtggaccaaaataagccaacaggaacgggtgtttacttaatggctagtttctgtttgaaatgggaggagggatcccctagcagggttccaatccgaagagtagacactgttgaccgaaacagacgagcaggcacggcgtggtcaccccttagctataaaagtggccgctgccggggttcggcgactcggggtgtcaggcggagtcttggtgaggcaggcgcgcgcccggccgtccccgggcagagacgtttaaagagcatgtgagcgtgacaagtgtctgtccgcaacgtgtcagatttcgaaactgccttgcaatccagtccggaactcgcagctttagcccgggggaacagacgttcgtttaggctgtgtctcatcattcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtgcgggggaggggcggaggagcggcggggcgggagggggacggggcgggcggctgggggcggaggcaggacctcctgtaccttccctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtaaggcggccgcgggctgcgcgcaccagaagacgcgagtccggggaaacgtgctggccgggccgcgccgcgcggagtcacttggtggacttttccgcccaggggctctcatgctggagtggcggccgtgctctttgttgaggctgcgtctgaaacggcagcggctgttttcctgctagacacaacacgaggggctgttgtggggcgagcctctccacgctgctggcacgttgtcaagaaacacgctcagcgccttgtttgtgcgcctgcaagtttcattgtctccgccgacaccccacgctcggcccagccgccgcgtggcttctcgctctttctcgcgtgctggggatatggggtccgagtagggaggacccagcccctcgtttttcccgatccggacccaggcggccggggccgcgggaccgccgcggctttgtctgaaagttccactcctaggctccccccgcccccgcccccgccgcccccctactcccagccgggccctagcactgttctttagggatgtggtgtttttacgatcgaaggaatgcgattctggaccccctcatcgccctcgggtgtaaacagctttggaaagctagacttttacaaatccccagtctctaaaagttttcccacgatgaattttggggcaggaggaagagttagcacccagggccagcagcttcaagcggcatgcagtcaaaatgcgtccaaatgtgacaagcaggcttggttgtaagtgcaaagagcaaggctgtcattgtttccacgaagtgttctggaagctttacaactaaaacttgccgtcagtttggtttaaaaacaaaatacaccggagggggacggggggtggagaaaccacacaaaacaccccgaaaggtcagagtgtgaagtcccttttgaagttaacaaaaattgagtccctggctgggaggtcccccgagtgttccgctgtgggctggaggtggcgtttctgtcgtgatttatgtggagtggttcaaaacagaagttaatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtgacgggctgaaggggaaactttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctgagcccggggtaagcttggtttgtgataatagtgtgtcctcccagaaagctgagagtgacgccaaaagatctcctaaaatgacttaaaaacaatgagaaggatcgataaggaaaatccactaagtctttttgctcccagtttttaactgttgaattcctgctttgggattgctctttggctggggtagccaaccataccttggatttggtggcttgagtgttcaatgcctgttgcttctcccaaggagatactgattttttttttcttttgttcctggagaccgggtctggctatgttgcccaggctggtctcgaactcctgggctcaagaaatcctctcgccttggcctcccaaagttctgggattacaggcaagagacattgctcccagctcaaaggagaacttctggtcaggaaacttgttgagttaaatttgctttttcctaattgtgcatctcgacttttcccatcaatcttatttctagagtctcttcacaaccggtgtctccctgcctccctgtctcatgatgttaccgagctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcaaaaaaaaaaaaaaaaaaaaaagaacgtgcaggaacaaggtcgctgcttagggcggtgggatcctcaggccatgttgtggctttctccacaacatttccttgtatgtggatagcgtgaaagaagcttgtgatcctgcccccaccctccccaccgccacattttttaaagtgtaagcaaagcaagacgtttggaaacaagtcttaaccgggaaacttttcaaaagcgctgttacaataggaaatgagtaaggaggaaaaaagtctttgtttttccaagctgagccacaactaggagggagagttttaatgaaaacagtcctgacagcagcaaacgtggttttactgcagtgaaatatcagctggcgtagccaaggcactgaagtcttaacttcctgttacttcagcttttgtgcacatattggaaatatttgttaagagttccagaggtctggcattcatttatttaaatgaactgagaacagagtaaagtcgcgctgcagtttggtgttgcttaactgaaacctgcttttgtgtgtcactaacctattctgaaagatcaggcttcttgtcaaactaggcaagcagatcaaagggcagccttcaggggctttttttgtttcaaactctttgtgattaccaacttacagttgggaattcactgttcaatgagcaaattttcacactttttctagattaaaaaaaggaaggagataatagccttgagaagaatgtctggcttttcagacgttggagagtttaaacaaattgctttattcaaatttgctttagtcatttaattaacttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagaggaatattccgtgtttatttcctgtcaaggggaactggctcaattaaggtcaagtcatattttcaaccaaaattacatactacagaggaaagaaagcatacaaagctaaaaatgcttacctttacatttttgttattttaattacttcccctaatatagaagtactgatttttttcaagcatgccattgtttgtaattcatttctgtttttaagattctagattgtctacaagcaaaagaatgtatttctttagtcattcggagtagcctgctgtagtttttgaaaggtggaattaatagcgtttgttatttaattttttttaagttcagaatgatgtttaaatatctgtaaaggccagttctggagctttattgaaccccgtccatctgtgatttaaatattctctatggcttgtgaattcttaaaatttctggcaggattaaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttcttt

SEQ ID NO: 36387 - DNA, 45675 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcaggtgagcccgcgtttgcccgcgctcccctcctccggggccgggagggcttttgtggggaaagaggaggccccgtgtccagttctgcccgggctctgcgcgtcacccccagcccaaaatactgccctgcagccaactcggatggaggcgttccggggtgacggctcccagcgcctacgaccccccactcagccactacccccacccacacacgtgttagggagagcgttggggtaactgaggccgtgggatgggggagagggcatcgctgacgcccccagcccaccctacggtagcctcgccggttgggggcggccctcccctcaacttgtgcctggggaggagcggtcaggggtcacccattgctaccctgaaagtgaaagtagtcaaactgaggctgtgagcacagatgagcccttgggtgtgggggcagcgggggaggatgcgccggcccctccccactccccattccgggccatgtggctaagagggtagcgccctgattcaggaagcccctctccccagttcctgcactgccgaggtcgaccgggccaggcccccgcatgctgctgaattgggcggttcaccagggctaggcgtcccagagacaggtttctggtattgatcctctcacacctcttgcctggggttccctgggaatcccccgaccaaaaaacgtctggagtgggtgttggtcttctagatccgcacggtagggatggtatttcagaggtctctgatgcctggtgcagaaatccccttccctcccttccctccctccggccaggggagctttgttttgagggagggggactgcatttgaggaactggagaggagggtctgcctgcctgtcccgcttctttttttctttagtttcctcattctcctgtttctcttccccattcccagccacaatgatgtaggtgaggaggtcactgcctgcagctgggggcctccagggaggggcacggccaggctgggctgagtgggaggaagtgaaatctggtggggggttcagagcagaggccccggcaaggcaatgtcggcaaggccagctttggtggcaggagggaccgagatctgacccgcagcccctcgccggggagatgacagttccctaacaccggctagcagccaggcctcagggcccctgccagggcagtgggcctgtgggtctccagggatgcaggcgcaggttgtgtctgggtttcccatcactgacctggctgcctgagtggaaacagctctggaggctcctcgggacctgccctcgtggagggagagccgtcagaggccacctgggcaggctgggctcggaggatgagagccagggcctactgggggaagttggaagggtttttagtgcacttttcctgagccttttcccactaccccctctgggagggaaaatccttctgagccaaagggtgagcattcctagaacttttgtgagtccctgtgggccacagagcggccagctgggaaggggctggctcagagcatcagcagctgggggctcagggtctgcaggggctcagcaggaagtggaggaggatagtgaggagggtcctggagactgtgctttgctactcctattgccttcgttcagctgaaggcgtgggcaagtgactctgccctcagtttccctctgtgtaaaatgggggagtaacaggtttgcagtggagatttaatgagccagtgtgtaatgagcacctgctgcctggcaaagagaggttcagttgcaggtggtggtggtggtagtggtgattttatcattgccttcattagtgttactgttattggctatgaggtgttccttcagtagtctcccttgagcatctcttgcatacatagcactggaatttcctgggtctttgggagcagaattttgaagatctgggcacttccttagctataaggccttgcttaactgccccacctcagtttcctcatctgtgaaatgggtgtgctaatagtacctacttcctagagtcatgggaaccatgaatgagtgaattcacagtgtccagagtggcttggtcaggaggaagagaagaagtagccttggggccggaatgatcttttttgttgtgggtgttagctctgctggctttctttcctcatccccccacccccacccccatgcctctcaaacctgggcctgatcctccttctccgataaatagaacttttgagtacaaatcagatcccacaggactgctgggcccttggatttctggctcccgctgtgccacccccagacattctccatatcccaggtggagcagagctggaggcacttggagggacctcctcgctgccagtctcagtgccacctgtctgtggtgaggggagaccgggtgccctccccagccaaggtggggagggtcagtgaagggggtctcagggacatagtagggagctgtcccacagtctgggccaatacagctccttttgctggaaacacctttgggacccagtttacatgaccccacacccttctgagggctggtgttcatgagggtctcccattgctggggatccttgggttgatcacttaagctctctgaggcaattgagacaacatctgtgaaaggctttaacagctgtgcacttgctgtgacatggcacataaggcactgagcgctgagcctggcactcaattaacaatagtagatattattgctattaataaaacaagaggcttttcctgctaaattcccacttctccctggtagcagtatggactttggggccaaatctgggctctgccagcttccaggtgtgaggtcctaggcaggttacctggcttctctgatctggacctcgcctgcccgatggaagccaagagttccagcctccccagggttgggtgtgtgaagtacagtgtcaggactggaactgtgttggctgtacttgctctggctgtgtgatcttgggctggtcccttagcctctctgagccacaggtctttttgtctatgaaataggggggttgccaactccctgttagggtggttttgagaaaaggaggcatgcacagtgcccggcatgcaattggcactcaataagtgcaagccattgctgttcatgcccaataggggctggcacttaattgccaggtttcctgggaaaacggtccccaagggcccgcgggcgttcagcatctttgacgaggcagggcaggaagccgctgccgtctggcagaccggagacgcctgcctcggcgagtccagaggtgcagtgctagctgctcattccctgcaaggccccattcctcactacccacccttcccaaggaaactgaggcgggcaggctgcccaggggaagtgactcagccggggtcacttgctgagtcaggccttattggacccaggagtcctgcaccccacctccccagcttcccggggcttgagatcccttggagactgagcaggtcctgaggcctggcagcaggaccaggccaccactggacatctgctcaatggggccctgctgccggggtgacaagcatccctctaccagggctccagggttctgctggccaccactagccatccttcctcccagcaggggcagaggacacttccccaggggaacaggtcctcctggtgcccccccactccccgccccagccggaaacccggcagctgagcagttagatagaagatttttcctcccacgccaccctgtcaggggtcggccagcagggccgggccacaggcttccttgtgagccaggcctggagcccctgggggcccacccggatgtggctaccccccggctggccagtggggagccggctgctgcccaggacatgtgtccccagggaggcctgggaggaaggaagtctatgccctcctcacaggggctgactcacaggcgcccaatggggggccccagctgggagactgggaatgtgatcaatcagggaggtggacacacaaggggacctctgacatgggatctgccctttcagagctcacacactggtgtcatctcaaggaggagaggcccagagagggcagtgtatgctgcgagaggcgaggtaattgagggcttacgcatgtccctcctgatgtccccaagtagcacgtggggaggaggttcacccacaggctgccctcctagggtctcccctgtctgccctcaacccagaggcagtgaaaggaagaagccacggccttgggatggggggcgtgcgggattctgatggtgctgcctctccgcagggagatggttcttggctttccctacctcctgaaacctagctggggcggtggctgggatgtcaggctggcggtgtgggcagaggaagccagaggacatttcctgttctggcagactgtgctggcctgataaatgtccccggggcacaaggtgaccccagcaagggtgcatcagtgtccagccagctgccccgtggcctggggtagaacccacctctctgcctccccagggaccctgccttcgccccctgcttcccgtgggcatctctgcgtctggcaacttgaatgctgtgaaagggcagcaggccgcctgccaggcagtgtgtgtcagaatcccacaactctctgggcctccttaggccacagggtctggactctatgaacagttggtgctaggcatggggaagatagaaatgttccttgtggcctagattcaaccaggaggcctccctggaggaagtgtcccctctgaaggtgtgagacttcctgcctatatctgtgagctggggcaggggagagtggaggctctggactggcccaatttaacttcatttaccacactttaagaaatcttccccaggctgggagcagtggttcacacttgtaatcccagcactttggaaggtcaaggtgggaggatcacttgagcccaggagtttgaaaccagcctgggcagcatagtgagaccctgtctctaccaaaaaaaaaaaaaaaaaactgggtatggtggcacatggctgtggtcccagatacttggaaggactgcttaaacccacaaggtcatggttgcagtgagctgtgatcatgccactacactccagcctgggtgacagtcagacctgtctcaaagaaagaaaaaaaaaaaaaaatcctccccaagcctcagcaggggaattcctaccatggataaaggctttctctgcatgtgggcctgatcattaaaaggaaaatttcagcctcccgaattatactattatccagggtgattagatagaggagaggctgagaagccctgatctcagcggggcatggattaaggggaccccacagctcagccaggttcccagcgattcaaggtcctgcgatttctcaccgacttggtggctccagggtgcctggggctggctgtgcttcttggggagcaccaggtaccactgctgcttcgaggccctcaatagccctttggtggacccggttgtgttctgagcttggggtcctgagatgcagacaccccccagccccagctggtgggcgtgcagctagctgccttcatgtatttgctgcagggagggaattgggggtgggggacaaggatgcaccaggctgagttattccttctgcacatcatcctgcccctcacctggctgcaggatttggggaaaccctggagacccccatagctgggaggttcctgccccagaaggaagcctgagcaggtgaggggggtctcctgggtgctagggcccctctgtggggaaggtggtttatttctctggctgaccaggctcccccgaagctctgtgctgggatagaagtgtcccaaagacaccctgcccccaactcataccctacagtcgaagcctgagggccccaggtccccctggcgtgatcatcattgcttcctgtccacagcttgtcagcccctgatcccagggttgtcaccatctgatcaattgctttttctctgagcctggcacatagtaagcactcaataaacgccactgcctgggccagggtcagggagggatccaccttcctgtggcctggctgccctcctggccaaaaaacctccctggtacagtcccttccatagcttgggctacagctgactgctctgggctggcaacttcctgcccggagcagcctgagcagccgcctctcccctgagaagatcttttgttccagctccccatgacgccccgagcccagcccatgaggcaggcccccctgtggcttcccatggcgggcgagcctgactccgaggctggagctcttttctaacagtgatagtaagaaaatagcagcagccacttatgagccccatgccaagcacactgcagacatcagttctttttttcttatagagatatggtctgcttctgtcactcaggctggagtgcagtggtgtgatcacagctcactgcagcctcgacctcctgggctcaagcagtcttcccgcctcagcctcctgagtagctgggactacaggcccagccaccatgccaggctaatttttttgtatttatagtagacatagggtttcatcatgttgcccagcttggtctcgaactctggggctcaagcaatcctcccgccttggcctcccgaggtattgagattataggtgtgagccactgagcccagcctctcatttttgttttcttccttttgccctgtgacagttttcctgatcattggtgggtttgggacctggacagagctactgccgactcctgactccagctggagctgaatgagacttttatattctctcctctgggactcactcattcatccaataagcattcattgggaagtgagcccttcttgtgtgcatttaggcactgatcagacattttgggggtcccttctgtgtgggggtctctataatcactagctatggggccgctctgtttcagcttccccatctgtaaaatggaagtaatcgttggacctacctcctagggctgttaggaaccttggaagaggtaatattttgtaaaagtagttagaaaaatgcctgatatgatcttggcatggtgccatgagcctgtagttacagctactctggaggctgaggcaggaggatctcttgagcccaggagttcgaggcagcagtgagctatgattgtgccactgcactccagcctggaagacagagtgagaccctgtctctaaaaagagaaagaaaaatgtctgatgtgtagcagacgctcagtaaatgccattgttcttatgggaggactggtggaaggggcccaatgaggggggttcccagccgttgcctgggcagtgagggacctggagtgggcgcagctgttttgaggaaggctcctgccagggtttggccctgcagttgggcttcaagactctgacatacaggactgtgcggaaggtaggacggcccagggggcgggggaggttggttcatgctggttgccacgcatctgccgggagagcaagagtttgcaaatccaactgatctcttgcattcatatgttcattcattcaagaggcattcattgagctcctgctgtatgctaggagctggagatgaagcagggaatgactcatggaactcagtctgttggagagatagtcactaataaaagcatcctgtcaagtgataatgtgtgaccagtgtgctgaaggtcaagttcagttgggagctcagaagaggcttctcttatgtgcaattggaagcagacagggcagagggaatggctcatgccaacacccacaggcagctggcgtgactagcggcagatcgtgtaggtggggcaggagcctgggtctggaatcacagctctctgggcatcctccaagccacgagggcagcgcctgtctcacctgtgtcaaggctgggtgtggggaacagtaggattgaccaagaacaggtgcccttatgcaggggttagaccctccccccttcagggacaggaagaacatggtggccaagggcagatgtggcccctccctctcccttcccatctgcctgacagcttttagtgactacttactgtgtgcaaagtacctactgtgtgcgggtcccaaggaccctgtgatgtacaaaactgtcgactgtagcagggcacggtggctcatgcctgtaatcccagcactttgggaggccaaggtgggagggctgcttgagcccaggagtttgagaccagcctaggcaacatagtgagaccccatctctacaaaaaatacaaaaattaaccaggtgtcgtggtgtgtgcctgtagtcttagcactttgggaggccaagatgaggatagcttgagcctgggaggtctaggctgcggtgagccatgattatgccactgcactccagcctgggtgacagaacaagaccctgtctcaaaaaaaaaaaaaaacattgtcgactctgcatggcccccttccatcgagggcagaggcacctacttgtgctttttggggtttcttgtggagatcggctgtgggggttccaccatggcctcatgtgacaggggcaccctttgttgccactgccctgcagacatgcccagcgggacatggccacatgcagagacggtgcctgtggaggggtgtgtggcagagagaaccccatttgtaggttcgcatctccaccttgcattccctttcatgggttccttacaaggtggatgccatgctgccacctggttggcagatgaggaaatccaggttcagagaggttgagtcaggcatcaggagccacacagccaatacgtgtccccctttgtaatgtgagccctgggagagcagtgttcgtctgtgctgttcaccgtggtatctcagggcctagcctggtgtctggcacacagtaggccctcagtaacacctgaagagaggatgaaggagggcgtgattggaggcagcaaatgtacccaggcccctgtggctctgtagcttgtgttgtgcagccactacccctgcccagggagggagtcactggagtggcactgctgttcattcagggtgtgctgatatcagggatctggggcccagttttgtgcctgagtagggagagcatttcttctccatcttgaagagcgacatggatatgtggtctccagcaggggcccaggcccagcgagggtcaggaggaaggaaggatggtgcccacagaggtcccaactgttctgcaccgtggacagcagaggggtggggggtctcagtgccattctggtgatgttgtgcctaaggaaaggccctctggccatgggaggagaaggatgccccagttgagatgggcaggcaaaggtctgctagtcctgagggtcccctgtcagtgcaggaaatccctctggacccccgtgacttttgttaatttattcctttttattttttgttttatatttatttttgtttttgtttttgtgtgtgtgattttttttttttttttttccaggacagagtctcgctctgtcacccaggctggaatgcagtggcatgatctcagctcgttgcaacctctgcctcccaggttcaagtgattctcctgcctcaccctcccgagtagctggcattacaggcacacaccaccacacccagctaatttttgtatttttagtagaggcgaggtttcaccatgttggccaggctggtttcgaattcctgacctcaggtgatccacccacctaagcctcccagagtgctgggattacaggtatgagcagctgcccccggcccatttatttatgtatttatttatttatttatttatttagagacggagtctcgctctgttgcccaggctggagtccagtggcgtgatctcggctcactgcaagctccgcctcccgggttcatgccattctcctgcctcagcctccccagtagctgggactacaggtgcctgccaccaccccccgctaatttttttgtatttttactagagatggggtttcaccgtgttagccaggatagtcttgatctcctgacctcgtgatctgcctgcctcggcctcccaaagtgctgggattacaggcgtgagccaccgtgcccggccctatgtttattttttagacaccaataatatactctcaccgcaacatggaaataacaacaatgtcagccagtctttatgaagcattttctacgttctagggctttacagctatcaattcatgctcataatatgcctatgaagtaggcatgatcatggttcccctcttacagatggagaaactgaggtagagagtaatcatgtaagtcacttaaggtcccataactaataagttgttgctggttttttttttgtttttttgttttttgttttgagacggggtcttgctctatcacccaggctggagtgcagtggcaccatctcagctcactgcaacctccacctcctggattcaagcatttctcctgccccagcctcccaagtagctgggactacaggcgcccgccaccacagccggctaatttttgtatttttagtagagatggggtttcaccacgttggccaggctggtctctaactcctgacctcaagtaatccacctgcctcggcctcccagagtgctgggattacaggcatgagccaccgcgcgtggctggtgctgggatttgaacccacattccagaatctgtgttcttagccatccttgctagagataagcagtaacaggcttcttggttacttccccaccatccccacatcccaattctgattcctccccagaggtacccactgtttcaggatgagtttgcttctgccagacctttcttgcccaccatttacaaaatgtttgtgtacacataaacattagtagtttggttttatgtatgttcatgtaaatgggattgtctagggtgtcttgttctgccgtttgctttttcgcttagtgaatagccctggagctctcccagaggtggtggggtgggtcttcctcactctttccccctgatgcagtcttccagcctatagatgggccagattctttcactagtctccagctggtgggcatttaggttgtttctagtttttccccattataaacgttttagcaggaaatatgtagcagggagcaagtatttctcttgaatacttaaaagtgggattcctagagcctgattgctctggctaggactgtcagtactgtgttaaatagaagtgaccagagtgggcatccttttctcatccctggccttaaaggaaaagttgtcaacttttcaccattaagtacaatgttaactgtgtgcttgtcatatagggcctttattttatttatttatttatttatttatttattttttgagacagagtcattctgttgcctgggctggcgttcaatggctgatcatggcttactgcagccttgacttcctcaggctcccaagtagttaggactacaggtgcacgtgctgcaatgccaactcatttttgtgttggtttttttggagagatgggctttcaccatgttgcccaggctggtctcaaactcctgggctcaagtgatcctcctgcctcagcctcccaaagtgctgggattacaggcctgagcctccgacctcagcctttatatagggccttcagtgtgttgaggtacaacataccatctatgcttaatttgttgaaaatttttatcataaagatatgttgaattttgtcaaatactctctctgcatctatcgaaatgatcatatggtttttgtacttcaaaagcaggattccagagtctagaatcaattctgccaaattggccatgccccttacagaatgccacttggtaggggagtgcatgtttccctgcatcttcaccagcactgggtgttatggtcgcgttggatttctgctgtggtgcccggtgtgtaatggggcctacacctgcttgcccacctgcttactccttgtcgcccccccacccacgtgtctttcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaaggtaagtaagccctgcccgcggggttgcgcactgcactgcgcccttcgccttcaccctggggagagcgcgggctggggaggtgtgatggctttccagctggtggccacagagtgtccagagggaactaggccctcttaaaaaagaacttttaggccgagtgcaatggcttatgcctgtaatcccagcactttgggaggccgaggcaggaggatcgcttgagcccaggacttcgagaccagcttgggcaacttagcgagaccctatctctataaaaaattagccaggtgtggtggtacgtgcctgtggtcccagctgttcgggagactgagaagggaggatgacttgagcccaggaggtggaggctacagtgagccgtgatcatgccaacacactccaggcctgggtgacggagtaagaccctgtctctaaataaatacaataaaaaagaactttttattttagaattttagatttacaggccaggtgcagtgggtcacgcctgtaaccccagcactttgggaggccaaggtgggcagatcatttgaggccaggggttcaagaccagtctggccaacatagtgaaaccctgtctctactaaaaatataaaaaattagctgagcacagtggcgcacgcctgtaatcccggctacttgggaggctgagtcaggagaatcacttgaacctgggagggaaagttacagtgaactaagattgcaccactgtattccagccttggtgacagagtgagactctgtctcaaaaaaaaaaaaaatgtttagacttacaggaaagttgcaaagatagtagtgttcctttacacatggtacccagcttcaccgaaggttcacatcttacgctgctgtgtacattggttgtagctaaggaaccagcacgggtacatcactattagctaaacgccactgttcctttggctttgccagttttcctctaatgtcccttttctgttccagctcgccccccaggataccacatgaggtttagtcgttacgtctccttaggcgcctcttggctgtaacagtttccaaccctctattgctgatagccttggcagttttgaggagtaccagtcaaggattttgtacaatgtccagggacacctttttgccttcacatttgggtgtcatgtgggctggtagcaggtcactctgagatccttgaaaactctgactcagactggcattgacagattggtgttttatttccagagggctcaaaaccttcagagaatttctctgcacctcctgtgccttggtgatattttgcaagttaaaaagaatttgtcctttggcaaaaccccattgctacaaaaaataccaaaattagctgggcgtggtggtgtacgcctgtggtcccagctactctggaggctatggtgggaagatcgcttgagcccagaagaccaaggctgcagtaagccaagatcgcaccacagcactacagcctgggtgacagagcgagaccctgtctcaaaaaaaaaaaaaaaaaaaaaaaagttcttttccttcacagctggcttaattcctactgtgctgttgaggctgaaaggtcactgtgttctactcacctgccaggctccatctttgactcaggtatgcatgacaggaccatatggctttcatctaattgctctctctttgggatcctgttacgtggtagggccttactctagagcatgagcaaaaccgatgtgatactggccctgaggggctcacgatgtgggtggaggaaacctatggttactctttcattcattcgacagatatttatggagcacctactatgtgttaggcacatgctaggttctgggggaccaggcgggcctagtggaggctgttgaggaaataaacccacagatgagcatggaattaaaaatggtaaattgtgttctaaaactggtaaactgtgttctaaaggaaaagcaatggggtctctgggaggataactgaggggtcccggtttggcggtttgggagagtcatccaagaatcctttgaagtaacgttttcaaactgactgtggcgtaacatgcagacctggaagtgcgtgaagtatgagacacatctgaagctctgtgtttccgtgtgtgtgcaacgcaagtgaccagcaccccagagggctccttcatgcctcccccaggccagtgccctgtacccccatacataccacctcttatcaccacaggttcgatttctctgttcttgaacatcatgtgaatggaatcacacagtaggttgcctttgttttattttattattttattttgagacagggtctcactgtgtcacctaggctggagtgcagtggtgtgatcatggctcgctgtagcctcaacctcccagcctcaggttatttttgtgcctcagcctccccagtagctgggatcaccgtcacgtgccaccactcccagctaataaataggttgccttttatttctggctccttttgcccagcataatgttttagagattgatcacattgatcgtacatgtcaatagtgtcttccttttttttttttttttttttttttttgagacaaggtctcgctctgtcacccagctggagtgcagtggctcgatctcagcttactgcatcctctgcctcttgtcctcctgggctcaagcagtcctcccacctcagcctcccgagtaactgggaccacaggcacgtgccaccacacctggctaatttttgtattttttgtggagatgggatttcaccatgttgtcaaggctggtctcgaactcctgggctcaaatggtccccccacttcggcctcccaaagtgctatgattactggcatgagccaccacgcccagccgggtttgtttcttttgagtactgaatagattccattgcacagctgtctccatgtcccacaactggtttatcccatcctctgttgatgaatatttgggttgtttctattttgatttatgaataaggctgttatgaagtttgcatctaagtctaaatatggacacacatcctttcatttctctcaggtggattcctagaagtggcattgctcagtcatagagtaggtacatgtttactttagagaaattgccagacttttcccaaagcagctgcaccattttgtgtcccaccggcagtgggcgagagttccgggtggttccacttccccaccaacacttgagcacttggtgggtttttttgtgttttgttttgtttttgttttgagacggagtctcgctctgttgcccaggctggagtgcagaggcacaatctcggctcactgcaacctccgtctcctgggttcaagctgattctcctgccttagcctcccaaatagctgggattataggcgcgtgccaccacacccagctgatttttgtatttttagtagaaatggggtttcaccatgttagccaggcacttggtgttaagagtcaccggtggctgcgttcctggatctcaaggtggctttactttgcgtttccctgatgactcatggaggttaagcaccttttcatatgttgattggtcatcggaatttggtcgtttgtgaagtacatgtttttattgtctgtctagccttttttaaattgatttgtaaaagtcgttatatattttggacaatttctttgcgttttaaaagtcatttcctacctttatggcctggcttttcatgaaaagcagttttgttttttttttttcttgagatggagtctcactctgttgcccaggctggagtgcagtggcgcaatctcggctcactgcaacctctgcctcctgggttcaagtgattctcctgcctcagcctcccgagtagctgggattacaggcgcatgctaccacgcctggctaattttttgtatttttagtagagatgggttttcgccatgttggccaggctggtcttgaactcctgacctcgtgatccacctgcctcagcctcccaaagtactgggattacaggcgtgagctacctcacctggcctcaatttttgtatttttagtagagatggggtttcaccatgttggccaggctggtcttgaactcctgacctcaggtgatctgtccgcctcggcctcccaaagtgctgggattacaggtgcgagccaccacgcctggccaggaggtcacttactttcattctaagtaaatcactgggccttccaggcagagggaacagcatgggcagagaccctgagtggggaatgtgtttagcatgttttgaagaaaggacaagatgaagaggccggtgtggtgggagcagagagagggagatggggagcggggaagtacatgtgggtggaggacactgggaacgggaggacttagtgttttattccaagcacaatcagaagctgttgggaaaacgcaagcacagataaaaaacggttttctcatcatttgttaaaaatctcaaggctgtgacaccatgaaagacaaataacggccccaatacatgatcttatctgtgtgacactgtagggtttttatttttttattttttatttttttgagacagagtcttgctctgttgcccaggctggagtgcagtggcacggtgtcagctcactgccagctccgcctcccgggttcatgccattctcctgcctcagcctcccgggtagctgggactacaggtgcccgccaccacacctggctaatttttttgtatttttagtagagatggggtttcaccgtgttagcccggatggtttcgatctcctgacctcgttatctgcccgcctcagcctcccaaagtgccgggattacaggcgtgagccactgcgcccgtccagggttcttaactttgaaaaacaacctcagtggctgggcgcagtggctcatgccagtaatcccagcacttagggagaccaaggcagattacctgagattgggagttcgagaccagcctggccaacatggtgaaaccccatctctactaaaaaatatcttggtggccaagcgtgtggctcatgcctataatcccagcactttgggaggctgaggcaggtggatcacctgaggtcaggagctcgagaccagcctgaccaacatggtgaaaccccgtctctactgaaaatacaaaatcagcctggtgtggtggcacatgcctgtaatcccagctactacggaggctgaggcaggagaatcacttgaacccaggaggcggaggttgcagtgagctgagatcgtgctactgcactctagcctgggtgacaagagcgaaactccatctcaaaaaaaataagtgaatatataaaaaataaaaataatcttggaagaccaggtgttgggagccagctggccctgggtttgaataatgaataagctgctttctcagctctggggcaagtggtatcacctttctgagactcagtttccccctctgtacattggggagtactcatagttcctaccccatagggctgtgtgtcttggtggggagagcgcatgtgccacgtgcctggcgctgggagcactccatgagtgctgtgttgctgttgccacggttgttgtggtttgttatggttttgacttcgggcggagagcccaggtttatttccagtgcttgctgggccctcaggggaaggcatccccaagactcctgttctctgggagccctgatggtagggccccatcagattccctagggcttttcccaatccagggaaccagggaggtcccagagggctttgccgtagccctggctggctggggctctgtcacaggcttggtggttgctgcggggcctggggtgttgcctgcaaagcaagcagccctggggaggcttctcctagcccctcggagcatcaggtggaacagtccgggcggctcaggagcatcccctcagtgaatctgtgtccaggtgatgggccaagggtgctcagaccacaactcttgcatgtgcttgccaggtagtcaactgtgatccctgacctctgacccaggggttggctctgggaacagttttaaacaaaaggaaaagaaagttctgacaaccagtgggtggtggcgaagggcttaagctttggatctgcacttgcggtctgtcacttaaagggtgccctgcaggagagggagcagatgtaatcccagtgccagcctggtggaggccctgctgcccagggctggaagaggctttggagggagagagccaagagaaggcagctgcccagaagtctgaggccaggtgggctcagcccacaggtgagcctcacctgcagttgggccccagctctgcccccgacctgctgtgtgaccgcgggcctgtggagcagggtgatggtgtagcacctccaggggcactatgagggctgcgctgggagagagcactctgtgactgggggtgtgcaaggggaggccacagtctgccaggggtgggggtgtgggtggaggagatgtctgtgttttccaaggtcaggagaaggggagaaaagtcccagctttctctggtctcagtggccactgcaggtgggcagcgtgggcccttgggaggtgggagggggctgccttccctggggttggtcagcaaaggcctcttggcaggaggtgccggtcctgatagatctgggtgaaggagtcccaggctgaggaatggcaggttcacaagccctgcagtgagcgtgaaccaggcaagtctgtggaatagccaggcagcctggggttcgagggaacagggaaaggtgagactacaaaggtagtggagctggattgcagaggcccttgtgggccacagtggggactttaggttttacattaagagcagtgggaacaattggaggatttaggcctagagggcctgagacacttgctggggccacctgcgggtgggagtgggtgcaagggaccctccaggctacctgtggtctcccagctcaggcccgcgatgggagagtatgacatgatttcctctagagacctccttcccctgggcaccgctgagccccaggcagggcaaggacaggggagcagtgtgtttatgtgggggaaaggtgacatgcctttcatcacccatcatcgggctcacgaccgacactcttgcaacaagacaggtcagcaagagaaaagcatcacaaagttattgaatcaaagttttatgtgacatgtagctttcaggaatgaagaccgaaagaccccaggaaatggtctgtctggtgtttaggtttgatggagcagggatagctgcgtaaaaatgggattgggatgaaagggtgtgatctactgagctagacggaggcggggtcccagcaaggcctgcttgctcccattcctcttggcctctgcatggtgttccttcctcccagtgtagggcaggacctctctggaacttacaacctgcctccctcagacaaggtaggttggagaatttctctgtggatggctcctacccaggaaggtaggggaaggttagagttatatttctaggttttatggctggctttcagggagaggggttctagattctatgacccaccttgaggaagaattctggttccgtttttcttttatctttttttttttttttttgttaagagagatggggatttgctatgttgcccaggctggcctcaaactcctggccctaagtgatcctgctgcctcggcctcccagtgttgggattacaggcgtgagccactgtgcccagccgcctagtttctatgactcacttcaggggagaaggagggtgagagagacaggaaggcagaaggaggtgagagagactttgcttctgagggccccttctgagcccttctagtcttctttagttcaagtacgtagcatgccacagcacctttctttggggtgttgttttctgagccccaacattcatggccctgaatgtgtgcctctgtgtgccaggtgttgccctaaattcttggaccttcccatgagctggagttcactgacccatttgacagatgaggaaactgaggcactgggagaagcaaagagacttgcctgggatcatgaagtgaaggggatctgaaccctgagacaggaactcttgatcccaaggggcccctaaccccaagcccttggccccctgctgaactggttcaaaccagagagtgtataacccagctccaggctgggctgggcctgaggtgtgcgtctcacctggcagttacaagaaaaggaaattgcactggttgccacatttacaacctaaagtggagagatttcacagaatccagacttctggtttctcttatggaatccggggatcggccgggcacggtggctcatacctgtaatcccaggactttgggaggcgaaggcagatggatcacttgaagtcaggagttcaagagcagcctggccaacatagtgaaacccagtctctactaaaaatacaaaaattagctggccacagtgacgtgtgcctataatcccagctactcgggaggctgaggcaggagaatcacttgagcccaggaggtggaggttgcagtgagctgagattgcaccgttgcactccagcctgggcgacagagcaagactccatctcaggaaaaaaaaaaaaaaaaaaaaaaaaaaaaaatcagaggatctggcggtgccaggccggcattggagggggtcccagcctggcctgtgctgccactggttcagcagtagagcctgacggggaggcgacagcagtgggggccctggggaaggagaaagattccagaagcagctgctaggctggagtagctggccttgggccccagaccttcccggggaggtggggctcccatttcaaatggagcatgcccagcctgccgggcctcagtttccacatatgcccaggcatggattagctgagatggtcttgaagtcctgccagccctggtggttctggaggttgagcctcagtttccctcatctgtacagtggaggacatgatggagttctagctgttgataaatgccctttaaaccaccatttattgggctttccttatacagcaggcactttactgacctggcttcattttatcttcacagcagccctgtgagggtagctgcgccattaggcccatttcacagatggggagactaggtctgagagagcttaggtggctttcccaaggtctcacagcccctgtggctgagaggggcttggaacctgggcagttggctgcccctgtgagcagtgagtccttagaaggacttactgtcagtattattgatggcactgttaactagggccctgcatgggtgggggcacctgttttgggctcttggactaggaaaagctcctgtggccattttatccaatgccaccattttatagatgccaacaccgaggcctggagggggctggccagcgcccctcacctggcacagaggactctgcctggcacatcccacccatggcctctgatgcccagcttggagaagtggtagaagaggggctgggggatgcctcagggggacttagccctcagccctgagccccccgctgcatcacaggcctgagtgcccaggaggcagtggtctgggtaggagtggctgcgactcgggggtaaatgtgcttcagagccatccccactcatcccctttcgagccaggtgtccctggtgtgtgacttggccttgctgggcctcagttttctgtaaaatgggaagtgtcatggggggcaggctacggtaagcactgatagggcaggtgaggggcagcctcgggcccacccttctggcaggagacatttggggcacccagaagccctggaacaaggccactctgaccttgattttgggagcacaaagtccccccaagagatagcacaggagcccgggtgtctgatgagtgacccatcccttgggggcctcagttcctgggtgtgcctgggtctgcaggggaggcagaggcacaggtgggcagctccctctgggtgggctgtgaccctgcctgggcacaggagggccgtgcccgtccgtccttgccgtgattcttccaggtggcaccgccctcacacctcctttacagaggaggaaactgagacccggggaggccacaggagtcgggctctgggcccagagcctgggcggggatgcaggagccacccccatgcctccgggtgtgggaaaggggaagcagaaagaaagggacgtccgccggaggcctggcggtttcctctcggggcaggagtgcgaggaggaggaggaggaggaggaggaggaggaagaggaggaggaggaggaggagggacggcaggaagccgcctcgggctctgacaggcgcggccctggcctgcccctgcccttctgagcctgtgacccgggggaaggcactttgccctccctgtgcctcagtttactcaagtaaaaatagctgaatgatggctctggccccaggatcaactgagtgctgtctgggaagcacctagagctgtgcccaacacagccagtgttcgctggggcctgcaaggctttgctgctgcaggcatcactggcgttgtcatttttatttattatttatttatttagagacagagtctcgctctgtcgcccaggttagagcagagtggtgtgattttggctcactgcaaccaccgcctccagggttcaagcaattctcctgcctcagcctcccgagtagctgggattacaggcgcccaccaccacactccgctaatttttctgtattattagtagagacgcggtttcgccatgttggccaggctggtctcgaactcctgacctcaggctgtccatctgcctcggcctcccaaagtgctaggattacaggcgtgagctaccgcgcccggcccatttttattaattggttttcatgtgacaggcactgtgtccgccacatcccatggaatccttatcacaaaccccggaggtggggacagtgatgaagccatttcacagccaagaaaactaggcacagagaggtccagaaacttgcccgaggccccagagctggtaggtggccaaggcaggaaatgagagtccctggtgggtctgccaaggccggggggcaccaggggcagggggtttgtgtttaggccccagaacaggcagagagaaagcacccaccctccaccgtcagaacgagcctgtatcccggcaagcagggcagactgagccctggtcttggcaggcaggcagagctcaggtcctggcgggcacacaggcttaagaagccggttttttcctgggcccacgtctcctgggggaccagcggcagaggctcctggggtaggaacggaggtcccatcctcactctgtcctgggctgccatgtgacccaggtaggtcccagtcctctctgagctatgaagtgggtgcctgcagtggccttctgggagtgatggggaaggcggagggggttgggcagggctcctgcggccccagccacacacactgccgccccatctgcccccttattggggttccatgcaaaatcgtttttgaaaaagtgctttgccgcttagaagaaacccccgaccgcgctgaaaccacgggggcagatggtatcggggcgcttcctttcagctcaaattctgcgaatccacagcctagaaagtgccctgaatccaacaaggggggaggtaattaagttattatggtccatccccaccccgtcctgcttaccaggcctggctgctcttactggcttcttggaagttggtgtggtatttttttgttttgtttgttttcgaggctggtattgagatgagaccattgtggggtcagggctgtgggcttggaggttcagggtcagggtccaggggcgaagggtggacgctggagaagggcagatggacagggtcaggttcagatcttggctcttgtatccttgctgtgtggctctgggccaagaacttggcctctctgcgcctcagtggctcattacagaaaatgggatgccagcacttgccttagtgggttgttttgagccaactgcaggctcagggagtagctggcatgatgtgttcctaccctgaagggcagaaaaaggggaaggaggccaccagatcccacaggtgggtccccagggtccctccccgggatgggcagcagcctggctgctccccacagcaacccctggctggccccattggcgctgctggaaatcccccacccagttctttgtgaatggaaaaggaaactgattgcgctagaagaggtctccgagtgccggccgggggtgggtggcggggggggcttcctctcccagtgcaggaggggccacctcagcttcctttctggggccccataccccctttttcctatctcccctctgagttgaggaggaggctgtggcccccgcccactgtttggcctctggaaccactgggtgacagtgtacatcggggcgattaagggccacctggcctctggacctccctcgctgtggctgctgcctgggaccccccaccccatgcctgactcgaaccccaacctcagctctacacacaggggcaccactgtaggaggagagagaaacctctctctagggaaccacctggaagggggccctgccctgtcttcatctgggtaccccatgtaatctaggaaactgtctttaacttgccgagggcctccatgtctgagttcctaatgttttttattttgctttttcaattaataaagctcatggcagaaactatttaaagaaaaaaaaaaacagtaacagaaaaacctcccacaatctcactacccagagagaaccagcatttccattttggtagatgtcattattgtcatttttgttttgtttttgagactgggggacactgctctgtcccccagactagagagcagtggcgccatctcggctcattgcatcctcaacctcctgggctcaaggtgatcttcccaccttagcctcccaagtagctgggactatttaatgctgctattagcatagacattagcaggacaccatgccctgctaatttttaagtttttttgtagagacaaactctcactatgttgcctaggctggtcttaaactcctaggctcaacagtcctcccgcctaggtctcccaaagttctgggatttacaggcgtgagccaccaccacacccagcctcttctctgtctttaactttgcctccgcctccaaattccaattccttcagcaattgctgggaagggattactttttgcacaattctgtctggagccccttgcaggcaggagcttgtggacaaaagcttcagcctttgcgggcctggcattcctcatactatttggtcacctgcttttttcactttgtgtcctgaacatttttctgtattcttttttttttttttttccacctcctaggttcaagcgattctcgtgcctcaggctcccgagtagccaggattacaggcatgtgccaccacgcccggctaatttttgtatttttagtagagacggggtttcaccatgttggccaggctggtctcgaactcctgacctcaggtgagctgcctgcctcagcctcccaaagtgctgggattacagccaccgcgcccagcccatttttaacttttttgctggtatagatgaccctgggatgaacaccttatgtcagtcttggtgcccacttctgatgattttcttctgctcagttcctagaaggggagtgctgggtcaaggcttttatgagcacttctgatccgttcttgctctcaaagctttattgagatataatttacaaaccataaaattcgcttgtgtaaagcgtataattcattggtttttagtatatttacagagttgtgcaaccctcaccataatctaattttagaacattttcgtcatcaaaaaaggaaaccttgtacccatgaacagtcactccccatacctccctccccagcccctggcaaccactcatctcttttctgtctccagggatttacctattctggacatttcacatatgtggaatcagactatgcagccttttgtgtctggcttccttcacttagcatcatgttttccaggttcaccgaagttacagcatgtattttgttcctttttatggctgaaaaatactccattgtatggacttgccacattttgcttatttgtttatcacttaatagacatcaggttatctccactttctggctgttatgaataatgctgctatgaacattcgtggacaagtttttgtgtggatctgtgttttcatttctcttgggatacatctaggagtggaattgctggggcatacagtaattctatgtttaattacattgggctgggcacggtggctaacgccagtaatcccagcactttggggggctaaggcaggtggatcacttgatgtcaggagtttgagaccagcctggccaacatggtgaaaccctgtctctactaaaaatcaaaaattagctgggcgtggtggtggatacctttaatcccagttactcaggaggctgaggcagaagaatcacttgaacccaggaggtggaggctgcagcgagccaagatcatgccattgcactccagcctgggaaacagagagagactctgactcagaaaaaaaaatgactatatataaaataaatatgactgccaacctgttttctgaagcaactgtaccattttatattcccaccatcattgcgtgagaggactccagtttctccatgtccttgccaatatttgttattgtctgtcttcttgattgtagccatcccagccatcttaaagggtgtgaagtagtttctcagtgtggtgttttttttgtttgtttgttttaaacggggtcttgttctgtcacccagcctggagtgcagtgcagtggagtgcagaggcagctcactgcagcctcaaactcctgggctcaagtgatcctcccacctcagcctcttgagtagctaggattacaggcacacaccaccacactcagctaatttttgtttttcactacactacgtgatgtggttttttgttttgttttgttttgtttttgttttttgaagagctggggtttcaccatatttcccaggctggtctcgaacacctggattcaagcagtcctctcacctcagcctcccaaaatgctgggattacaggtgtgagctaccgggtttagcctcagtgtggttttgatatgcatttccccaatggaaaatggtgttgagcatcttttcatctgcctaatagccatttcttattcttttgatacattatttttgagtagccttccagaaaggtcatacgcatatatcttcttgtcaccagtggtgccagcactgggtattattttaaaaacctttgccaccttctggatgaaaagtggttatcttatcctaagtgtgaccatttctctttgttaaaagttgagatatgattcatataccataaaattcacttgtttaaattgtacaatgcattggcttttagtatatttaaacaattgtgcaatgatcaccactatctaatccagaacatttctatcaccctagaaaaaaaccttggagcagtcagtccccaaactccctgcctccagcccgtggcaaccactgatctttctgtccccgtggatttcgactgtttctcttctgttccttggtcatacacatttcttgtgatttatcaggctatttactcagcatgtttgtctcctgcactgcttgcctttttcttgatttgtgaacactacacggcacggatattagctctgtcccatgttgcaaatatttccctggtttccgatttgacttttcaattttgttcctgcatttcttgacctatgggggtttgcaagttccaggcagtaaaatccagtgatcttcgcctttatggttttattctttgcttttttaccttagaaaggcctttccccacccaggatcagataaataattatttaggttttattctagttctgtcttggtttcctttttcacttttaattatttaatccagctggcttttgttatgggtggctggtgtgatttcctgttgttttgtgatgtcagtgagaggctgtgtgtcaaggcctgtgacatggtaaacgttcagtaaacaggagctaaaatgatagtaatgagagtccgtgccgggtggagctcagaaggacatgggattcccggtgctgtgccgtggctggaggaggacctggcctggctgtgccagttggctgggagcccctccaccccagaagcccttgctctcacctcttcttctgaatcatcgttcttcgaaggcaggcagtagctaccgttgtctggggctttggggatcttggtggtgatgagtcccctctcctctggtgcactctccccacccgagacgggcgacagaggttttttgttgtttcttaaccacatctttttccacccacacccggtgcagagcagatgcttggccggggcttccccgagctggtcctggctttgtggcagggggatgggccgtcggtgccccattcaagcctggggacctggccccactggtgtgtgctacagtagacccagccctggggccccatgataccctcggtgatcgtcacagatgcggggcctggctacagtcctcactggtgttttttttgtttttgagagggcatcttgaagtagcccaagctggagtgcagtagcacgatctcggctcactgcaacctccgcctcccaggttcaggtgattctcgtgcctcagcctcctgagtagctgggactacacatgcaccaccacgcctggctaatttttgaatttttagtagaggcagggtttcaccatgttggccaggctggtctcgaactcctgacctcaagtgatccgcccatcttgacctcccaaagtgctcgttacaggcgtgaacaacccccacccactgcagggagccaggcttgccccctccctgccaagggagctgcttgctctcccttctgtctggaggccagcacagcctggcactcgtggtttggggcgtccatggccttgtggtggcgaggcgcagaaggcgtcacctgaaaaaggtgtggccaagggcaggggtgctgggcttagccaggctggccacagtgggggcaggaaggattcctatggggacagctgggagcaggatgtggtcgtgcgaggcgtgggctgacggcagctggcatgcagcaggggaggtgtgctgggaccaggcctggagtggggtctggtggccctgccgtgtatggagctgagtgccgcccagagatgccatcttgtcctcagaagtggctcaggcctgctggggacagggcaggtggatggaagctgctgcatgccctgtgccatgtgctggtccgctggctgtcactgcagcgcagctcccggtgcctgacagttgtttgtccttatttggcacttgagagcccagcggtttggccagaatggtgccctgtgcggagggcacagcttgagtgaaggtgtggagggaaaaggccctgggggtgtggctcccctccttccatcctgctccttgcaaggcccatcccaggacattcctcctagccaggtgggctggatggggcctggacttcctgtccatgttttgggatgagagcgctggggaaggtgcccactgcggggtagggagtgtagggctttccaggcatcatccctcataagccactgtccccaggccttgcgcatagccccaccatagccgactcgagagtagaagcgtcccaccatcctcacagcaggctgcaggggccatgtgtaactggcccctccacccttggccacctggtggagtcggcacccatatctgaggaggggaccatgttgctgctggggactctgggctggtctggaagcaggtgtggtgggggctgtctttccctgtgtgaaggtcttcctctgggtgtctgtcgctgtagggaggccactctagcatctgaaaggggctctgtgtccttgccatcatgattctgtcttgggggtggttgctgtctctctgagagggggctttgtgtctgtgtccctgtgattctctgacatgcaggaggaccatgatgggaactgaggggaattcactctgggtggggttttagacaggtccccaagtcctgtctgtcccagcatctctggctaatcacttcccccgcccccctcccgccacacacatacacgggaaaagcaggctggtgtgtgtcctgttgcccacaccacactcagtcactcagtgtgagctggggtgccacctgcctggaggggggatctgactctgaacagggattctgtatttgggggtgtcacactcaccatgtctgtctctgcctctaccatctgactgggagaattcctctcagggttggggtgggcaccaagccttgctcccagtaggggcccagccctgggttgggcccagaggaggtgcttggagggtttactgggtgacggatggatgagcacttgggtaggggcctgggacccccaaagccctcagatgtctgggaaatagggggatgttctggctggggaggtttctgtttctggcattggggggctcttgccaggaaagggcttttctggcagccatgtggcttttctggaagcttctcccttctctttcctcctcccctgtggggaaagggcacctgaggcagcagggtgcagaccaaggggggatctggcccataatgaacagggtggtgggggtctaggagccgctgccctgtggactgggcccactgggcattcagggcagcaggcaggctcacttgcagaagtccaaggagtgggttccattatcatccccattttacaggtgaggaaactgaagcacagcaggccaaagtaatttgctcagggccctgcatttgaagggtctgtgaaggaggggccaggcttggggtcctggtggggggcatagcagagaagcgccctgtggcctgtagttcccacactgattcagtcgctggaactggctcattgccttcagtttgccccccaaggagcttgggaaaagggggctgagatcacccatcacaccccatacctccctctgcttcccaggcacttgagagcttgggggtcccaggtacctacccaagtgctcatccatccatccacccggcaaaccctccaagtacctcctctgggcctgccccagggctgggcctcagctggcagcaaggtttggtgcccaccccaaccccaagaggaactctcccagtcagatggtggaggcagttgcgtcatcaggaaaccatggccggttcgataagctcagtgctgagggagaggcacaggaattgcactaatcatgactcagtggtcagagaaggctccctggaggagaggaggttttctctgctgggacatgcagtttgggtcaggcagggcatcacaaatgcaggggctgggtggcaggggaaggtgtgggcgggaaggcggctggagggagaccaggtgttgggggtgctggggctgggggtgggcagatgaggattggagccctggctcaacttcgctattccccatggctggggcactgtgtgattttgcctcccagagtctgtagcatgggggctcctgatggtgcccttgcggggaggtcagggggctgacacacctgagcctgcctttcagcctgccctcttccctggccagctggaggggccttgggaggcccaccccagccctgagagcactggcttgtagcatccctatcactcatggtcttcactggggtgggggatggcagtaggggcaatcatcccctatgccccccgttacccagcacaaaggatgcttagccagcaaaaggcttatgatgaatgttgagcacccaccacctagcaggcactggctcgcggccaaggacaccacgtgagcaaagccaagtcacggcagagacctgcatcaaggaatgcgcaagaccagctcataggacaacaggcagggaaggaagtgaaggggctttgcggctcaggatttagatactgtggtcagggagggcctccctgaggagatgacactttgaaaagcagtcgtatttgtgaagctgtggggggagctgcctctctgagggcacaggccccgagtgcacctggcacactgaagaagagtggaggccagtgtggctggatcagagcgagggagggaggcccaagaggctgaggaggtaacaagggtctctcagatgaggaccacaggggagtttttgtttttgtttgtttgtttgtttgagacagtcttgctctgttgcccaggctgcagtgcagtgcagtggcgcaatcttggcttactgcagcctctgcctcccgggttcaagtgattctcctgcgtcagcctcccaagtagctgggactacaggtacctgccaccatgcccgactaatttttgtatttttgtatttttttgtgtgagatggagtttcgcttttgttgcccaggctggagtgcagtggcacgatcttggctcaccacaacctctgcctcctgggttcaagcgattctcctgcctcagcctcccgagcagctgggattataggcatgtgtcatcacacctggctaattttgtatttttagtagagacagagtttctccatgttggtcaggctggtctctaactcctgacctcaggtgatctgccttgcctcggcctcccaacgtgctgggattacaggtgtgagccaccgcacctggcctaatttttgtatttttaatagagacagggtttcaccatattggccaggctggtcttgaactcctgaccttgtgatctgcccgcctcggcctcccaaagtgctgggattacaggcgtgagccactgcgcccagccgggagtttcttttgagatgagattttgctctgttgtcgaggctggagtgcagtggcaccatcatagttcacggcagcctcaacctccctgcttcagcctcctgtagctgcaggggagttttgagcagaggagggtaggctggagcagcatcgtgggggtggaaatagctaattctggacagacttgggcgtagtctgatgggacagatggcagtttttgatgctgcccaactcccagagggcccaggtgtcacactgttttccagcctggctcctctctcctcactgggggctccttgtgaatacccctttcccccagcagttgtctgggactggaatcctggctgctcagctcccagcatccaccactttctgcctttgagggatgggccgtgcctcccctcctgcacatcttctgtggctccctggcatctggggggaagatgggggacagaggcctccctgcccagctctcttgacctccctcagaccccagccagctcagacgccggtgggtttcagatccacccaggtcccatgttaaaatgcagattccaaactcccttccagatgtcctgtgccagaaggtcatagaagcaccctgtgctgtgttccctcccccttggaggtctcttgagccttctcatctgtgaagtaggtgaaggcacaggagggccacgtgaggctcacacacactgctccttgcacggagctggcccggggcagggtggtgaggcttctccttcataaatctcactgtccatgatgcccaggattgtcctttgctctggaaccatgacgtcctacttggtttcgtcgtgtccttgatggtgtgacgcccatttctgtgacttcctcttggaaaactttttgaaaaatgttgccggcctgtgaattccacaatctggaaactgctggtgggccacccaggctccaatgcctggcacacagcagatgctcactaaagggtggtgtggggtctgtgagcgtcatttccagccacagtcaagcccctgttgtcttctagcctggggctgtgccttctgccctctgggtgttggctcttgctattcccttaacctccagtgcctttttctccaccatccccacttcggagaatattcagcaaacgctactgctcctttctctgtgctgggccaagaccgaaagatggaaaaggaagagggaggccttcttgagcctctggtgcatgggagcaggggagtgacaactcaggagggctgcccagggaggggccttcttgctcccaagtctctcttaaggctgagctcctaaggccctgtgctcctccctgccttaccattcccctgagatccttccataccctctgggagctctgttgcacacactatgctcatattctcagggaagggtagtggcattattatcccaccttagaaaatgcagactcttgcttgagcccaggaggtcaaggctgcagtgagctagtttatactctatcctgggcaacagagagggaccctgcctcaaaaacaaaatacacacatacacacacgtggagactcattttgggaggccgaggcagaaggatcacttgagccaggagtttgagaccagcctggacaacatagcgagatcctatctctatctctacaaaaaaataatcagccacatgtggtggcatgtgtctgtaatcccagctacctgggaggccaaggcaggaggctcacttgagcccccaggagtttgaggctgcagtgagccagcctgggccacagagcaagaccctatctcttaaaaaaaaaaaaaaaaaattggaaactgaggctaggagaggtgagtcacttacctatggaagagaaggcagagttgggactcaagcacaggactaagtgtcccaaacctcagggtggtggagttgctgcatggttctgtagccctgagggatttctgggcaggatactggatggcttttagcaactaggctcagtcttgatgctgcccaccccagagaatggctgagacgcaccacgtttaaggagagtttgcgaggtgaggaccttcctcacctcaatcccatattaccttgggatggtaataaggtctatgaaataggtcaaagtctgggtaatgcatgggtttaataggtttctctgctgcaggacttctcagagtctttaatggagctaagcagcagcattctctttccacaaatgactgtcctctctcggagaatcctttgcattggctgccaggaagctgagacaaatctgtggcaagagggactcttgtctgtgttgtagcagctgtctcccagctctttctgggtgtctctaacctgactaaaatcatttttggaagaaggcaaggaatttttttttttttaagacagggtctcactctgtcgaccagtctagagtacagtggtgtgatctcagctcactgcaacctctgtctcccaggttcaagtgattctcctgcctcagcttcccaagtaggttaactttttgatactagacagtaagcttggattaagtattttccataataatgctcattcatccatcccggcagcatccacttcaggttctgggctggggtgagggatcagccatccaggacaggatctggaatttgctctgcgccttttcagaccccctccctctcctcctccagtaagaaggtcaacaggacctgcttacgggccccctattactgaaagcaaactgaacctccagttagtgtcctgcccaaggtttcaaaggtaagtaagtggtagagctagggctcttctaaccacctgcagagctaggcccaggctgccagatgcctccttgagggcataggtgtggcagaggcgtggctggtgctggagggtcgactgaggcctgtcccactgctgctgtacaccgatgaatgtgggctcaaaggctctggggaaggtaagaccaccagggagctagtgtggcctgggggttcccgggggtgggcggtctctccccaaggctggtctgggccaagcccttgctgctggggtgtgtcagatgctgccctgtgtcctgccctccagcgtcccaggaggagggggacagccagcaggcctgctcctgttaagagcttccccaccttagaaaaagctcaagctgattcccacagccttgaagccccatggtggcttctgggggctgctgtggcaggctcacctgtgcctcttcctgctctctcaccaggggaggccatgccatcagccttgctctccacgtaggtgtggtcacgccaccagagctctggcctttgactggtgtgtccagccctgccctgccccgacttgcctgtctctgctggatgcctgagggcaaagccagtaacagaccccactcaagctggttatgaggacctggcagggtggggtgtggcccagtacctcggaagactctagaaggaccatcctggccctataaatgtttgtgccaagacaggtcccctgtccctcagcacacagaaggggcagtaggtagcaagacagtttccaggtaacagcatgagggcaagtgaggcctagagaggaagggtctgttgcctccagcccgtcacattccctccaggcgggctgaacagccaggtgggataaagagggatcctcaggtaggcgggagtcagggagagctgcgtgaccccacgaggctggtgtttcatcttcacttctcagatgacgggactgtggctcagagacctttgcagggggactgatcacagcacagggccatttgaagggagcctggaactgcatttccatgtggaccctgggtggatctggaaccaggctggctttcctagctcccccgccctttggctcccttatgttcttagccttcttttcacaacaaactcagaagcagccaagtagttggttgtgttgtctacagttgcactgaagcacgttttatttcggctaagtgacagtcctttgttgtccctgtcttgtaattagttagggtagtatgttggttatattacgtggaatttattgcaggatggtaagggagcatgtgacaaaatggggcaatagttctgtaaggctgagagaagctgggggtgtacccagtggctaggctactcagaggggactgtcatgctgtcagtagtgtagtgggagccaagcaggctttactcaccggcctgttaacagctgtgcgagtcatgcctttcgcttgtgttagctcaccttgtgaaaaaatgagctgaattacagatgacaactaaggcatggagagccgaaccctttgtccagggttgtataggaagtggcagggtcagggctgaatcttaaaacctagagggtagggcccggcgtggtggctcatgcctaaaatcccagcactttgggaggccaaggcaggcggatcacctgatgtcagaagttcgagaccaacctggccaaccaacatggtgaaaccccagctctactaaaaatacaaaaattagctgggtgtggtggcaggtgcctgtaatcccagctactgcggaagctgaggcaggagaatcgcttgaactcaggaggtggaggttgcagtgagccgagattgcgccactgcactccagcatgggcaacagagtgagaatctgtctcaaaaaacaaaaacaaaaacaaaaaaccctagaggataaaagaactataacatctgggataaagttagctgttgaaataaatacaagtcctaccgttggggtagtgtcagagctggcctacgtctttgactttgagattcctagcagccagagcaaagaaagaaatagattattcccactggagccacagtggccataacaaacagaagccatctgtttagatgctgggaatggagaagacttgctccccagaaatagacgctgcaggatgtggtgggtgacagtctactgttcaaaccacaaatacctgaaatgatctggccactttgatcacccaaccacagtagagcctaagcaggtccagggagcagctgttgctggcctggcttgacttttgagggaggtggaatagcgggcatgtgagaggagggaacctaaagcccccacagctgctgacacagcccccaggtttgagcttgtctcccctctcacccatccccccatatagcttaatctgatgggcatctggtggtccttccctgcagtggccagagcctgagctgtccaggctgaggtttcgactgaagcaggggttgtcctgcgcccatgtgcccacacgctgcaacctggctggagcctctggcataggacacccataccaccaggtagctgtggcggaccccggctctgatacttggcaggcttgggttgagattgtggctctaggcctgggcggctctcaagggctgctgtggggagttggggaagaacccctgggttgtgctcagccagcaggcaggtggcagccaggctggctgtgggtgaggaggggaatcctcttttcaccactgcctgcctgctcagcagttcttcagctgctgggggtggagctggcttgcaggggccagagtcagagtgaaaccggcagctctgctggttaatctcagcactgacactggggactaggcctggagcggaactgaaagggagactaggcccgttcccctccaggcctggcctatatcctcccagtgatccttaaggcctgcagctagggggaagggtgggggccaggcagggccaactggaaaagtagcagaaggaagtggccactcgcaccttacccatcttgcagacaggaaatgaaggctctgcagggctggctggctgtaaaaatgggcaagagcgcagaggccccactccctgcacactgcgctgtgtccagtgcccgtgtggatgccatgtgaggcctcactctgcctgcctcatcctggctgctggacctctgggagtaggaggtgaaaatgccctggctggtgctggtcacttcaggctggaattttctagtcatgcagctttctagtgagaggccgcagtgagctgtggccagtgttggtcattcctgcagtcattactctcccccagcctgttgtgtccgccaaccagagcaggcccgggagctcccaggagacctgctggaagggcccaggtggccatcctgctcctgccaggctgccctcttacctcactgttcattgactctcctgcaggtggggaagggggataaaggaggtggccaggccactgggtcatgatccttccgacagaggtacctggcagctctgtgtgtaaagcaaggttaagcatctggttttgggggtcaattcaacagcactagcagctccagtccaaggtatgcccttttgggctgaggtggaggtcagatcacctgaagccacagttgctagaacatcctttgggctgcctctgctttccatccccctgctcccagtttgttaggggttgtagtattttccaggaacacctgaatggagggggcccagtggggccacttctgtccattccttatctcatctctttctccccttttcttctttcggccatcttttcagtcttatcacaagaggaaggggaggggcaaaccccctcctgagcagattcccaaccggaagcagctggctccttggctgcagagtgccccagcacaggaagcatctgcagggtcagttgagacctgggagcaggtttcctgctggcaaaggaacagtggctaactcctatccaccctgcagccctatgtgccgggtgtcctgggaaggtccagggccaagattttgtggttttacagtggctataacttaggctagccatgctaggctctgcccctttgggcttggtgtgatgagaccgtcagcagctgctatcacctggctgggcagggagctgtttgctcaccagtgggaagagaaacggatgtcagacacatggcagagtgggaatgtctccaagtccaggtccaatgggctgggagggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggtggtgcacacggcttgagatgcctgacaacctttacacctttgtgctgaaggtgagtgacaaggcttttcacaccctggggcaatacaaatacatacacatacagcagacccaaccctgttcccttcctccctgccaggtgaaggaccggacagacatcatctttgaggtgggagacgagcagcagctgaattcatggatggctgagctctcggagtgcacaggccgagggtgaggtcctgggccctcgtccctggcaccacctttgctgctaccacccctgacctgcccagatccttaacctcagcctcttctccagcaggctggagagcacagaagcagagatgcatattccctcagccctagagcctagcacgtccagctccccaaggggcagcacagattcccttaaccaaggtgggtaaaccaatagctaggccattgtcttctgggtacgctggaacccagactcagcccaggacataaggtagccccctgcgaccaccatcacccatcttatctaacaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaaggtatggggtggggtggggtggggtggggcaggcaggaccgtgccacccctctccactggagttcagggtcctagagggacagcccgagcccaccatcctctcctcccacagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggtctgaccctactgccctttgctgaagggggtggctgacactgggtagagggtagaggcttgctgcagacccaggggtacaggtatcttgttctgtgtcctgtcagcacttgcctcaagactgatggtgtggtctctcttggtcacttgtcctaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttg

SEQ ID NO: 36388 - DNA, 9151 bp, Homo sapiens
ctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgctaccgggtcggccccgcagggtctgagacccgcacccttccccggtcccacccgtcaccaggccgcccgcgtagccaggaattcttagccaggttcctgtgcgcccaccgtgaccctaagagaagaggcggacgccctggcacgtccttccctcctgcttcccccgcccaaagcgctcccggttcccggggcgtcaggttggctgacagttcggggtccctgcgtcctgtctcctcagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggtgagacggggcacaccgggtggaccggctttctgaaacatgggcatattctccgccacctgccccctactctcctcttatcccaggccggcgtcaggaggaggaacgcgcatcagttcccaagcagtaggaagaactggaaggccttgaaaggcaatgcgcttcctttagaataacagtttgggcttggagtttcaacaggagaaagaatgtcggtctttcctggggtgtgattttccttgcatacataaggctgggctgagtgtggaggcgggtacctggaagccacacttcttaccacaggctgctctcggggccctgttgtgactcgtacctgcggttctgggcaggactcttctttctttcattgccttttattcagtcactgcctgtgcttggggtaaaacaaaagtgatctctgagcagaatgccgctgacagtagaattggatgaggatgtcagacctggttaagcagtagtgtggaggggctgcttcaactttgcccctggcagatggcaaggatgggacccagaggaaagggaggtgtgtgcagttaaggcgagggtcccccccagtacaaacgaatgaaaactccagctgcgggataatgaatgagaaggcctccaaattactttttcactgatgaaacacaaatggaagtggcatataattaaaggggaaagaaatatggaagcccactgtatattgataggatattttgagtaactctattcatactcaaaatgtgtcctaaactgtagagaactttcttaagcatcttttaaattttttatggaaaatgtcatattttaccaataaatgttgttgtgttagaaaatatccactttaatctgagaggaagaatattcagatcatccccagtatcacaacagttgtcacgctagtgcttcaggttagtcctggtgaaaggtataacccaaggtacctccgtgtctttcttacaccttttatgatattgccacaccctgataaatactcggtgttcattgttagaagttaccaatttatcctttatttctctataccacctgaatcttaatttatttagtcagttagctagctagttagttcaacaaactttaaattgattgagtgcttagtttgtgctgggcactgggccaggatgaatgagagatagggtctgccttcagcttactcacagccttatcagggcagctggctaggtacagagatggacgctgagaaaacacagtcaactgacaaagagggaggaacagacaaggctttgaagagtgaaaggagtcgaaaaagactttgaaaggataaatgaaaattcaccaaatacgtaaaggatacacaaagaacaccaatttaattttatcactaaaggttgtaaacaattaaactatgttgaaggtgccaagattgccagggaaatgaaaatgttgccttagtacatgatcagcttcatgaaggtcaaatggatagttatattctgacatttgcacttgaattttttttaagatccctgagttggcacataagatttgggattcccaattaactaaaactaatcatctaacctctatgtcagttttctcactttcaaaactgtgaaaaactgagtgaccgcatagcatattgtgaaatgctgactatgaagctatttggaaatgtgaagtaccatatttatagtcaacaaagctaggcttcccaaagcttttgtgaaagaatttgaaaaaaaaaagtttctcatttactaagtggtggaaagatataagtaaaactacaattaaccaagcaatgcctctctccagctggctcttctgagaatgggaggtgtttttgtatagtgcttcaattggtgaatcatcaatgcacctttttttagccacataaaatgtattatttaatattatttaacttcagcttgtttttttaactatatttatgtggggcattaatatttaactgtaaaacatttgtcaccaggcagctgtgattgcaagtagaggagtaatttcaaacaagaatgcttaaaagttagctatgccttgataaaataggtttatcattaatagattgcattcccatgacatgataagaccagatcaaggacagaccttacagaattgcaaacccatttgggcaagctttttttgttttgttttctttttatatatattttttaaagcaggggcttgtgtattgtttttaccaaaaagttagtggtgaccaaagctaggaaaatatgcagtagtggaactttgaaccatgtcacaatattaaaacaggtcagattttagatcctttaaacaaacaatcaacaacaataaaacacagaagtctggtggtgttggatcctagaccagaagtacgggccattaggaatcagtgaattagttggattccatactacagtcagacagagatagctgctgtttgttaagcacaggttattggtcataagtggatcataaccaaagaaatgtggctggagcacccatatcccttatttttgctggaatgcaaagcaaacaaatgcccaactgatggaaatgcgatagtagcaatctcatttctagaagacagttttcatacagtaaattgctatgaatgcagtctgcatgactctacaattactacaacactaaataaaagtctctatcctatggccttattatccaaggatatatattatccaaggaatatataaccttacatatattaatatatataatatatatatattataagatttacttaagaagtattggccacattcagcctcaaccaaattttgggtcaatcagaactgcctggagtttcagaagctaaactatttgtgatgttgagaacccaacttaagtttgatgtcggaggatcattagattctctgctccaaaatgagggaacacaagtaaacaaaaataaaatccaaatgagttaacaacaccctataaactgaactcctcgaatgtgggtaactgctttgctgaacaagaagattcacttttgacatgtgctaaattcccttttaggacatggagatctaaggagtcacggagatagaaaatttgttagcctaaggaagaatagaaagtacattgtattctggctgggagcagtggctctcgcctgtaatcccagcactttgggaggccaagctgggcagatcacttgaggtcaggagttcaagaacagcctggccaacatggtgaaactctgtctctactaaaaatacaaaaattagccaagcatagtagcaagtgcccatgatcccagctactcagggaggctgaggcaggagaatcactcgaacccgggaggcgaaggttgcagtgagccgagatcacttcactgctctccagcctgggcaatagagtgagaacctgaaaagaaagaaggaagggaagggaagaggaggggaggggagaagaaagagagaaagaaagagagggagggagggagggagggagggaggaaggaaggaagggagggagggagggagggaggaagacagaaagaaaaagagaaagaaggaaagaaagaaagaaaagaagaaagaaaaaagaaaagaaaggaaagaaagaaagaaagagaaagaaaaagaaagaaagagaaagaaagaaagaaggaaggaattctaagtgaagtggatttggttaggaaactttctgatctaaacttcagccttttaataggccaatttgaggtcatcttgttatagttattttcattatatattctgccttcaaaataggtctatttattatacattataatgacagcatcatacaggcatttcaggggtacataataaatgtcaatcctcatagccagttctgagagatctcctggtgtcactttaatttgtagcaacatgcccaagaccacatatcaagtgagaaatataatagaataataagtctaaagttgccatcattgaggtttctattcagctatttatctctgaaacacttagtaattaattttcttattatataaaagtgtttcatgtatttagcacttgaaataaaacacaatttgtggagacagtcaatgtgaataattctatattctaaaaatatatcaatcaatcagaaagctgcctaatatttccttcattttgggctaagtacagcagaccctcatttaagtcatattttaatagcaaaccaagaaaatcagcctactcccttatgcccacccaggtaataataaagcttccattgaggctaccagcagtgcctgaaaatctcacaactacttttgtgctcagaggacattactacaacagagaacattatttagaaaattacatataaaattaaccatcctgaggactataaggatatgcagctatgttaggaacaagtgtatgaaaaataacaatttcaggatagactagttttcttgtgtaaaagttctaacatcatttgcagggttctttcaactataccatacagcccttttcagtgtgtgtgattactgtgaaaaaattaaaaaatataaaacatagttaataacataaggcataaaagaatgataaatttatgttagctcaaccatttactaagggtcaaggatgtcctcactgtttaaaaaaacttaaacgctagtaggaaagacagaaatacagcatctatttataataccttttgatacatgtgaaaattaagaagtttgtttcagtactttagaaatacaatgagggaatatccgatctagcctggtccaggaaaagggaagaagactgaggcagcaggaaaggctatcaggaagtaaaccctcagggaagtgtgaagacttaagcaggttaatgttaactggcagagaccaggtagataaagacatggttttatttatttttgttttactgtttcagatagcatgccaccagtagaaagaatattagtgtttattatctacatgactatatttttaggcaacatattttttgtgcatcttatcactttagtccatttgcattactatgaaggaatacctgagactaggttatttataaagaaaagaggtttatttttgctcacagttctgcgggctgtacaggaagcacagtgccagcatctactttaggcaaggacctcaggaagcttccacttatagtggaaggagaaggaggagcaggcacgtcacatggcaagaaagggagcaagagagagaatgtggaggtcccagactcttttagttaatcagatctcaagcaaactaactgagtgagaactcacgttaccaagagggtggcaggcactaagacattcatgagggatctacccgctgtgatccaattatccccactcggccccacctccaacactggggactacatttcaaaatgagagtcagggggacaaaaaacccaaatcattatcagtgatcattgttcatttatttgtttcaaactctcaaccaaatttaagtaaatgggtcagtattttatcttttcatacatgtacaagacagaccttatttggtaacagcaacaatcctcacacatctctcttccttccttccaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatacgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcct

SEQ ID NO: 36389 - DNA, 9151 bp, Homo sapiens; identical to SEQ ID NO: 36388

SEQ ID NO: 36390 - DNA, 201088 bp, Homo sapiens
cgcactctccgtccccgcggctggcgcaggacctcactcgagcggagcgcccacggggagcgggtcgcggggcggcggcggcgaggaggaggcgagaaggagttggaggaggaggaggaggaggcgagggcgagctagcccagcggggtcccggccgccccgcgggccaaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacccgcgcccctgtgcgtccccgcgcgcctccgagcgcccctgtgcgccccggcccgcgccccgccggcatggacgtccatacccgctggaaagcgcgcagcgcgctccgcccgggcgccccgctgctgcccccgctgctgctgctgctgctgtgggcgccgcctccgagccgcgcaggtaagggcgccccggggcgcggggctgcgggatggggcgcgcgcagcccgggcgccgctgtcatccccgggcgccttcgcccgcagaacttttcttccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagttacagcccttcaaatcccgggactcctggggatggggggaatcccagaagcctgggcccccagcactgaacttcccccaggcactgtcactctaggctgagctggcgccctgctttccccagggacagcgtttcctgcagccttggtcacctaagtgttcgggggcactggggacccctgcagggtggtagacagccctgctcctaatcccacccccaaacttcttgatccctggaaggcagcttttcctggattcgctgctgagagatgggatgcgtggagcaaagccagagatgggcttgcaggcggggctgtgagtggttgggatgatatgcagatgtgggattccttctgccaagggtcagcccttagaaggaggcttgcttcccggggagggcgcttcaaggcggggactgtctgcgtccctgcctgggttctcgagggttcaactctccctggcgcagcttcctgacgggggagtttttctaggcatcgctcttggtagttagtggcggggtgggttttcacagactctcgaacatcagagcccccagccctggaaggtcccccgaatccttattgacaggcggggagatggaggctcagagctgtgtgctgccaggtcaggagaagtggcgggcagagcgatgggacggtgggctcagcgaacgtctggaccagcccgccgcctgccagcaagaatgcttctctctgcttcacgattggaagacaagtgggaagaatcattgtccgtgttccgcttgtcaattaaaacactcttttcctttttccctggcacgatcagtgcttgttgggctaactggatgagctggagtctgggtgtgggggctgccctggggctctgggggaggagccaggagcctggcctggctcccaggacctgggatctcatccctgggccgccaccaactctctcctgaccctgggctaactgggcttgtgtttctccaggggttagctgaaggtgggggacaacagaggtccccagaaaagtggagaggagaaggaaggtgtggtcagggactgtgccattgccgggggactaggccctgtctcagcgcctctggggacttttccccagaaactcaggagggagtccttcaggggaatcgtcaccctagacagctggggcagggcactgcctggggaccatgcaccggactgggcttggggttccatttccctccctgcccatctccccacctccacactgtctttttccctctctggttgccctcgctaatcgaagtgcggctcgttggaagtgggagtgaggatggcccagagcagcaggctatggagttggacattttgcttttgtcagaacagacttttagaagcatgtggagagaccacttttcttagtgagttttgccaacgtctctccacctcccagggtgggacctatttggaagtcatccttcgagcatggccagagggggcggctgtccactggagatgcaggcgctggggggagggggcggctgtccactggagatgcaggcgtggcggggagggggcggctgtccactggagatgcaggcgctggggggagggggcggctgtccactggagatgcaggcactgggggaagggggcggctgtccactggagatgcaggcgctggggggagggggcggctgtccactggagatgcaggcgctggggggagggggcggctgtccactggagatgcaggcgctggggggagggggcggctgtccactggagatgcaggcgtggcggggagggggcggctgtccactggagatgcaggcgctggggggagggggcggctgtccactggaaatgcaggcgtggcggggagggggcggctgtccactggagaggcaggcgcgggggggagccaccagcaagtgcctgctgtcttctccatcttcggatctgccagatgttttctgagggttttctgaacacagttcttttgcctgctttcttttggccaagtgtgtgaaggaatgaaaagtaagattgcatttggggctgctgaacagtgtaacggggaaggagagtatgggaaatgaaacatgaccccaatatttggaaattgaggtcatctcctctacacgccattggttgactccagtcacgtgattgctttttgcaataatttgtggggagagtcggccaagttttgtgagacttgacaggtatcaaatggttaaatttcctctgactcaatcaagttggctggaaagacatccttttccatcctctgccccctccctccctctccccataaaagagcagtgagtgggaggagctcagaagccccaagaattccccaagccctctccctgctgtggtccagatttgccggaggggttggagttttggttgctacccagggctgtgcccacccagcagtgcggcagccccaggcaggggcgtgctcccagtgccaggctcacagtggtttctccagtgatgttactcctgggctgctcctgcggggctggccagagcctgctcttcaccccgccctgcagatatttctggactccccaccgccacgcctcagccgaacacagctggtgctgcccgtcccgccctgccttctcgctgcctggcctgtctgcctgccctgcctcctccctggaccgccccatcccacctcctgggagatagaccttgataggtggagtaggggctgtgcagagcagtgagctgccccgctggagggcgaggatgagtccccaacacttcccgagggcacccacataggagcctgagccaagctgcatctggaacagtgcaggacctgtccctgctcggtcacgtgacgtggctctgggaatggccttgggagacaatcacacatgggaatggaggggctggcacttgcctggcctgtggtgagcatcagctgcaccatctcactgcaccctcacccgggcctgagaagggacagagcctaggagtcagggggcagggatgccaggcagatgtcttccattcctgctgtggggccctaagccagcaacggcccttcgcctggcatggtcactctttgacttgtcacagttccctcttctcacttcccatcggtttatcagctctccccggggagaaggccagggccctgagctatagtcctggcctgggggcccagtccaaacagggtcctgggagcagagccattccatttggccaacacagcttttaagttcctttctttctccttccccctccatccttccctccttccttctttcctccctctcttcctccctccctctctcccatccccttccttccttccctttgtccctccatcccttctctttttactccagtgccttcaagagggatgcagcagccacagtctccaccacttcccaggcctctctgcacatcagcataacctgcctggaccctgaaggcttttgccttttcacctgggtcgggcctatcttggggagaccgaggcaaatgggatgggacccctcgtttccttccaggagctcacagtctgacaggcagaccattgtgaattttactcagggccctccatgggatgtgctgggtcttgcatccgacagtctgggagggttaattgcactggggagagctggggagcttcctggaggaggtgatgtgaaactggccttccctccttctcttctccttccttttattgcagaaatgaccctccttcgtggggtcctcctccacctctggctttaatcttgctctcttccctccttctgacaggacattccacaccgtgtcccagagctctcctgggcggctcccttggctggaaagcccctcattcacgggcttggcaggtgctcccagtatctgtttgccaggagaatacaagtgcccctaagggaagtggcagatcctggcagcttccttaaccctttctctgcccccgttcctcctgtttccctttgacgagccctgctggcctggcacagtgagcccagtctgcacagctctgcagacagctccacagctgtggattaggatgtgggggcctctgggggtgattttgggtacctgtgctgggtgacaggtggtcggatgtgggaggggacattccttggcaatcagattactgaactccaggccagcaaggtcggtgtgaggctggagctgagtttccctgcctctgaggggctgtcggatgggctgggcgaggacaagtcactgcacctcagcttcccctcgtgaacatggggagaaccacatttcttgctttgaggcatggttgtgaagatcgattgaggccacacctgtgagaagctttgcaggctgcctgacctgtactcggcactggctgtgtggggacgttaccatcgcccccatcttcagtggtggttttgcaggaggaaagagcagtgttcccacagccctctttagctcccagaagcacaggcgagggaggtgtgcctgtgtggggcctggccctgctgagacccctggggctctgctgttgcccgcttagccggtctctgctgcccctttgccttccttggcctcggttctttgctttcccacggaacctcatggggtcattgtccaggccgtggggtgtgatgcatgtgaaaagctttagaagccaattccagggtttgcactcatgtgtgcgtttgtgtgtatgtgtgtcatgtgtgcgtgtgtgtgtgtgtgtgtcaggccgtgtgcacgtgtggacaatgtgtatatctccccgcgatctgcctgcacacatgtgtttgtgggtatacatgtgtgtttgagtgtgcacgcatgcgcatccttgcacatgtacctgcgttcacatgggtgtccctggctgactccacgtgcagggcctggtgtgtttgaggagctcgtggcagggcgacgtttctctccttaccgtgacccggccccagctggacgggagaggaggagatggcacgtggaacctgccggttgagcgtgaggctgtgggttctgccgcagggcaagccgggtccagctggatccgacaatttcatgtctttttaaactcccgggagggcgatgttacattatggctcccgcttctcctctatttacattctcccatataattgactcgtctgctctctctcagtgctttgccaagtgtcggttttaaagtttctggcctggctggtggatgtgcctcgatcctgcaggcggagcccacagcggcccttgtggtggttactactgagtgtcaatttgattggattgaaggatacaagtattaatcctgcgtgtgtctatgagagtgttgccaaaggagattaacatttgaatcagtgggctggggaaggcagacccaccgttaatcgggagggcacaatctaatcagccgctagcaggtgtagagcaggcagaaaaacatgaagagacgagactggcccagcctcccagcctacatctttctcctgtgctggacgcttcctgccctcgaacatcggactccaagttcttcaggtttgggactcggacttgctctccttgctgctcagcttgcagacagcctattgtggtgggaccttgtgattgtgtaagtcagtacttaataaactcctatatatatatatataatatatatatatatatttctattatttctattcctattagttctgtccctctaagggaaccctgactaatacagctctgctcataggcaggactgcaggactgcagccaccaggacatggcatagggaccagggtggcctgctggcaaaggacaggcagccggcaagactcctggattcctatcctggctccagtgtctaccagcagtgcattttcccaccctgtgcctcactttccccatctgtaagaagggggtggtgactgtaactacagtagggttttagtgatgtctaatgtattactcatataaagcacagagtaagaccccattactgcccttgccaccaggggccccagtgcagcaggaggctgtgaggtggtttggggccctctactcgctggcctgtgcgtgctcccttgccatcctgtgtggtgtcacactgctgcttccctcactgggtacgcaggagaaaaggtaaggcagtaagcaccagtggtcagttcagcggatcgctcgctgctcgctgcctctgaggctctgagcctgagccaggaaggtgcatccttgggcagtcgcgggccaggccaagttcagcccgcagagtggccctcccctgcctcctctggccacttgctctttacaaggaacggaggtccaggaggtggatggacctgtgcacctcccagctgcaggcctctgttctgtctctgtgatgtgatggcggtgagtggtggctgatcactgaaaggaggtgttccaggcaggggtgggtgaagttggtgcgggcggggtgtggggggggctttgccatctcagatgttgtttttgtgccagcccagccccaggccactggagagaagaccgtggaatgaatgaattggtggctggatgctcagtggaggggtgcgggtcactttgagttatccatgtcagatagtccgagccgtcacaccctcagcttcctatcagcagaggagtttttctggaggaatctcaaactaggtaataacctcatattagcagtaaatgtcaccatcctttgatgactcagacctaagaaatggaaccacagcctgacccacttttctcaaaatttaattactcagagctctggggacatgggctcagcctatttgccgagatgtctctgcccatgaaatggaagcttcctttattttctgtttcctagacccgtgttcttgtagggaaattagctcttctgtccttttcttccttgccaggacctcggcaatagggtttctggtggcctcttttttttctgtaaataaatgccacaaaatgacataaaaacagtgtggtgattcctcaaggatctagaaccagaaataccatttgacctggtgatcccattactgggtatatacccaaaggattataaatcatcctactataaagagaaatgcacacgtatgtttattgcggcactgttcacaatagcaaagacttgcaaccaacccaaatgcccatcaatgatagattggataaagaaaatatggcacatatacatcatggaatactatgcagccataaaaaaaggatagttcatgtcctttgcagggacatggatgaagctggaaatcatcattctcagcaaactaacacaagaacagaaaaccacaaacaccacatgttctcactcataagtgggagttgaacaatgagaacacacggacacagggaggggaacatcatgcaccagggcctgttggggggtggggggctaggggagggagagcattaggagaaatacctaatgtagatgacaggttaatgggtgcagcaaaccaccatggcatgtgtatacctgtgtaacaaacctgtgcgttctgtacatgtatcccagaacttaaagtataataaaaaaaatttttttaaatgtgtgtatgtagcaggagtgacttaagttgaaaaactctgacccttgcattgggaaacagtgatctcccagtgagaacacatgagcatcgtaaccgtcttccattggaagcgaccgtcttccattctgctggcgggtggcctgggggaccagcactctttcccgtgtgtgggtacagagggaacagatggggtccatatgcaaagacattgggtgtgtcagcaggtttgcttggcagcatttatggacccctaacatgagacggacctgtgcggggggcacaggtgagcgataggcgagccgtctgtgccctactgggtcttccgctgcggcgggggagtcagccatctgaacaggtggttttacccagtgaggtgcagtagaagtgggagtagggtgtggccaaggccagtctagggaggcacctgccagccccatggggcggtggccagtcagagaccagcctgcttctccagggccagccctttgggatgcatgcgcctgaaggcaggctcccattggtggatgcagagggcacgttcccgtgcatgttcttcctctggctcttgttcatattttcatatttacactggaccctgctctgagggtgctcccgtcagcacctgtgatcctcaaacccgcccttcgtgccaggtgggatcggcccattctgcagatgtgccagtctagctccttgagtccagctggcacaaggggatgaaaaccaccctccacgtcccagtggtcacacggcctgcatgttggtgcaggtccgtacagtcacatgcatggacgcaagcagcctctgtccattctcaaggccaggtgagggcggcgtggctccgctccctcctgtttgtttgctggcgccagcctccatggcagctgggtcccagtgcttcagaaggggagccatggccccaggcaacagtgcgtacctgaagcctctgcctcggtttcttcttcttcctttcagatgcataaaaatgcacatcaagcctgggcaccatctggtggcctctttattttttaaataaatgccataaaatgacataaaaacagtgtggcgattcctccaggatctagaaccagaaacaccatttgacccaacaataccattactgggcaccacctctacagaaatttcagaaacaattagccaggtgtggtggttcgtgcttgtggtcccagctacttgagaggctgaggtgggaggatcacttgagccagggaggctgaggctgcagtgagctgtgtttgtgccactgcactgtagcctgggtgacagagtgagaccctgtctaaaaaaaaatgaaaataaaaataaaaatgtacaccagagagcacggtggtctcagcttttccagctgtagtttcgtctttcttctggaggacagaggcccagccatctgcatcctcagcacacaattaggtcagtcactggggcctgttgtgggggtgacaggcaagcctgggtgtggggagagccggcccgttgcccatgggctctgcacagtgggtgggtgcaggtgcgatgacaggcgcgggacagaggggcccctggggggacttttctcgggtcctctgccttcccaccactgtgtccatcagggacattcccaggatctgtctttgctgctggttgtcttcccttgattttttgttttgttttctttctttggggatgatctgaaatcctcttcctgtgctatttctctgctcttcccctggggaaaggagagtgaggagaaagtgtcccgtgtccacgttcctgtggacgttccccttccttctttctaaggagggatggtgactcccagaggtattaaggaaaggagaaagtgacactgactcttctcagagcctttggctacagagtgttcccgcggtcgaggtggggtgaagggcgttctcgagggaagggtagggaacgatttctgactgcgattgtaagagctttctaggtaattattattcatgctatttagggtcataggtctcagtaatggtcgactaggtcaaaaagtactgcttgagcagtggagatactcagctgaaggttgagaacacacagggcgtccttgggccggtgtggcggtaacagtgagctggtgacagcaggcagacccagtgtaacacggctctgctgggtggggcaaggagatgccccaggtggagccatcgggagagggagagggggtgggagggcaggggagcgactgtcctgccagggatgccagtgtcatcctcctgcccctgaaacaggtggacatcatggcttctcagcccaggccatttggggacatgtggcaatgtctggagatgttttctgattgtcgcacctggggtgggggcagggctatcggcctgtagttgggggagtccgaggatgctgctctgcaccccacagtgcacgggacagcccccaccaaaaagactgacccagcccggaggctgcaggaatcgtgggatagaggaagcaaaggtgagattccgtggcctcaccccatggtcttctcatggctcattgtcagacaggagggagggcctcttcttaggccgggtccagcgtttctcctcatggtgtagaccagcagttcccaaactttaccaggccccagaatccccccgaggcctctcttaaggcacagattgtttctgactcaggaggccttgggtgggcccaggaaactgcatttctaacgaagtcagttcccagaccacgcggatgctggagcgtctgggggtgccacactttgcaaaccacgagtcgttctgcgtcctcgagcccagggtcttggatttcagcattaatggtggtcgtggggtggggagggcacctgccaggggagaagcgctggagagaagagaggagggtgtggctgttcctccacccatctcaggaacctcccgctttctttatggtggtccccgcttcacaaagcacccatggtgctgttcccctgcacacctggcagcggcactcactcatctccaaagcaaagaccccactatccggcaggtcttagggagcagggagaccctgggggtgggggtgagcttccagagaaggggtttcccatgggtttggccatgagattctgctgttgttgatgttcttattatgggaaggctcagacacagcgcagcaaaggtcgtgttctgcctggggccacagggaccagcccacagccaaccccgttccagccagaggccagcccacgcccccgcacccggtgattttgaagccagtccctgacatcagctgcgttcttcggtaactatttcggtctccgaaagaggaggacccctactccaaactcacctcagcttgctggccgtgtgccgtctgtgcgtctcccaagggcgcccccctcacccagacctcccctccatccgtactgtgctcggtccacaggaccaggctctgcagagccagggatctgtaggactgcaggtttatagggctggggatctgtagggccagggttctatagggatggtggtctgcagggctgggggtctttcaggcagggggctatagggctggggactctgcagggctgggggtgtctgcagggtcaggggtctctcaagctggggatctgtagggctgggggtgtgcagggccgggtgtctgtagggctgggagtctgtagggccaggcatctgtagggctggtgtctgtatggctgagggtgtgtagggctgggggtgtgtagggctggtgtatgtagggctggaggtgtgtagggctgagggtgtgtagggctggaagtgtatagggctggtgtgtgtagggctggaggtgtgtagggctggagttgtgtagagctggtgtgtgtagggctggaggtgtgcagggctgggtgtgtgtagggctgggggtgtgtaggactgggagtgtgtagggcttagggtgtgtagtgctgggggtgtgtagggctgggggtatgtagggctggaggtgtatagggctggaggtgtgtagggctggaggtttgtagagctggtgtgtgtagggctggaggtgtgtagggctgggggtgttttgggctgtaggtgtgtagggctggaggtgtgtagagctggtgtgtatagggctggaggagtgtagggctggggtgtgtgtagggctgggggtgtgtagggctgggagtgtgtagggctggggtgtatagtgctgagagtgtgtagggctggtgtgtgtagggctggaggtgtgtagggctggaggtgtgtagggctggtgtgtgtagggctggaggtgtgtagggctggagttgtgtagagctggtgtgtgtagggctggaggtgtgcagggctgggtgtgtgtagggctgggtgtgtgtagggctgggtgtgtgtagggctgggggtgtgtagggctgggagtgtgtagggctgagggtgtgtagggctgggggtgtgtagggctggaggtgtgtagggctggtgtgtgtagggctgtaggtgtgtagagctggtgtgtgtagggctgtaggtgtgtagggctgtagatgtgtagggctggggtgtgtgtagggctggtgtgtgtagggcttgtggtgtctagggctggggtgtgtagacctcgtgtgtgtttagggcggggtttgtagtgctggtggtgtgtggggctcgtgtgtgtagggctggaagtgtctagggctgggggtgtgtagggctgggggtgtgtagggctggtgtttgtagggctgggggtgtgtagggctgggggtgtgtagagctgggggagggtagggctggtgtgtgtagggctggaggtgtgtagggctgggggtgtgtagagctggtgtgtgtagggctgggggtgtgtagggctggtgtgtgtagggctggaggtgtgtagggctaggggtgtgtagggctggtgtgtgtagggctgggggtgtgtagggctggtgtgtgtagggctggaggtgtgtagggctggtgtgtgtataaggcaggggtttgtagggctggggttgtgttgggccgggcgtctgtagggctggtttatccgaatgcactgggtggccttgggctttagggcctgcacttttctgttttgtgcatcgatgtgggaggcagggtgagtccccacccgagggaggcggaggtggagctcagagaagcacagagccccgggaggcccccagccgggagggtggagggcggctgtgtcccatacctttagcctctcagctgggctgtgcagcgtcctcatgagcctgagctcagtgctgctaaggcagttcgtagcaccttcctgtgcctcagtttccccatctgtcaagtgggcatgagaataatacctgtctcacaggcatgctgagaggactcaggattcacatgtgtaaactgctaggaccaccacagctggctatggtcattactattactgtgtgtcccaggcatgccattggttcagaggtcacaggtggcccccatgaggtgacttgcaggagtctgctgagcccatggaattgagctgggcttgtgaaagtgccacaggagacaggaatgtgtgaccaggctggactcagcccgaaggctgtgggtgaggacccagagggtgccatgggtgctgtgcccaccaggctgtcctatggcacgtgggcttgtcagagcctctggcacctgcagcagggctcccctgtcctgccctccttgaatgtcctggcacagagggctggtaccaagacagcagctgcactgccattttgcagagggttggagttctctgggtctgtaaccctggcccggagttgcctggtgttttctgggattgactggaagcaaaggagggtgggcaggtccagcttcctgcagggtggggctttgcagggctcaccaccggatgccagaggatgccggagcttggagcctgggaccctcacagtggacaggtgcaggagccccggggccccaccttgcagcttcagattgagggtctgaggtggagcctggggcctgcggctcctcgtcctgcccgcccagtgcagcggcagtgaccagttgagggtactttgggaaactctgagcagaggagggtgggggcctgtgcctccctccagccctctgtccttctgcagagcctgtccctatcaccagctcacagtcacctcttggacttttgcaaagagagctcaggggatgaggagggaagcagtgattctcagggacaccgggagcttcggaggccgagagagcaggtttgaactcctggctgtgggatctccaacatgttacttaacctctctgatctgaggcagcttatctgcatatcagaggcaatagcaccacctacctggactggcagctgtgaggatctaaggaagcaatactggtgtggatgcaaagccctaggtgtgcccggtgtgcaggacatcgtcccgtgcagtgcaagcaccaggtgcactcgtggtattgataacgatgcctgctgcttttattgggatggtcgcagatggtatcatataattcttattagagatggctgttattttacatggctgttaatacggaggttgggaggcagtaattgtaacttttataaagtgtgaaagaaggactaaagctgctgtttgcagcttcaggcccagccagggacctcagaggatgctaaatggttggcacaaaagggccagaggttccaattggcagggcaaggggtgtacattatagataatatgggggacggggcagggggtgcactttatagataatatgggggggtgagacagggggtgcagtttatagataatatgggggacggggcagggggtgcactttatagataatatgggggggtgagacagggggtgcagtttatagataatatggggggtggggcagggggtgtagttaatagataatatgggggtcagggcgggggtgcagtttatagataatatgggggcagggtagggggtgtagtttatagataatatgggggttggggcagggggtgcagtttatagataatatgggggcagggtagggggtgtagtttatagataatataggggtcggggcagggggtgcaatttatagataatacaggggtggggtagaggggtgcagtttatagataatatgggggtggggtgtaggtgtagtttatagataatatgggggctggggtagggggtgaagtttatagataatatgggggtggggtgggggtgtagtttatagataatatgggggtggggtgggggtgtagtttatagataatatgggggtggggtgtaggtgtagtttatagataatatgggggtggggtgggagtgtagtttatagataatatgggggtggggtgggggtgtagtttatagataatatgggggtggtgtagggggtgtagtttatagataatatggagggtgggttgggggtgtagtttatagataatatggggggtggggtagggggtgcagtttatagataatatggggggtgagggctgtggaaccttcctctgtattcagttcccaggagcttctccagatgagtttcctttgcccgggggtgccaggcctgacggggaagggcagggggtgggacaggacctgcctggactcctggagaggactctgatgtcttctggggagggggcacagagtcagtggcctggcttatggcctgggggccgtttggcagatgaataagctcagacttagaaggtgtgggttcctggtgtcacaggctggtgaggagtggggagaccaggcctgggagtcctggcctgtcgggtgggcttcactgacgagggatgggccgggcacggagatgctgctggctatggcggactgcactcggagtcctgtcgctggggaaagcaaccctgcccgtctcttgccaccgtcaggggacggtgttcaaaactgggtcttttctcagcctcagtgggctggaggggtcccaggctttctaatgcaggggctttctgcccagggcaggctctgaggaccaatgttcaccctacaaccgtggtggtgggcagctcgcccctctgtgagcaggcagcacccacgctgggaggttctggaccccggcctccgcagcccataggtttcaccattaccctgaaaatctccttgctcaccagtgataaaggaaagcagctccgaagtgcagacacccgctccctctttctttccttttctggctgcccgggtctccagttctgctgggacagccctgggaggggcagcccaagccaagcctgcatgtgcccccgcccctgcacgtccccccgcccctgctgggcctgtccttgcacgccctgggccccttcacatgcatacgctcccacctccccttcctgcagctagggcctggccgattacaaacagctgcctagccctcaagcaggatttgcaggccccggagaggggctatagtccgagggcagtgtgggcctaaaggcatgtcgggggtcttaatggaagccgacgcccctcttgtaccctgcccggcttctgtcccctggagggtggcggggggtggggcaggcaccctgtggttgtgcggagagcagctgggaggctctggctccaggcctggaggggaggggctgctgggctccaggtgggctctggggtcctggccctcttcaaggtctctccggagcccggaaactgaaatgtcagttaaggtagaaattcacatgagacatacgagggaggggttcgctgagacttttctctgcaggtgaagagtaggactctctgggacttgtcttcttctgacctgaccccaagtgccttcacactgtgttttatcccgatggcctctgtgtaaggcaggaggtgtcatcccattttacaggtgagaagcaggctcagaggccctgcagctaggaagtggcagagttaggcctttaaaatagcctttgaggccgggtgtggtggctcaggcctgtaatcccagcactttgggaggctgaagcgggtggatcacaaggtcaggaatttgagactggccaatatggtgaaaccctgtctctactaaaaatacaaaaaacttagccgggcgtgatggtgcatgcctgtaatcccagctacttgggaggctgaggcaggagaattgcttgaacctgggcggcagaggttgcagtgagccgagatggcgccattgcactctagcctgagcgacagagactccatctcaaaacaataataataatcataatcataaaaaagcctttgagttgtgggcatttgattctgtccagctgcttgggaacatgcctgatatgagtccaggccttccgagagtgccaagtagccaaggaaggtggggttttggtccctatctgaaggacggttgcactttttttctttggggtcttcatccctgcagtaggcactgagagagaggagcaggaggaatgtgaagtccggtgaccccaccaacaaccctctgtcctccctgccctcctgcatcaccatggccctggtggcgggtctcaggagggagcggggccttttggatcctgtcactcagcagcctcttccaaagcccacagagccgtgggctccacaggcgccccgagtaccgtcctcgatgagatctgcggattagatctggagcctgtgcccagctgtgtgtgcactgtttgcttaagggggtgagctgccctggtctgagtcagtttttccattttagcgggaaggaaagagtgataggggaggattatcgccaggtaggtgctgcctgtttagtttcagccgacacacggccaaggagaaatggggcccagcaagccagatgctatagcagataaggcgcaggcgggccaggggtagaaatggaccagatgtttcaggaactgagctggaatagcatcacaaaacccctcctgggtcagggacctgggccacgatccacatctttaaaccatcagcatttcagaaaagaaaaatgcaaactctgagagaagcagtgccccaggcctgatttccaagtccaccctttatcctattagcagaacgatgtgttctatgtgccatgagagtcctcaggtttgccaaggaccaggctcaaaagagttttactcttggttttcacttaaaatggaccatgagtcctaaagaattgtcaaagtcctctgaagattcgctacctgggtaactcacctacgcctactgtatgccccagacagattctattaggaaaagttaggaagtttcaatttattagaaaccagtggaatagagatgctgctgcatatgtggtcttaggcatttctagtttcaggtcacctcagtagccagaattcactgtaaacagtggtaacccaaagccctagttcatgctcatgacatcaaagcctcaaacttcagtgtctagctagagaccagtggtgggagtggtgcccctggaggttaaggagggtattgcatcccagctctactagacattgtgaaaacctaggcttggcctgggttgtactagagtactcatggtgcgacctcaaaaccataactttcttctgtgcctcagtttcttcatgtgtaaaatggagctgatgatgtctctctacctcatagatttgtggtgagcatctaaggaggcacagtttagatctctatagaaacaggcaaggtctctttgagttcttcttgcatctcagagtgcctgccactgtgaggtgctcagtgaatggtcactgggttgaattgtgagtgctttgtaaactcagagggtgctgaccagcccagagaattgctatgttttgaagtagctctctgaagtggggtggagagcagatgttagaagctgtgaaccatgcacctgggttcttttaggggaggatggaaggtaccagaagagtgatctcagcttaccacacccaccactggctggcagaggtggggtatgctgggtttgctgaccccaaagaggctgggtgggagaggaagccgagagttgcctagggtggcctggggagtttggttggggaagtgtcggggacactattctcggtgctgcatccagggaagctgcccatcagccttccttggattgggatctttgggatcagggattcactaattgtcccacatctgacattaatctgggctcagccatgtgttgctgagcttcacacagctgtttgcaccaccccagatctttcaaggggtccccaagcagatgaccagtttgcagcagggcgtgtgtgtgaggtacaggagcctccagtcctgtgggcagatgctgacggatgggctgatggctcccagcaccaactgctttctgtcggtgactttcactccacccaccagtcctgtgaggtcagtacggttctcctgactctgtgaggacgtgcccagttgacttggccaatagggagcagagctgagacttggtggctctcttagacgccagtgtcccctctgtgctgcacccatacccccctccccatgcaaccctgcccagcccactgcatcttcctgagagttttcccagatgtcacccagcaccttcttagctgtaatctctccaggccctttcaacctaaatgtctttaattctgggatcaatcatctcaccctataaatgactcccaggagctcttccagctgtgctccagaattccttaagcagtgccaacctcgctgttcctccgaccgcttcttccctttccagcccttccctccagcggcttctgttctctaggatgctaaggcgagtcccaggatggcattcaactggacacggatgccagtgttgtgagtgctccatgctgaaagccgccttctctggggcggttactcacgcagaggcgggaacctgactctgtgcctgtctgttggcttccgtaatccagccctccctgtgctgagtttaagcccaaatgaaattactgggctctaagtatgtgcctttctccataaaatgtgatgcctggtcaatatcttggccaaaaaaaaaaaaaaaaaaaaattcctctgaaggagggtagtctggtctctttctagtcacttgtgaaaatatttcctgatctgatctctgcagtcgtgtacgcggccagcacataactgcccccaggcagggccctgacttccaggccgctcagggcagctaccctccctgggatatgtcaagctgagggcttcgcacattcttctctgacaactcagctggtttccagcccagtccggctgcctccttcttttccactttgactttcctaacagcctgggaagctctgaagcctgtgttttcaggcctgccggtgccagtggagctggcctaggcctccccagcacccttcctgacccctacgtagatgcccagtgctgcctgccaaggactttgaatctctccagtggggacattccgcgctccttgggtgatgggaggctgagggtagaagtgagggttgatttaagagagcagcccagatggaagggcctctgggggttgttctccaccctcatgctctgcagcccatatctctcctctgatctctctcccggcctcagctttcacagctctagagtgaggtggggacatggacggctgccagcttggatggggacgggctaactcgcatgaaaccctctgggctgcaaagcgatgctctgaatctgttgttaattacatcttcctcgggccgcaagttctgcaccagagttggtcactctaaacctggggctgttagctatagtagaacctcatctgcctcgttagcagagaccgatgagtgtttgctgcacagctactgcctgctctgtgagcctccatgtttggaaatttactaaaaatactgcctttgcattcaactcgccacacatttctgtgagcatgtacgatgtcaaaggccctgtgggtggctttgctgagggggtggttgaagagaccatgttctcaaaatgaagttcgacgtttcctgaacaactgttctctgcacgttgctgtgctgggtgcatccatcggacgcagcccctatctggaaggagggccgtgtgggccaagaaagaagagaggatgcctggcctgacctgggctggccctgaggctttgaacacctgggctcctcatcctggagtcagtgtgtggtggccgggggcctgtcccagaacgtagcacacttctcctctctgctgtccccatactgtcctgatagcctaagagggtgaagggctggggctgggggagggagtgtggcccaggtgttcagaggcctcgggagtctgctggggaggtgcaaggaggccgccctggccaacctggcagggctgggaggccatgggcacttgaggggggaggataaatgtcacttgagcattttcctcctcctccagttccttctttaatatctatttttaatgaaaataatacatttcattatagtcattttggaaaacaccaaaaagtataaagaagaaaataaaaatgactgtaaacccagattctcccaaacccagattatgaatacagagaagaaagtacagagggaaatgcgttgtggtggcggatggggaacgcctagaccatccctaggcctctgccctgaggacttggacttggactttgtcatgccacattagagtgcaggcattctctttcattcacgacagctgtcaaaagtctaatttaaagtgtcgcctattggatattggggtggctccccctttttgatactgcaagggcaggggtgttgaggaagcttgctgtggcgggtcaccagagctgccaccaccggagggtgctagaggccttcttgggctctccagggggaagggaacatcttgggggtgctgggcaagcagcagaccccctgcccaccctcgggaatcagtcagctggtgggaaggcagagcttttgccctttaaagccagggcactggcagaaatgtagggtttggtaaagacagcctgtcatgttggctgggaaagacaggattcatcattgaactgggctagagtgttgcagaatccgtctgggaaaaaaagattggatcctgccctactcttctaccaaaatgcattccagatggatctgagatgcgaactttaaaaatgaaaccataaaactactagaagaaaacatgggaggccaggttttacagtcttgggatgggaagcttttccgagtatgacgtaagcccctgcagttataaaagaaaacagtttgaccccataaaagtcaagattttctatctggccaaaagaaaagcaaaaaaacaactggtcaccgtaagaagagaatctacacctatctgacggaaagggggtcgacctgcaaggaactcccactgatcagtcagaaaagtccagcaaacaaacaccaagatggccgacacacatggcaagttctcaggaaggaaaatacaggtgacttttaaacatgtgagaagatgttagactttactcacaaggagagaatggaggtgaatccccagggagaggcactgctccctcggccagatggacagagaacagaagctgagagtctgtgacactggctcctgtgaggggcagtgggtgttcccatggtgccttctctgaaaggcatttggcaatatctatccaagcattaaaacacatgtacttggccgggcatggtggctcatgcctatatttccagcactttgggaggctgaggagggtggatcaactgagcccaggagttcgagaccagcctggccaacatgatgaaactccatctctactaaaaatacaaaaactagagctgggcacggtggctcacgcctgtaattccagcactttgggaggctgaggcagacagatcacttgaggtcaggagttcgagaccagcctggccaacatggtggaaccctgtctctgctgaaaatacaaaaattagccaggtgtggtggcgggcgtctgtaatcccagctgctcaggaggctgaggcaggagaatcacgtgaaccctggagacggaggttgcagtgagccgagatcatgccactgcactccagcctgggcgacagagagagactccgtctcaaaacaaacaaacaagcaaacaaaaacacacatactctttgaccagcatctccagttcccagaatgtttcctgcagatatacgtgtgtgtggagaaccgctgtgcagcactgtctggaagggcgagagccgtttaggtgggttaccatgcagaacaaaacaagcacagcagctaagaagatgaagttttcatttgctgaggtacaccaatctccaagatatgttaagtaaagcaaagcagaatgaagaatgttcgtcgtaatggatccatctctactcaaagaaaagacacacaaatctaggcttgtctatgattattgaaaagggatgcatacaaattgggactcgtgtgtagtttctgtagagtggacggctgggtgcacaggctgcaggtctctcctgaatcttttgaaaggggttgaatgcgttgttgttcagcaggtgggtctttggaaggtggacagttgtgtgtgcacaacacagagcagggacagggacgtggggctggcggctctgggagctgagaacctttccagcaagcaagcagctggcctttggctgaaatgacttagtcaattaaaacaacttgtggtcttaaaaaataaaaaggccaggcatggtggttcacgcctctaatcccagcactttgggaggccaaggcaggtggatcacctgaggtcaggagttcaagaccagcctgaccaatatagtgaaaccccgtctctactaaaaatacaaaaactagctggtgtggtggcacatgcctgtggtcccagctacttgggaggctgagacaggagaatcgcttgaacccgggaggcggaggttgcagtgagccgagatcgcgccactgcactccagcctgggtgacagagcgagactccatctcgaaataaaataaaataaaaataaaaaaaggacaaagacaggaaacaagatcaacccaggcagaggctggattgactatatatgatcactcagtaatgctccgaaaataggagtgtgcccctgtagatgctcagaactgaaactgtcgttgccatccttcatccactcattttacaggtggggaacctgaggctggtacctacctctcctggtgtcacttagtaaactgggggcagagaaactggcacggggtccctgggctcagcacaggctcctggggccattctgctcaggcccatggccttcttctctggagagtggcttttggcctcaggcgagtctgtccagaaaggagaattctcttcttggggaggctctgggccttgggtgtcagtgggcatgagcaggcttcaggggactcgttctcaaaggcacacaggttgggctggccagggacagtcccagcctggcatgcgtcttcctcttctctctcctggatgactgagagctcgtgaaggtcaaggcctttgcctctcttgtttggcctcagggtggggtaagctagtttgtcctttctctaccagggggctccctcactgggggtgcctggaggatggagtgtggctagcccatcgtgacccttttcttctgccagcgggtatggggacacaaacctgggctggccttgattcagcactgagtctgtgagatttgggggagtagactctttgggactcagtttcttcacctgtgcgatagggtaaaacattttggtccttcattaaattcactattttcttctttcacggtatacatgttgagctgcctttgcaaaataactcacatctcctcgaggatggggatgacatgaccccagtgctgatgacagggtgatgacacataaccattttttgattacttcctgtgggtctggcattgatctctagacattatgtttcagtcatcgggcataatgacgagcttgttttagaaaagaggaacatgaaggaaattgccaggaaccatacgactgagagctgggaccttggatctagctgcttatggtgactttcccagcacagaacttctgtgggctcagtgcctgtcctgttatttgatgttcacccgtggaatggatgcacacacattgtaccttattcacaattggcagcatcctggccatgcatggcacctgtccctagcctatctggtgggcactggaggtttggaaatgcctccaggccctctcaggatcagtggctgtggaacgctgaccaccagggccttcttcagggagtcagagggacaaaggatgtgacagcatttgcagtgggatgggctctgtttggtcactggtgctcagcagttgatggcttggaagtggtgtggccggtgacctccagccctgccagcaccaccccacaccctggtgctcacttgtcactcataactgcaccatctccatgcactgccccactagggcctcaccttggtgtccagcagcagggccacctgctgtcgctaggcttatctctttccacatcacaggtatccttgcagtcttcctttctggctgattctctgcttagaggtgccccacctcccaggaagccagcccagacacaagatttgaaggtccttcacctggaagtcctcaggcacagacagtcatgggagggggtgacaagtgcctgactctaggacagggggctctgtggagcaatagggatccgttcatcctagaaaaggagctgaaatccctcacttcctagggcgttttgtgtcttgtttctatgcagtccctgctggaacatgacatttcccccaaacttcagcctctgctcttcctaccaggtaggctgagctggtctgttgtgttggaacacagagctgtgaggggtgggaaggagttgagacctgctcatccaccttttcagctgacagtgttgtggatgtaccaggcactttgggtcagtcatagccccaaatgtcagaagcaaaaaggtgaagtgtggtccctgctctcgagtcctgtgtcctgctgggattggacaatcagaagatcttgtgatccatgtggaattgctatcctgtaggccagaatgatcaaacattggccatttcacatggttcaatctaatgctataagaataaacacataggatggccactgatccagcatgaggcttaaggagccctttcagaggtagcaatgtctaagatgaggtctaggagatgaataggaattcaccaagagtgggagtcgggggaagaggaggattccaggtctgaggaacagaatgtgcaaacgcctgatcactgtgtgatcttggtctttgcgtgaggcatttagcttggctatcactcaacaccaggtagggtagcaggagagaacagcaagaaattgggtgccttaaatttagtttaaatcagcaaaggtgtattggtgtctttacccacccattcatccatcaatgcatccatccatccatctatctacttgtccatccataccattaatctacccatatatccatgtatataccaacccatccatctaaactataaatccatccaatcagacacccactcacccatccatccaactgttcttccatccgttcacctgtgcatccatatcattaatctacccatccatctgtccacccatttgtccatactccatgtgtccatatactcatgtacccattcactgttcatccacctgtccacccacctattcattcaaccaaccatccaactgtccttccatctatgtatccattcatccatccatctacccattcatccatcaatccatccatccatccttctgcccatccaatcatccatccttccacccacccacccatccatccatccatccatccatccatccatccacccacccacccactcacccaaccatccatcccatttatccatttactcacctatccattcatctactcatccttccatccatccatccacccatcctttcacccattgatccagaccatatatctattcaatcacccacccatccaccctcccttccacctactcttccttccttccctccctccttttccctttcacttttcctttccctttccctttccttttcccttcccttcccttccctttccttcccttcccttcccttcccttcccttcccttcccttcccttcccttcccttccctcccctcccctcccctccccttcccttctccttccttccttccttccttctttccatcccttcttccatccattcatctacacatccattcatccatccatccacttatccacccatccattcatctgtccatgattttgtcatagcactgggctgcctcctctaccatagcgattggcatttttgtgttagggtggtttacgaccatctcagacttccactgtctacactaggcggccaggagtggctaacttactagtttctgcagtgctttgaatggtaccagatacaactagattctcaagctgttttgttggcttgaactgagagacaagagaaatccagttgcagcagcagccgacggtacagtcagaatcatcatgaggtgctgagtgctttttaagagttatgagaggaggcagcctaccacgccggaggaagtggggatgtggaagtaaccctggctctccgcagaggtggggtgtggatgggaggggagaagtgaggagagcattcctgttgacagtaagacataagacaactccatggtgggaactgagaactgggaatttaaagtccacatgttcctggatattggcttatagattcagagacgcaactcattctccaaataactttgttaacttttcttgactctaaaaggaacgcatactcattatagtacatttgggaaatatcaaaatgactttattttcctttcctcacattttttctttgcatggttgaactcatgtgcagaaacggtgttgtgccctgcacttagacacagagattttctgatgtcattatcagctctttgtaaatatctcaacggctgctgaacattccaccgcatgtttgtatcatagttttcttaactgttcctctcatgttgggtttgggttgtttccaatcgtttgctgttataaatgacacttggatgaacatctttctgataaatcctttctgtctctctgattatttccttagggcggattcttagacattgactcactgcatccaagcatagggacattttaaagcctttttattgcagaattacattccaaccaacaggcagttgtcacctgagcaactgtgccccaggcagtgttatccttaggtgttaaacccaggtggaccccatgtccgagaactggggctgctcacccatgctaagccagttacttccccctctctgctcctagagaggcagtggggagctgtgatttaatgcttgggccctggtgtgattgtttcctgggcctgtggcacgtcttggagacccttttaggcaagcccccgggtcgttgtctggaggatggagcagcacttcctgctccacaggctgtcccgagaagctgaattactcttaagagtggaaactcacatgcatgtagagctttagacctctcctcccattgagtcagaaaatgtaagggaatcttctagaacccagcagacattcactagatgctcattactttcccctccttccctccctttctctggccatctgtgtgctgagtccccactgcggtgatggagtggacagctctgtctgtgtgggggttctgctgacttgcgggtcttctccccacctggtggctgcactaaacgcatgtgcctgggcctgccttccacactgaaataccacaaggccgggagggagctgatgtctggaggtggctggtagagaggtgggcctgggctgctgtgaggagacgtgaagtcggggcctgctgcagctttggggccgcagcctgactcagtcgtctggggcagcaggttggattcttgcagatggattttttcagtgtgaaaatgagctccatgtggccccacacacttgtgcttcacccacttctgggagggcagacggagctgttcagacagctcctgcgcatgagacacctggagagcccccagctgcccaccgcggaggggaccttgaagcttggctccattaacccactgggtgtgcagactcacaggggaacgtcagctccaagtcctgcccccagtgcaccaatgtgtggtgcatcctttgttgcgtctctgggatctcgcacagtacagttatgtgttcattcagggcccatgtagctggttttgagtccatttctagtgttttgaaaacttgcaaagctctcgtaattgaaaaatgcctctggtcccggggaagtaatgtaaaatattcctcccaaaggtcacagtgacccaccacaatgttcctttacttgcatcaaagaactgaataaaataatttcagagctgagtcagcagagccagagaggaaccccactgggctcacccgcagctctaaagtggctcccctcggatgggtgtgaggaaccacacatctggacgagtgcgtgaagggttgagtggacagagaggggctttcatttgtaactggaagtgtattccttttagcttcctctatcacgttgtctgttttgcagcatttaataggtgctaaaccatctcccggggccaatttccttgtatttctaaatctgcccgttgtaatgaaaccgtaaaggcaagtgctgtccgatgccagggctggggaagaacaatgagccaacaggcgcgtttgtcttttgtccacattccacagttttgtctgaaagggcaagtgcaagctgcacttgggcctgaccaagggccctgtgaggacacttggtgtgggggggcccacttcaaatgtcacactcctgggaagtggagacattcctgagaagtgcaaatgcagttttgttttataaaggccagttaaaaattgcccattatcaaggcaaaggccaaagatccatgactgtcttgcagcttcagttagatatggagagatgttaaatatctatgtacttaattatgtaatgcaatttcctgctagatgccaattggcatttattattccattcatttgttataaaagcaatatgtgtccatgatagaagtgttaaaagctaccaaaaagtataaaaaagaagatgaaaatgagtcataatgtcttatttgtttaaaccattatgatggtgatggtgatgattatgatgatgttaatgatgttggtttctattaagtataaccaaacacattactaaaggaacattttgatgtatttactttctactatttgttccatgcctgtatttgcaaaattgggattacatactactttgtagtagttttaaacttaaaacatgatgagcaaatctcaataaattaggaataaaagagaagcccctcaatttgataaaggacattcatgtaaaatccacatactaaatgctttcaccctaagatcaggaacaaggcaggaacgtctgctcgtatcacacctattaacattgtatggagatcctagctggtgaaataaggtaagaaaataaaataagaggcatattgattggaaaggatgaagtaaaactgtctttatttgcagatcacattagtgactatgtgaaaaaaattctaaggaatctacaaaataacttctagaactaaaaagtttagcatggcgacagaatacaaagtcaatttacaaaaattcattgtatttctagatactagcaatgaacagttagaaacaggaatttaaaaagctgttacaacaatattaaaaatataaaatacttagagatatatctaatgaaaatatgcatgacttattcactgatgattacaaaatattgcatagataaatcaacgaagatcttaagatttaaatgcaaagatataccattctcatggaccagaagactcaatattgttaagatattattccacctcgacttgatctatagattcaattcaatgtcaattaaaatcccagcaggctttttaaaaatagagattgataagatgattctgaaatttatgtggggatgcaaaggacctaatataaccaaaacaattttgaaaaagaagaacatcggagggcttatgctttgtgattttgagacttgctctaaagctatagtgatgaagacagtgtagtgttgacagaaagacatatagaccaatggaatagaatcaagtccagaaatagactcacatgtaaataatcttttggttttccataaaagtgctaagatgctgcagtgagccgagatcacgccactgcactccagcctgggcaatatggcgagactccatctcaaaaaaaaaaaaaaaaatgctaagatacaatggtgctgaaacaactggatatctatttgcaatagaataagccatgacccttacctcaaataatatacaaaaattaagatgggtcatgtatttaaaggtaagatttaaaacttttataaagcataagacaaaagagaaaatcttgagtttttttaccttgagttaggcaaagatttcttagataggaaacaaaactatgagccattaaaagattaaaaagctgataaatcagactttattaaaacaacaccttatacttttcaaaagacactgttggaaaatggaaaggtaataagattggaagaaaatgtttataaaacacatatctgataaagaacttatgtctaaaatgcataaaacatggtcacaactccacagcatggaggcaaatgaccccacttaaaactgggcagaagattcagacaaatgttccagaaaagaagacagaggcgtgccaacatgcatctgaaaagatgtttgtcagggttagtcattggagaaatacaacttaaaaccataaggacatactgcaaaagtgtgagtgaggatgtggaaaaactatcacccattcttggtggggatgcaaaggggtgcaaccactttggaaaacagtttggctgtgttttataagattagcccttcctttaccacaggacaaagtaattccatgtataggcattcatccaagagaaatgaaacatgcgtccatacagagacatgtatgtgagcactcatgtgctgtgttattgcaatagcctcaagcagggagcagcccaagtgcccacctggtacggggacaaacaagcgggaatactgcttggcaacagaaggcatgagtgcccgaacagggtggcacgaaagcactgtgctaagcgagagaagcagacacgaaagacgcaggggacacggttccatttatatgacatttgagaaaaggcagaactgcagggacagaaaaaagatgagtgaggagagagacataagggaactcctgggggtgatggacatgttgtgtatcttgatagtgtgtgtgtgtgttggatgagggtgtggagggtacagcactatccatttgtccaaactcattcaactgcacacttacaaagaatgaatttggctggtgcgatgactcacgcctgtaatcccagcactttgggaggccgaggtgggtggatcacctgaggtcaggagttcgagaccagcctagccaacgtggcaaaaccctgtctctacgaaaaatacaaaagttagctgggtatagtggcgcatgtaatccagctatttgggaagctgaggcaggagaatcgcttgaacctgggaggtggaggttgcagtgagctgagatggcgccactgcaccccagcctgggtaacagaatgagactccatctcaaaaaaaagaaaaagaatgaattttactgcatataaattatacctccatgaacctgacttaagccacaaatgccttgagcatttcctcacgtttcaatattcccttattaatactaataattattaataaatgaaataaatggtaatattaatgtaacattaaggcacagatgagtggctatggtattctgttggttgtacagagtgtactgtgatatgtgcagtcctctccagttgggacatctgctttctttctatgttttttcagtattgcatgtaattgttgggtgagcgttttgattaagcatttgtattcatctcaaattcagtgttaaactcccataggagcataaagagaatgaatgtccctcagactttcagtactaagtgtcaaactgtttcctgagaggtgtcaatttagactcctgtgggtactgaatgagaatttgcatccttgccaaaaattggtcacttaaaaaaaaatttgtgccagtttgatgggagacaaagtcctcttgatttaatttgtatttagctactagtaacatcgaatgttatttatttgttcccccctttttctagttgcaagaacatctcctgtgtatttctgttgtacacatcttgttgtttattgcctgttcttttttgttgttgttgtggttctctattgctgcggaacaatcacttcaatacctggtggcttaatagcatcctcttattttgtgtgtgaatctgcgttttgagcacggtttgttggggaccctttgtgtgctccacatgacttcaggttgagtggcttgtttggggctgggggatccatttctagatggcttttccacatgtgtggtgttgatcctggctgttggctgagggcctggggttctcttcacatggagccctccaaggggctgcttgagcttccccacagcatggtgtcttggtcctaagaaggagcattccaagagacatgggagtagagtctcccagtttcttaaagcctagacttgtgagccagcagtgttgcttccatcacgatctatcagtcaggtggccacaaagcccaccttgatttaagggaggggacatagaccccaccccttgatgggctgttatgttagatactttgtggccattttgaaacttccacactttaaaaattttgttttggcattttttttttgttaacaaaattatgccagttgtatgtggctaagtatttacacaatttttatgaagtggagggatatagagaatgataagcagaccttccccttcactgctccaccaaacctcagcccctttccagaagtaacccctcaactctctgatcggtattgttctggacttactggtgtgtgtatttgcatggtgttttatcagatgacattgccatcttttacttattttaagatgaaagggattgtgctttataaggatttccatggcttaaggacatgttgggccatctctccatctcaggccgtctgcatgaaccccttcctgtctggcctctgcagcatatttggcaaatgcagctttgttgatttaaccagttcccgattgatgggcatgtgctttgttttcagttctttgctgctgtgagcaagccttggatgtcctggcacagagcaagcctttctgtaggattcagccctaaaggggggcatggcaggtcaatgcatgtgtacatctgcattgagatcctgcaaaattgctgctcccgaaaggctccttcttccactggcattcgtcttggagccacgaatgcacagttcctttgtttgttcattggttgatttgttcatttagtccctcctttatttgctggtgggggtggtgcttcattgttcacttattgtcccttagttggtttgttcatttgttccttcatttgctctttggttgggtcattcctgcatttgttcactggttggtttgatcatctgttgattggttcctttggttattttttcctttgtttgctcattggctggcttcctccttcttccttcctttgagcgctgtaccaagcatctgctctgagctaagctctcttctctgctgtggattaagggcaagacttgtcccttccctaaaggagctcacggtctgggaaatagcaagtcccttggagcacctgctgccagtcctgggcttggggaggccatggagtgctctggttgtggtttgctggggagacacagaagaggcagggacaccaggaagcggcggtccatcccctcgtgattggtggcagggcctctcatcttccttgagcttcatgaaggaacagtgtctctgctggatgctaccttgaatattcagaataacttacttgagagtgggaagcctgaaagtccagcctttttatccagatctcagctaccagtcatggcttctcggggaaggcaggccctggtattacacctcctttcctgcaggggaaaaggctcagggtggtggagctgcccttggttctcaggtacatccttgtgctgggttccactgagcatttcaggacagcaggagaggtttctcactgccttctaaatcccgaatctgcccacacaggcaggaatccagtgcatccagtagagagaggccatgtgcaaatgctcaggttcgtggagccaggctcttgcccctgatgctgaaatgataggagggtgaggtttatcagcgggatcttcggggtgatgacattccttcccccatcactccttggcacagccacccttcatccagccgtccctggggccattcttcaagcgcccttttccatcctgtagtgagccatctgtctatatccatccctccatcctttctcagtccggccatcttactccctgttcctccttcatctcttcacgtgtctgtgtgtctgtccttgagtgagtgcccagctgcagtgtgtggttgagacagtggatgcgggaggactgtgaataggctgctttctccacagctgcctggaacgccccatggcatggttccacgggaggggcatcttctgcctggcccttgttccaccgctgggggtctcaagattctctgtcgccccatagcttgggtatggagggcctcctctccatgcaaggcctcctatggtcctgaacatcctgtgaagaacaattccgctcttcctcggattgagcctcgctctgccctcatcatggccccagtgctctccccagcgtcactccctccgcagcagggtatctgcaggggtcttggaggcattctcccagcttgcagccccatggtgcagaggaaagattttggacccaaatggatgctgtctgaaactcaggtggtctgtatctctggtggtctgtggctctgaagccatgggcagcttgctctacctctctcacgctgagtttcctcatgtaccagtgaaggggccgacactgtgggccaagttgatgaataagggaagtgtggcagctgggcgcagagcacataacaggtgcacagtcctcagctgcccctcccccatggtgctcgggtgcatggatggtgcccagggtccagtcccccaacaacaggctcattgcagtggcctgccgccccggtgtgtgtccctgactcaggggtcccatcggcaggtgtgttggctggtgccagccccgggaagctgtctgcatccctgcagggcaagcacctgcttctcaccacctgctgctcctccatggtctcttcagagcctgtttttatcctggctgctgtcattcctgagctgatgtgcactcctgcagtgagcgacagagacccccatttccttccctgtggctgggcagctggaccacccaggatgacagcccaagtgatccaccaggactctcgcagtgcagacaaaatgaaactggccctcgctggaggaacgggtgggccgggccctgggtgaaggggctggagctaaatgccgttggaactgggtggcccctgaagtgtctgctttttgccaaggcagagcctgggaagagggagcagggatcaggctggttggtgttaccccctgctggggggcaggcgttagatctgtgcagggtgaggctccgaggcttgctgggtcagtcccattcagtggctctgtgttggggtcacgtggtatctgccctctgttatccgagatgcctttcaggccttcagttctcatcaattctcagttcatttggagcctcctcttcactacttgacacccttaaagtgataccctgccatcagcgctgggaaactgatcatccttttcttcctttcgctctctgggcctccttgtcttgtgtcttgtgtggaaagagcagtctccgaggccctaacctaccaccccgcagtccctccccgatctgtcccctgcactgtggggctggctagggggcactgccgggctggttagggggcactgccgggctggttgggggtactgtggggctggctagggggcactgcagggcttattagggggcactgcagagctagttgggggcactgcggggctggttagggggcactgtggggcttcttagggggcactgtggggctggttgggggcactgtggggctggttgggggcactgcggggcttcttagggggcactgtggggctggttaggggcactgtggggctggttgggggcactgcagggctggttgggggcactgcggggcttcttagggggcactgtggggctggctaggggcactgtggggctggttgggcactgcggggctggttgggggcactgcggggcttcttagggggcactgcggggctggttgggggcactgcggggcttcttggggcactgcggggctggttagggggcactgcagagctggttacggggcactgtggggcttcttaaggggcactgtggggctggttgggggcactgcggaggtgccccggtgctctccggtggtcagatctcaggctcctgccagccagtcccctcgcgaggccccactgccaatatgtccctcttacagataatgacaggcagcctctgggatgggacccactttgcccaggaccatggggcttgtacatggggggtttaggatccaagtcagtccaccccgggagtggggtggtgccgggtcaggtgggcctgtgcctgtggggagggtggtctagtgtcagacacagatgagccatagatcctttgcacagagaatctcataataagcaatgcagtgagagcagtgacactgtcatcttcaggaaggactaccccggaggccctttggacgggcccttcattcttcagcaaggaatgatgagctgggagccatgaacaagcgcagtgcctctgggtacctcagagcccactcagggcagccatccaggcgaaggttaacatagagcctccaggcccggctacaggccattttctcaccctgtgaaacactgcgggtcggtgcacaggtgtctggatgtggacttagctcagtcctgaaggctctgttgacagacaagctgggcaggtgggcagagtcatttttacaaaggttggtggcatggaggggtggggacagcaggccccttccaggtgcgagctccctgcccggcacacctgtacctgttcctccatgacccatggctgaggacaccaacctggtccccgctgtggagggcggagctggcatcctgactagccctggtcagttccaaactgctgctctctgctgtaccatgtccggtgaggtcctgaagtgcaaaaggccttgaggtggggccccaggggcttggggagggtggccatgctgtgcactgcacaaccccagggagcgctgttctaatgcaccatgatggggtcttgcaggacggtgacactggtgaggagatggacctgtgacagccagggcctcccgggaaaattccacaggggcagaaggacgggtgagggccgggactttgacatcaggcagaggagttggacgttgatgggagcttttaggtgggtgcatggaacctgctttggcgaagtggcagtgagcgcagggacaggctgggagtttgggctcaggtctccaggtctccgcctggcactgcagcctcggggggcagcgggagaggccgggccatctgccatcctcccaggatggtgtcctcggcctgtgctgcagccccaggccctctgtgcatttcccaccccctgcccctttgctttgctccctggtttagtcattgaggaagaatttcagtcgcagcctccagagcgcctctgtttttcgacctgctgggttgacctcactgatgaggccgcctgccttgcagggagggctggggtgggggggcctcagccctgggccagaccctccctggtggctcgatggctcggccctcagcccggcccttcaagaactgtggctctctggcttccaggaaatacaggaagggaactaggagggacagccgcccttccccggctctgcagggccctttacaaacagagcaaattgatggcttcgtgaacaatttctgcgagcatctgcgggtgccgggctgtgcggggcccctgccctcctgcagttcacagcccgtggaggagacacacgctgcccatggaacacacatagcagggatatggttccagtgatggggccacgggtgggaccggaatggaggctgccagctgtgtctggagaggccagcgtgtgcctgtggtttcgggagcctgtcactggctccagagtggaatagcgcttgggactggggtggactgggcactgagggtgactcccttgcagccccagcatggcaccagcctgcgagtgaccatgctcacctgccctgtacctcgattcctctttcccaatgaaggctcttagcccagatgctatttatgactcctggctctaaaattagagttctagcccgagaattgtgaagacctcaagcttggggttatttagagactctcaagtttttcttgaagttaaggatattgactttggggcctgcagaaacctcccctctcttcctcgctcttcctctctttctctctctgtctctccctctctctttctgtctgtgtagctctctctctctccctctctctccccatctctccctccctctctctctctcttgctctctgtctgtccccacagctgccttccccgaacccctgatccccagctcattctatcaagtccaccctggtcccttggctgtgcaggccacagacatttggcaggacgtggcctgggctcagtgtctgggaccgtggtgctgagtgtttggcggtgacctctggaggacgggccggggagctttaagggccaggcagaaatgctgccctgttcgggctgggggctggactgggtgtccccagagccgacagcactattcggctgggtgccagggacccagcctagtgcctcgccttcccccagccatgctgcctggaggccgggtcctgagcggagcactctgtacctgtgtcacccaagagctgcggcttcctttagccaccacagcgggcatggggaggggactgtgcgggtgaacatggggcagagagatcgggctgggccagcacacttccccagagaccctgaccccaggaccgacggagccagcccagtgccagggacagagttggaaataaccttctaatgagataaggagataaagatgatactagaatcctaccacactgcctggtggggtgggggagagcctgctgcccaggaagggcgcaggaatcccggaggtcaggcaggtgggcgagtcagaactgaggggcactccttgactggaaagtaacagtgggcactgctccggctcaggggggcaccgggacgggggagctgaggaaaagtcacccccaagtgaccacgagtgaccaggtggaatctgctggtgtgttgtggttctggggccaggggagcatccctgtgcatttgttggcaaaaaggagcaggctctgatggatcgcaaatgcccagcctttgggagcggggactgcggccagcacatcatccggtggggacagacagcctgggcttcaaaggcagccgacccatagccagtgcttaaagatattgaacttgtttaggggaaaaaaaggaattagagaaaaagatccaatgcagaccccagcaggcctcgtaggagcgtgcgatcccacggcctcagacccggcttccttcctgggcaggggaggcaccctcccctctgttcacagcttgctcttgctctgtgagggccgccatgagacggtgacagcagagtggcacgccaggctgaagtgggcttttatttagaaaagtagaacggctgtaaggtggtcaggggtcacctcctcccgtggcagtgctgaggctacaggtcccctggctgcaggagtcctcgaacaccggcagagaggaaacctgtgtggccatcccgtctcacctccaaaccttctgcccttgggaaaaaagtgggactttcctcttgagcccgtcgcgggctgatcaccattcctccctggggaggagggccaggccagggagcggggaactgatagctgaggaggcccacaccactgcacccagagatgggcactgtttagtagcagatgttgggatctaactctacttggcgttagcataaaggtggatacaccagtttctgtagatgttcaggcacagcttgatccagctactcaaactgtgtggccagtctgtctctctgcatcctcttacaccctctcccaggctgttgtgtgtagaagctgtgggttgctcagtcgttcagcaaacacggctgagtgcccagtgtgtgtgggctcctgtgcaggccccggtcctgccctgcatgcaagggctctgttcctgccgccctttgatactccctctccatcagggcccaccccacctgagagtgggtgcttgtgccctgggagcagctcattgcaccccctttcctggggcgccggcacccggtgggcttttctggctgattgtcttttgttctgaagacccgttccccactggggagatgaggctctgaggtcagcacttggcagggtgcccccaagcgtctcccttcctcgaggctggcaggatggtggtgctatggagcgtccaggctcaggttccggattccattctgaggacacatctgcgtcactcaagagggtggccccagacctccactctccttcccgaaagcagcggacttctgcagcgtttctgttgttggtggagaagcgttctttcatgaggggccccacttccaaggggaggggctgctgagcctgagagatgctctccagcagggcaggctgtgaccgggccgaagttgcctcttccttgcttctgagccctcggaggagtgctcgggcaccagtggacgaccaggaactgatttaagttcccgctaaaagcagccatctcattccatcagctcctgtaggtgccggagccctgtacagatgtccagcagccccccaggtctcggggggaaacagagcgttgctgggctgggtgctgtgatgctgccctgccatgtcttcagccacctggctgccagcattcatccttctcagcaggtctgtgagcctcaggccttaaggggagcccagggctccatcctcatgcctcaccagctcagtttcaagccctcatctctggttctttgtgctgggccacattagtccactgctggtccaggccaggagcacctgggtgcgctgagcactgtagtccttgcatgaagtttcagcatctcatgtcctgcagctgtgtgatgagagggtggcaagccctagagtgacatggaatgcggttattctgggtcagctctggaggagcagagaagctgacctccatggggatcgtggaaatgcctgttggggacagagaaagttatcctagcatggttagtggaggcattgttattggctggtggaaaggctgacaacttagtgcagcaattgtaaaattgccctatacctcctgattttcaccattcacttgctcatctgttcactgattgatccatccactcatccatccatccaccatctatccattcacccatccatccattcatccatccatccaccatccattcatccatccatccaccatccatccattaattcatccatccatccaccatccatccattaattgatccatccatccatccatccattcatccatccaccatccatccaccatccatccatccatccatccatccacccaccatccatccatccaccatccatccattcatccatccatccatccatccatcatcctcccattcatccatccatccaccatccatccattcattcatccttccatctgtccatccatccatccatccaccatccattcacccatccatccattcatccatccatccaccatccatccattaagtcatccatccatccatccatccaccatccatccatccaccatccatccattcatccatccatctgtccatccatccatccatccgtccatccaccatccattcacccatccattcatccatccatccaccatccatccattaattcatccatccatccatccatccatccattgtccatcatccatccatccatccattcatccatccatccatccgtccatccatccatccatccatcaccatccatccatccatccatccaccatccatccatccagcatccatccatccatctattcatccatccatccatcctccatccatccatccatccatcatccatccatccaccatccatccatccaccatccatccatgcatccattcatccatccaccatccatccaccatccatccaccatcatccatccattgtccatcatccatctatccatccattcatccatccatccatccatccaccatccatccaccatccatccaccatcatccatccattgtccatcatccatctatccatccattcatccatccatccatccatccaccatccatccatcatcatccatccatcgtccatcatccatccatccacccacccatccagccaccatccatccatccattcatccatccacccatccatccaccatccatccatccatccactcatccatccatccattagccatccatccacccacccatccatccattcatccatccatccattcatccatctatccaccattcatttatccactatccatccattcatccgtccatcctgcatgtctgtgttgagctcctcctatgtgccagtgctgcagtcttgcttgtatttcttatcagggtctttgtgctgccttttgtggtgcatgacacccacgcagaactcaaactttcatttccaaattattctccttcttccttcctccttctccttctcctttttcttcttctttctcttcctttttttcgagaccaggttatgctctgtcacccaagctggagtgcagtgacacgatcctggcttactgcaacctccaccacccagggtcaaacgagcctcacacctcagcccctcagtagctgggatcacaggtgcatgccaccaagcccagctaatttttgtatttatgtagagacggggttttaccatgttgcccaggttgatctccaactcccgagctcaagccatctgcctgcctcggcctcccaaagtgctgggattccagtcctgagccaccgcgcctggccatcaaattcttttcagtcacctcccttcttccttaaaactgaccttgctggcgtccattcctttataggtctggggacctgatgcctggttatatcctcatgaaaatgggcctctgggatgccagtgacaaatacttctacttgtaacagtgcaggggatgcaggggccaacttctctaactctgatcaactcggggatggacaagaggtattccctgggcaagcgaggctgtgcaggatgcctgacccctaggtgctgggggtaaacacttcttgtagtttaaagattctgatgcccgtggccttgtgctgggcccatgtcccataggtggttccagggaggctcctggtttcagtgcacacagctgatgggagcaagccacgatggggaaagggattgaatgcagggagtcaggtggatacagtctccgggagacccggcgtggtggggtcaggaggccccactccactatcccatttggggttgcaccaccatagcgaggctgccacccagactgcaggaagttgctgctgccaatgccgcctggtgccctgaagctggtcccaggccgtggcatgcgtgggggtctggacatgaggatcacctccatatgctgtgtctggggatatggccctgctggctgtgccagggcggaggaggctgccacctccctctcactgtccagctccatgagtctctctgattggcagattctaatttgcaccctgcatccttatgcaaaggcacctgggaagtgtagtttttagctccccagactgcagagcaggatggtgcctagaggagacagggctggagcttgggtggccaaggcacagcaggacacctgctattctctgggacttcatccatccatccatccatccatccatccatccatccatccatcatccatccatccattcatccatccatccatccatccatccaccatgtgatggactgaccccataggtgatccggtcatggcgagggttccatggaatcaacaaagtttttgtttcatgaagctttcggagctggccttctgtgcatcagatggtcggtctcaggaacctctgggcacagctgcatggtccttcactaaagagtaggcaccgggctgggtgtggagaccacacgcgtgatgccatctcgtcttcactgagcacctgggctgctcggtgggtcctctgggaactgctggtgatgggcccctgcctggctgtctaggagaaaagggcaaaagagaggggctcttgtttgttgagccgggaagtgcacgggccagtgtgcggtggccactgttgattctgcagcttctctcactggccttgacccactgggatccaccctctggtggggggtgccactggcttcaaacccatgtccacctgtccccaaagcttgtgctgtgtccaagtggagttttcatcctgatggaggctggaagaaaagctcctgaaaggctgtgcgccaggctcctcctgggctctccccaaccttttctttttcaaaaagtacttaatgttttcctctgctctggcacaggaagcccctggccagcaggaggggtggcactaggcctgggaaaggtctggtggcctcttaaacttgttgcaacagagatctgcgaacatgtccaccaagcctgctggaaaacagctcttgccttcagcaatggagaaaacaggcttgcgagcctgagtctgggaagagcatcacgggcttgttatggtgtgagtccaggaagccccggccgggatccttgctcccctgccccggccgctgccagtgctggaattgagtcttagggatgacccagggctcggcactgtgtcatcttcagcaggtggaccggcagctggcgcatcctctctttccacgggctgcatccaggcccagggctgcgcggtgcagcctcaccaggcactggcactcagcgtttcttctcaagtcaaaggcaaaagcccaccaaagccttctttgctggggccaggtgggaggtgccatacatgcccgagggggtgacagagctgggtgggctgtgccctgcttggcagccgaaagccacccaggaaaacagagaggccatgagaggcctggacgtggggtgttctgggtccctgtgccgcccctcccctttgtcactgttcccacgccgcagtgggaaatcctcagcttctccatgtttctggcttcttgatttaattggcagaggactgcagcaaagccaagctgtagaaatgacaccgtcagaggcagggacttcagaaccctgggacctgggtactgtggagccttccagagaactgtggatggggaggggcttcatgaatgagaaatgcggcttcgatttccctccaccctggtctccttcagagccctgcccaggctgctgtcttccctgcactgtcagctggtcatggcgggggtgggggtggcacaggttcctgtctgtacctccttgtggcctgcgcaccaagcacagtgcccgcgctgagtcccctggagggacagggagtgctggggagacagagtcctccgtctgggtgctcctcttgctgagggcctgctgggacaagcagtgacactgcgccattgtctctggcagccacctcctcccgtggcagtgccgaggctgcaggtgcccctggctgcaggagtccttgaaaaccagcagagaggaaacctgcgtggccatcccatctcacctccaaaccttctgcccttgggaaaaaggtgggactttcctcttgagcccgtcgcaggctgatcaccattcctccctggggaggagggccaggccagagagcggggaactgatagctgaggaggcccacaccactgcacccagagatgggcactgtttagtagcagatgttgggatctaactccaattggcattagcataaagagggatacaccggtttctgtcaggcacagcttgatccagctactcaaacagtgtggccagtctgtctctctgcatcctcaggcaagcactctccacctgctcaggagacagttgccagcagctccaggttcctgttctgtgtttggagccagcagagcagggaggattcctctttctcaaaggaaaaaagccccaggacggagcttccttatcctggctggtctcacgtccatccctgagctgaccgtctgggacagggcggtgtcatgctctgattggccagcagagggggcacggccaaccccgtccacatctactgggcagggcagttgccggctgctgggttcctccaactcccaggccgccccaacacacaccattctgtcgctgtgatgccaacttcgagtttattttctctgccgggactcccagggagcctcttgctcgtgggcacaggagcagtgcttttcccataaaactgaccttgttcagggcaggttcctggattcgcgccttgtggtggatgcaggtctggggtcctcgtggtgtgggggaaggaggctctggcagatggggccgtcttttgtgttggagggtgaccattgagctccctggtaatgatcacggcttcagtggccagaggtcagcttatccccttgcccttccctgagagcccctggatagagggtcaggaaccttctggaagggatgcgggggctgcccctcccttgttcttggctctgcatggtctggcgatgtgggcaggggtcttccagggcaatggaaactgcacacccgctgtaaacggtcatgggaaggcgacagacagtccaggtggataatgacggggggataaactaggccagtgacatccccgtgacctctggaggggcctcaggtggggtgaaggttctcagggctgcagggcagatgttgtgacccaccggttctcctgtgtcattgcacagcacaccataaggcggtcagctccgcagtgggccttctgtggccttccagcatctgcctgggctgctctccttacgtggccaatgagaagaggtgtctgggaggctgggtgtgtggcccctgccagcctcaggagccacgagagcgcagtgaggaaggagggcgtcgtcagagctgggctagcccgggtctgcccctggtgtgtggccgctggtggggacagggatgggaccctctgggctagcctgggtctgcccccggtatgtggctgctggtggggacaaggatgggaccctcctccgcagcgtggtgccctgcctcgcccagcacgcggctctaagctggtcctggggctcttctgagtgcccaggattcacagtggtgggggtgggggtgcttcctgtcatcccagcttccgggtgttcccaggtgctcctttcctctccgtggctaactctgctcctcctctgtcatttcagctcagccagcagatctcctgaaggttctagattttcacaacttgcctgatggaataacaaagacaacaggcttttgcgccacgcggcgatcttccaaaggcccggatgtcgcttacagagtcaccaaagacgcgcagctcagcgcacccaccaagcagctgtaccctggtaagtgccgcacccttctgtttggggcggtgggtcccgttggccctctggcctccagccaggagcagcgctcaagcctgcgtggtggcagaagcgggctcagctttccaggaagcccctctcacgagcccggcttcgtttcactgtagtgaaaaggcagttgcaacagtgggattttgtccttctggacgggactgggctttgtcactgtccttctctgctggatgtgggtgggtgggtgtggcccagtgcccttgaccttctatcagctgtgtctctggtggtagctgggccgccaggactccaagggcagaaagagtcggatgggtcctgagggatgaggttgagagaaacctcggggtcgtgggaaaggaagcacttccagacagaagcttaaccaggggcagtgacattaagagacgatgaatcaaacgtcgtgactcctagcaagagcatgggaggcttttaatgagagtcaactgctaaatgccgggtctctgcttttaattacatgcccggagcgggaagcagcattagctctaagatacagcatccaagttgtccctgtcacccagtcgtggggcggcacctgccacagttaattaaaccctctgggcttatctggacgtgattaacgagctgttgatggagaacctcatcgccttgacccagccacttgctcatggcctggactaaaatgagctcctctttctgattcagatgagaaagggacgggggatgtagggcaggtgagttcactttatgagatgctctgtaattattagaagacagcgcagcatctttttggtggacctggaggtgaccccggcattgaacccacgatcagggcagtctttgaatgctccgtggtgtttctgatgatcgtgtccccacggggcccctgaaggacaccctcttttgaggggctgtttctgcttccacagacgtgctctctgtacactcatccccagccattgcccagccctcctttacatccatgtgaccttgaagagtttgtctctgagagaatctgggcagttcttttcaagaatgtttttgagaacgagttatttcaagaaacaccttcgaggcaccgagtctctgccttgcagcttggtggaggtgaggtgaagtggcctgggacccctggcagcccatattctcttaaacagcccacctctgggtaccagagtggccctgggctgtggatccccagcctcaagcgtgtggaactcatcggctcagacagcctgtccccgcaaaggactgcagcggtttcgtttctccaggcctctggaggagcgttcataagcttctgggagagcatctcttttggaattagccatggaatcctcacttggaccttggcccagaaattgcacccttttctgccccatgacccccggtttagaattcgtgacctagagatcctgggagggctggtccagggaagggcttagagagctgattgccgaggaccacatggactctgggtgtgtgacacgctgaggggcaccctgggaagtaagcgctcctgctttccaaggggatcttcagccactttgtttaatcttctctgtgtcacccaattctggggtgtgggcaccacacactcactggactttgtccttctctgctggattatcttgtggccagaaatattacagtatctcaggaatacgggctaattattggataaataatctaggatcagctgggcgcggtggctcaccctgtaatcccagcactttgggaggctgaggcaggcggatcacttaaggtcaggagtttgagaccagcctggccaacatagtgaaactccatctctaccaaaaatacaaaaattagctggacgtggtggtgcgcgcctgtaatcccagctattcgggaggctgaggcaggagaatcacttgaacctgggaggcggaggttgcagtgagctgagatcgcaccactgcactccagcctgggtgagagtgagaatatgtcaaaaacaaaaaaaaaggaaaagaaagaaatggcttggccttccagcagtttctgcatagcaggctctctgtgcctctctcagcagggaccccatccctgagcagggctcttatctacagatcagttggtttccatgtctgtttccggcttttaaccagatgctaggtgagcgaggttaccgtgacacagtgaagcagtgagccgagatcgcgccattgcactccagcctgggcaacggagtgagtgagactgtctcaaacaaaacaaaacaaacaaaaaaaccaacacataatctagggtaaatttctgaatagtctgcgggatttttttttaagtccatgtttttttaagttttccaaagtgcttcacttgctcttccagagccttctgtgaattagcttacagagtagagtgggtccacataagccaattgccccattcatggcagatgaagctggaggttgcttgggaagtattgaagcagggctgtctacggagtcccttctgcaggtcccaaagtgttgggttgggacctgcagaggtcccaagggacactgttggagaccagtgtcataggacatcatttgcctttgaattgacgccataccccgcctcgccccttccgcccggccctccgagcaaactcgccacctgtcctctgttgctcggactctgtccaccccacttggcttgtgggcccctcagtggagggactcagaagctcacttcaggttttctgtttgagaagtgctcagtgtgtaggggccacacacaggaaagggctgtttgcttgggaccgacacggtctcgcgccagccactcgtgtgggtcagcctaagcgctaggggagctggagctgcaccatgccctgtctcggggagcagcagcatctgcgggattctagagacccgtacctgcctggcagttgtagaggtagaagagagggtgcagcccaggtggccacggcaaggcctgggctgtggggaactgagtggagcaaaaacagtatctgtaagtatctcttggcgagaggggaagcccgcatccaggcagctgtttccccggcatccgatcccctgacaaaatccctgagcaggctccccagactccccgaagagctcacacacccctcggcaaatcagcagccaagtggccctggatcacgggggtgggggtttggagactgagctgagcaggtgactgggagcctccacctgggtgcagtgcccgtccccgcccaggccgcacaggcgttgacctctgccctccacccacactggcaccacctggtcctgtatcccccactgggcacgaactggcagagtgatctgggtgccagggagacacagccatgaatagaacagatggagcccggcctcctctggcctgggagagcgaggttccctaggccaccctcctcaggggcaccgccctcccttctgtacaggggaagaatcctgttcccattttctgcacttgggggcaggacagaggctagaatttcccccctcattcgaagagggttttctagtcttgctgagacccagcagtctgggttctgggatctgtccgaccagggagctcaaccctgagccacggttgctgaccgatcatgggtgctgggttgtcctggcaccagggagatgaggctgcagggactgaagcccaggactgtgacacaggggctgccagtgaagcggggagggttgggacttccttcccagtggggtcccaggcctcggtcccctgtgtctgcagtgcagacatcgcctcacggtgaggtggcctgagaccctgaaggcagcgggcctggcttcctcaccaggcggcccgagctctgggatccacgtccccactgggggcccgggatggtgtgctccctgccttgttgacccagcactgcttgtttgtaatgacccagatctgagctgtcccctctgaggatgaccaggcgaggcagtgtcccccctggtcacctgacttggggaccagccccacctgagcccacttcctggatcagcacgcatcctcctcctcggctctggtgctgtgggtggggtcctctctattttgtcctctgtaggtgccttttcctccgtacccctcttcagaccaggcctctgagatttgcctcctactcaggacacccagggttgggtggaggccacggctctgcccacacccccctgccccttggccaacaccctgtcttcgcctgtggctctcctgcaccctggggcctgggctccagaatcagcctcccttaggcagaatgtcctgctgcccctcgctgcccccgccagtaccttcctgccagagagcaagggagcagccagttgcgctgggccctgggaccctccacaggattgcgctgagtgctggacgagggtggcagggacggccgaacagggtgccagctgcaggggcaggctgacgtgaggggaagatggaggcagcggtgggagggtagtgtcctcagcctgggggctttgcagaccctctactcactgagcagatgctccccactcccctgtacccccatagagcaggataggggttccctgatggctgagaggaggggggtcccatgaaataagatgcggggttcccacctgggaatctacctggtgagactggagaccgtctcttcctcactctatcttcgaccccatgggttagtccagcccagggaatgtaaacttcacttctggccatgacaaatgcagtaagtttgggtccaggccagaaggttccagaaccaagttatccctgcaggggctgccagatggcagcttcctctctggagcccctcacctgtcccaccccaatgtgggactgagagcccttctggtcgggactgaagatggctggtgaaattccttctgcagggctgcctcggtgcccctggatcctgggcctctgccctgggcctgccatgctccccttagcccggcccctcctgggctgccagggtccagctgaaacctcagccgccccccaggttcctggccccctgtccaaagttagccacaccccgcattcatttcctatcctctgacctctttctgccaccctgccccactgccccctgcattatttgcaattattattattattattattgagacagagtctcactctgtcgcccaggctggagtgcagtggtgtaatcttggctcacggcaacctctgcctcccaggttcaagcgattctcctgcctcagccccccgagtagttgggattacaggtgtgtgccaccacacccggctaattttttttatatttttggcagagacagggattcaccatgttggccaggctggtgtggaactcctgacctcaagtgatcctcctgccttggcctcccaaagtgctgggattacaggcatgaaccacctcgcccagcctgcaattatttaactaactggtttggtttgatgatttctgtttgtatcgtgggagtatcactttctgaggtcagggaccatatctgtcctttgactgtgtcaccccagcgcctggcaccaatcactgtttattaggggatcagtcactgtttattgatcacgtgatccactgtagtgagcaatcggtatgcttagtaactgtcggctcagtatgatttagtttcaacacaaatgcatttattgtactcctactgcatacctaaaatgctctagtgcctttggacttcagcagaagtaaaagtgaaaagctctggccgggcggggtggctcacacctgtaatcccagcactttgggaggccaaggcaggcggatcacgaggtcaggagatcgagaccatcctggctaacacggtgaaaccccatccctactaaaaatacaaaaaaattagccaggcttggtggcgggtgcctgtagtcccagctactcgggaggctgaggcaggagaatggcgtgaacccgggaggcggagcttgcagtgagctgagatcacgccactgcactccagcctgggcaacagagtgagactctgtcttaaaaaaaaaaaaatgaaaagctctgagggagtccggagcccacccctcaactgtgacttttcttggagaaatgaaacatgaagtgttcgacagccgattccctcctcccagagtgcccggacagcgtagattataaagtatcagcgtcccagctcatgtcatgactcgaatgggccatctcacagtgacaataaatccattgttattttgccaggagagagattaatgttaaacataatttatcctttcgggttttatctgagctgagaaaatttgttaccatagagatttcaaaacttgagaaacggcattttaatgagctgcggagatgggggttcgtgggcctagcggtgccttgtgccggagacatgagtgtgcgcaactcgttctttgatcttttaagacggaagaatgactctggcactcagggtggcggtggggtggggacgggagccaggtggccctttgcaatgagagtgagggagtggactcagatggtgactgtgccatctgccctgggtgtggacggggacctgagtgcttcaggtgagaccccacctggccctcagtgccccatgcactcccagggatcacgtggggctgccatggtcctgctggcagccttgccatatggggtccctacggtgggtgggcatggcaggtcccactcccttgccataggtgggaccagctaaggctgtcatctccagagtcccccgcccacatcccctcatgtggaaggatgatgcaaagccataatcgcagcagtttgggaggccaaggcgggtggatcacctgaggtcaggagttcgagaccagcctgaccaacatggtgaaaccccgtctctaccaaaaatacaaaaattaatcaggcgtggtggtgtggacctgtagtcccagctacttgggaggctgaggcaagagaattacttgaacctgggaggtggaggttgcagtgagccgagatctcaccactgcactccaacctgggcgacagaacgagactctatctcaaaaaaaccccacaaaaaaacccaaaaaaacaaagctgatggcttgtgtctagacatgggagtcctgagccagttcctccgtgaaacctgcctttcccagatggccacactgactgtcatcacccccacctggggctgtccccagctttgggggcaggtgccttggccaggcccacctggggcccagtctcctgtgggaacagctgagtcatggcttggagctggtcaacacagggtgcccggccacagctgggcagccctgttccctgtcagtgccttagtgagagattcgtgactgcaggatgagcctgctgctgtggcagcttccagcgctcacgcaggctctgggttggcctgtgggggccttggagggtttgcctggagtagtggcccctcattttgcagaacctcaggagatctccctgcagcaccttacagaggatgcagaggctgtgacaggcagcattctcctcccccttggaagcctcaggatgctgtgggacgagggggccttcagcgtccccttcctcccagtgttgtacctgcagctgtgctggagtgaccaggggcagaggtggtgacgctgctgcccgccttgccacaatttcgccagcagagggtgctcatggatagccgccttgcaggcgctgctgccgcagatccagactctgctgccccatggggtcaggggcctctgggccacctggttagcctttgttcccacttctaaagaaggggtgggtctggtaatggattcacgatggctcaagcccacccaccagatcccagccctccgtagtggtgctgcttgtggggcggctccagcagcaggtcctgggccccccttccttggcatgtccctgttgacaccctcctgggacaccgctccttctggcccgttctgagcagcccacagccttaggcccagcacttttggctggcccaccggcatcaactagccacaggccctccatcagccccaggctcttggcagaactgcaggtggcccagggtgagagcatcgctgcctttgccaccaggatcgatggacaggaggggctggggctcccggtcatgcccacggatgaggggcagatatgtggagtgggcttaggtgcttgtggccgggccagcctgggtctgccttttaatgacctcaaattgctcctggcatgtgttgtaagaggtaattcctcccgttaacatactagggatatatttttttctaattttaaatttggattaaattcttttgatgaatttccactttttctctgttttgcgtatcaaccaggaaatgtcacaaagtacaattctagtggcggttcgaggctgttgcttcccttctcccttcctctctctgcttcctccctccgtctctctccctccctccccctccctccctcccttccttgcatgctgagtggtgtgacctcatggagcgtactaagacacctcagaagcagcctccatccagaggcagctcacagcctgagaggttctcctgagggtcaacacacagatgtgttaggcgcaggagctgagggcagggtgttgagggctcccagctggaaggaccagttgtgtttcatggaggagtttgcatttgcactgagtcttgaagggggcaggtttggccaagtgggagcagggaagggctgcaggagcagtttgatcaaggggcagatgtgcagcagatggcagtgccccacgacgggcagcacagcttcccagggtcccgggctggcttgtttgcagagagccatggctgggtgtggttgcaggggctccccgactgccttctcacctctgtgctctgttccagcgtctgcatttcccgaggacttctccatcctaacaactgtgaaagccaagaaaggcagccaggccttcctggtctccatctacaacgagcagggtatccagcagattgggctggagctgggccgctctcccgtcttcctctacgaggaccacacggggaagcctggcccggaagactaccccctcttccggggcatcaacctgtcagatggcaagtaagtgggcacttctgggcaactgtccccctgctggaggggggatcaggccagctcataccactgaccagatgtggggcacagtagaggacgtgcagcagccggtactgagactcccacagacgccgcagcagaggagagggtgctgggcttggagtcctgaaacctgggttatggtcttgattcatcctctgtggctctggggagtcacttctcctccctggccctccattatccctttgtaaagtgcactaaagcacatcaaattcccgcctgtttgtgtcagaagggacacaggaaattgtgaggttatacccaaccttttccagaaaggatttcaggtatccttcaaggacacaggtgtgttaggagtgggagtgagcatgagaaaaagcgggtcgtgccagcacgctctgttgggtgcagacctcaacaccaggggttgtcagtctcctctttcgtggtcagcacgtgtgaggtcatgccctgataatctccgaacgtcttcaatacatgatttctgaattcttcgccaagactttcagacagatccactccttccaccatttcccgtccacacccggtcttctctggctgcctgcagtttgccatcggggttcagagggcacgtgacaagtgctcgcatgcacacagcaaaatacaacggccgccgccctgccattctcccgatggctgtgaccgcaccgcagggaccacgctcccagggaccacactcctgggtcccgagccagtgccgagtgctgtgtgctcccccttccccctttcacttgggctcccggctgggcttccagggttcagacagccatccttgtctgagggacgagggttctggggaatgagtagatctcatggcacggggtgttgccctaacttgtctgattccagaggctgggccttgatctgctccgccccaccacgatcgtgcaggaagtgggccttcttcctgtgtctcgaggaatttgcagcaaaattgcttgagctggcatctgtgatccaagccctgtcttcaccatctgtttctttgcaggtggcacagaattgctctcagcgtccacaagaaaaatgtcaccttgatcctcgactgtaaaaagaagaccaccaaattcctcgaccgcagcgaccaccccatgatcgacatcaatggcatcatcgtgtttggcacccggatcctggatgaggaggtgtttgaggtgagcaggagggcagaccaacccctgtgcccaccagggcactcctcctgtggagccactgtgactgctgttggaggaggctcctcgggccgggaccggctggcggtccactgtggtcaccgtctctgttggtcagaagcctctgctgccatcctaagagatgtttgtggctttcggaaatggaggggccagagctgctgccgcctgtaggccgcgtggggatggcagtggccgcccttgtcccaagggcccagtacgtgagtctcctgggtgctggctcggaaaggacagggcctttgtccagcctcgtgctgaggctcctggaaacctgcacactcctgccgtctgtatccgaggccatcctgggacaggggcagctgtcctctgggtgagcttgaagggcagagctgggccaccgtgtggacgcaccagggagacctgtgccgacccaactcgggctggcctcactccagtctagctgtgtccagccaggggccttgctttcccggggaatgcctcagaggcttgggagtcggggcctgagctgagtgggctctgggaccctcacttcagcccatggagcccttcataggttggggttctgcgtgagagagcaggagaatgccccgtcccactgccaagaaacaggttgagagcttctgcaggtgaccagtgatccccagctgccccgggtgggggcgttggagtcaccaggagcctgtaggggttccagggccctgcctcctggggtgctggggcgacagcctgcacagggtcctggactctgcccttcccaagggcactgcagtgaccgttgcctccgcggcttgggttaggcggcagccaggacccctccactgggcttccttgtcgtttatgtaagttgggttttgcagaagatttggttttgcacccgggtctctgtggctaaaacctgttcgaaagccactggcttaaatggcctccgagggccatcctggctctgggatttcctcctccagggctgcagagatgggacaagttagggcagtgtctcctccctaaatccccgagcgctgccgtgagctcctggctgtgtctacacatcggttctgcatccggctgcccccgtttcatggctgaggtggggtccccagggccatgtttcttctcggtgactcggggtcaccaaaccagacaccgtgttgactcaatcttggtgttctgccaagggcacgcgaaggagacatcacacgtactagttcatttctgtgttaaagatatcgatgtctgctcgtggggacgggcacggttgaactgaccctggggctttgagcgtgtgagaagagggcaattctgaaagtctcacctttctaggaaatcatactggggaccacgtagtgtcactgtgaactggacattcagcagagtgctggcctcagggcaagcccacctgggctctgtcgattgttggatttgggcctcgggcaagctgctctgctatttctctgtcttagggtctccgtctgtaaaatgggatcacagatgtggctgcttcatgagctgtggcaaaggttccatgaggttgaatgcagtgacacagcagcgcactgtctcccttataggaagccccggcttaatgtcaaattcagttgttctggatattaatacagtgtcaaggcagacagaaaggcaggacacagccccgcggcccagtgcagaccgcagaggaatgatcagagcagccacgctctgtggaatgagatgggcctgttagaagaaggcagggagtaggtgtgaaggtggtggagattctgctgaacgtgcagttggctctgggtcagtttccaggaagctgtagcctggggcttcggtagagcagggcgggtgcttggatcctgctggcacagccagattttgcaagctattgagacacaccctccgggcacacttctgaacagacctgcctaggcgcctggaaggaactgcgggcacaggagccgtcctcagccaggcaggaggcagcttctgggctattctggggagctggggttaaaagctgccttggagtcacacagactgggatcaagtgctggttttgcctcttgctggtgggaggatctaggcaaagcaggtgacattgatgagctttgagactcatttgtaaaacattggtcacagtaaggctacctgcacagctgcaggggaggttctgggcttggcctgggcacctgccagagtcacccccaccgctgcctgttgttctgtgggtcgaggccctgcctctggatgggaggccacgcggtggcctcgggttttttttttttttttttttttttttttgagacggagtctcgctccgtcgcccaggctggagtgcagtggcacgatctcggctcactgcaagctctgcctcccgggttcacgccattctcctgcctcagcctctcgagtagctgggactacaggcgcccgccaccacacccagctaattttttttgtatttttagtagagatggggtttcactgtgttagccaggatggtctcgatctcctgaccttgtgatccgcccgcctcggcctcccacagtgctgggattgcaggcgtgagccaccgcgcccggcctcagggttttaatgtttgtcatgcagtctcttttttgtgctgtgtcaaatctttgtaatttctagtgtgttctgttgtaaagattcaggaaaaagctttattttatctttaaaaaattaggatcctaaaacaaatagtgcttcattgatattctaactgagcaggaaaagctgttttcccaaaagcagatgtatgtgaagagtcccttaccccagggaagcactagaaatccgtgttcagggctgggtttgcatcctggctccactgtttcccaggggtgagatcttcggtgagttgtctgaccgctccgagactcagtttccccatctgtaaaatgacaataatagtacccgccgcagttttgtgtgtgtgggaggcaccgtgagaattaatccatgaaaaatgcctatgagtggccgacagcaaacatgccagagtttacctcctttatcagcaaaggatgaaggtaacgtgtggttttcaaaaggaaatggctcttgaatggaggaggctgttttcctaccctggcttgttcttccagggaaccgtgcaggtctcactctgcagctggcgcctggcaggcttctggtcgaacggtaagtcacagataggttccgaattctgtgttcctggtgagccattttttcctgtcgtggaattcgatttgagccagagtggctgccaggaacgagaggtttttattgaccacaagttgttaatggtctggaggaggtgttttcctagccccagagtttcctggctgttagctgtgctcacgttggaaaattggacctgtctttcttaatgaagtccagcaggatcagcgatgccttcagctgccccaagcatcttttcttttttttttttcccttaacagtgtgaggaggaagttcggtgagttggcctcagagtcccagccaccttttgtctcattgcaagtggaagagaatttctatttcttttgaagtaaaagtgatttatctctgctttccagcgggctctgcataacgacacctcccatctcagtcgcttggctgctctagaaggctctaaaaatgaggggctggcactgttgagacatattcctccagcagccccaatcttcccctggaaggacaacttccgctcattcaaagccaatctgttctgtgtttagagttatactgaacaaggattcaccaaactctaagagagttcgtttaaacagggactgggggtttttcctggggtgtctgtggccccacagaggccccctttgtccaaagtgatgcgcccttgagggacagagggagatagagactctcagggccaagacacatgtgtctcctgcagtgcaaggccagggctaacggctggtgctgtgcccgcagcctccctgggtatagacgcggagcctgagtgtgtggctttggccgtgtcagcagccccctgcgcctgcagaccaggccctcactgcctcccagcccctgagtctggttctagtggggcagccttgccatgcaggggaggtgggacactgctgtccctcacagagccacgtacggaggaagtgatgggcatggagggcattctgccggcaggtccccccagccttggacttccttccctgctggtgacttggagccccgtgtcctcatctgtaaaatggggcgatagggccaacgctgtcggattttgggttggtgagatcaaatctgtgttagatgtgagtacctccaagggccgcagggaaccaccttgtcctgggtctttggcggtgagagctgctctctggcccattgtcagtggtcatctgccagtgacaatgggccagaggtggcccatcgtccacagtggcactgtcatgagctgtcccttttctcagcttttctggactccccttatgaattagatgctgtgagtcctgccataaagatgagacccctgggccttcaggaggatggagccgctgagaggtccatggggaaagaactggctgagggtcccgccagccccagctagggcgagtgctccggggcgcctcctgcccgtacctgcacctgccatcacagcagcccctcagcaaggtttgggttcgcaggcccctgtcctcctcccctggcagagtgcccctgtggagctggcaggagatccccctggcatgggctgtgtctcctaggatggggtgggatggccaagccctctcatgctgcctgttcccagggcgagtatgccggagctgcctgggacattgtcctgggaagttctcatcccaagtcttgtcccttctggatgtgccggtgccctggggccagcactggtgtcagaggaggactcagggcattgctccctaagccccaggtttccagaggtgctgggcaggcccaggaccaccgtgcaggaaggggaaggcagaggggctgggctccccccagtgcaggaaggtctttttatccagggcatagtcaggaacgagctttgtgttttcagaaacatggcctcagtggccagggtgagcatggggcatcctgcagaaggtggggatgtgtgagttatcttcacaggcaaggagaaggcggatgggagagcagccagggcccacccccactgtgccctggaagaagagagtcttgctgccacttcatagcttgggaagccagcaccagggaggttgagtcacttgcctaaggtcactcagcaacatgacagcagattgggacctcggaaatcatgacacaactgtccccagcctggaagggatcccggggaccagtggcaggagactggactcaggctggcctgacagcactgtgggcccccgcctggcattctgttctcctagccctccccgcacaggccctgaggaccctggagtcccctggcccatggggtctgtgaaactctggaaccttccaggaagagccagcataagctgttagcaagggcagagggcccaagagtgtccctcccgtgtgtgacaggtgacctggacccgcctagcccctgtcccagcaccttccccagcctgtggcgggcagcacggggctacctggctgctgatccggagggctccatgcacctctctagagtctcacctcatctatgggccctgagctggcccagtgagccacgtcagggaggctgggaggcgggactaagagggggcctggggtgcctctgccttgaggcctgccgtggaaggcccctcctctgtgggtgagctatgaccaggaggggggccgtggaggggatgagaactgccccgggggacagccggccagcgagttctgggccaggagccaaatgtgcttttaagctgttgaaggtttcaaggggcaacaagaccaaacagactataaactccagctctccctgcaaaacccctgggtgctggcgggaaagtgatggcgtcggctccaagctctaacggtcctccatctgtctgccttcatttcagcctttgaaaaacaccgagcggtttacctaatccctgattccctttttccaggggcctggcttttccactgacatgttctttctggaatttcactctccccggggcaggagtggggcctgtgctgagtgggcctttctcagccatccacggaggcaccctgggattcctgtgagtgggaacagaggagccctgggattcctgtgagtgggaacgtcccccagggcgtcaggcccttcagtgttagggcctcgaaggggagagcaagggctttgttagaggcccaggtccacgtttgctgtaacttcccaggctggggcctttggagcctctggatccttccagaactaccttgttgctcactggcttgctgacggctgcctgggctgcctgtgggacacagcaggtaggactcaggcttgggtctagggcagctctggagcccgcagcccatcactgggcagccggggaagccccaggggagggaagcgcaaccgtgaagatgagcagacttcccggcacacaggcgggcgagactgggtgctgagctgtgtgcggctggcggctccgggacgtgaggggattctgctgaggacctttcctcctggtcgggggagggctgcggagctgggaaaacccacctcgccagaccttccctgggccctgctgctcagcctctgctggatgagctgcgttcccctgtgagaggactggggaggtgtccggggagggagggctttccccgccttggaagctgcccagaggggcacatttggggggctggctgggccaactctgacttcggacatgagatggatgtgatgtgtgcacctgggcagggcagggcactccaccgcctcgggcagccccaggcaccctgctatgtcgtctctgtgcctccatcactggccaggcagcatggataggccaggtgtccctctgccagggcttctcggaggcagtgtgtgcctgcccctcccgagtcctggcccaagtccctgctgctgcctggccagtgcgcctgccattgcggctcagagcaactcccggggtgggggctctggtgcacctgcactgacacaggacactgtcacccttctaggtcctcggtccaagacccgcatctacccagccctgctgtctccttagcatccactggtgctttctgtaggatccacctccgctgtctcaggccacctgtgtggcagcccagaccccaccctggcagtgctgaggcagcccctggcagcggaacaccagcaggtgaagggcagaggccccttgtcgtgtcttcagctctgcctgctttgctgagacctcctcttgcccctggaagggacaaggacattgcactctgcatgatctcctgggactgctgcaaccaactgtcacagcccggtggcaaacagcagagatttatcctctcccagctctgggccagaattccaagatcgaggtgtgggcggggccgtgctccctctgaagcttccagcgggggactctgcctgccgcttccagccccgggtggccccagacactccttggcttgtggccacgtcgccccagcttctgcctccgtctttacacagcctctctcttccccctgtgtctctctgtgtgacccacaaggacatttgtcgttggatttagggcccatcctaatctaggatgttcccatttccagatccttcattccatctgcagtgatcttatttctggacaaggtcacctgtggatctagattctgggagttccgacctggacccatccctcggggccatgattcagccacttccctacaccagcgtggaaaaggggtttttcgtctcttaaattgccacagagcacgtgtgcttaaaagtgagcctctgggcatgcatatttggggcctctagctgaggcttcggggtgggctgctgagctgtgcctggctgaggaggggtgggggggctactcctggctagcaggcggttggccaagccccgtgggcatctccctggtgcagtaggcagctgcctggctggctggagccagtgtgcagtgtggcattggggtgcagtttggtatcggggtgcattctcatttgcagttctggtctagggaggcctgagtggtgagcgagtgaggcctggactccttcctgctgcaggtggctggtgacccgcctggtaggtgccagtgaccctgctggtgatctgtgtggcacccagcaaggaggggtccagagaccccacagggttgggcagggcctgcctcttcccatgtgctgtggggcctggcccctcctgctgcctggcccgaggtttgggcttcaggtttgttccatggaaaatgtgagccacagacccatctcccagcccagacaggaatgatgtcatcttgggagccggccttatccaaagatatcttgctgggctgacggcggatgttctgatccacagttcccagaagatggcactgagggtctctgggaagggacgcatgatgctggagggtctctggaggggagtgcccagggcaggcagggctgcggtggagggggagcaaaggggcagggcgtcccctgtgggagggtccagtggctgggggagccgcccacctgagcggaggagctgccctcacacggctgacgggcgagggggcccacgaacgtgatgtccttctttagcaccgtggccaagggggcatctgagggagccgcagtcaagccccagccctccgcccatccttcccatggctttgagccagcctgaacctcagtttcctcagctggaaagtggggatgttaggcttgtggtgcggatgaaaggaggcaaagccggtgcggcccgccccgtgctcactcagcgtggtggcaggtgcgccgctgtgtgctggcaggctctcctgcccgcgcgagacggtggctgttgtgatgatgatgatggtagtcatagtgattgtgcagtattttcatagcatcgccgtcagtgccgttaaccctgtctcattgaaaggggtgtgaagggtctacaagctcagtgggcaggtaggggagccaggacctaagcctgctccccatcgagacgccccgtctgttgggtgcagtggtgggggaggggccccgtttagtgcagtggtgggggaggagccccatttgttgggtgcagtggtggggcaggggccccatttgttgggtgcagtggtgggggggccccatttgttgggtgcagtggtgggggggcccatttgttgggtgcagtggtgggggaggggccccatttgttgggtgcagtggtgggggaggagcccccgtctgttgggtgcagtggtggggaaggggccccatttagtgcagtggtgggggaggagccctatttgttgggtgcagtggtgggggaggggccccatctgtggggtgcagtggtgggggaggggccccgtctgttgggtgcagtggtgggggaggggaccccatctgttgggtgcagtggtgggggaggggccccatttagtgcagtggtgggggaggagccctatttgttgggtgcagtggtgggggaggggccccgtctgttgggtgcagtggtgggggaggggccccgtctgttgggtgcagtggtgggggaggggccccgtttgttgggtgcagtggtggagaggcccgtttgttgggtgcagtggtgggggaggggaccacttgggggggcagccacatgggaagccgggaagggagctcccacagctggtctctgtcttccacagctggcctccgcctctgggcatgaattgttcggtcggtggtttggtgcctggaagaagcccctgtgggcctgcagagtcagctcggaggccaggttggctctgtttctcccccgtctaagggaggctgcctggctcttccccagacccaagcagacggtccaggtggtcaggccggtgacaccccacttgcagggcctgggtgctgtcgtatagaccgtgcgcctggggtgtggggctgtgtcttgccagccaggtgtgctaatgagtgagtcttgatcccagagcacatggaaaatctgtctcagaatcacttttctgccagcaccctccagtctgtttgaagatccagcagttgggaagggctgctctgttctaccactgcaccccatggtgcccaagcactaggctggatggggcactgggggctggtgcagtggccaccgcttgttcagaaaacccaaggctccgagatggaggtaaagccagagaggtaaagccacctgcccacagtcacacagctgggaacagtcagggcaggacttcagcccaggcctggatctttctgggttaagagttcccatacttaggtgaagaggggcacggcttggggtcccggataggaggcttctgcctgggtcctgtctccttattctcatgaccccttcttgcatctcctgatccaaatccccgctcttcagtcacatctcctgtgtcccctttcagcgtctcgttctccagccccatagagccactgcctggccctccccgcaagtggatggcgctgggcctgagtctcacaccctggactcctgggcctgtctgtgagtgcctgacaggaagtgaaccccctttaccctggcccccttcctgtccccactccttccccctccttcctgtccccctccttccttccccccttcttcctgcccccttcttccttcctccctccttcctgtacccctccttcctgccttccttcttcctatcccccttccttccttccccctccttcctgttccccctctttcctgtcctcctccttcctgcccatcttcttcctttcccccctccttcctgcccccttcttcctttcccccctccttcctgcccccttcttcttatcccccttcttccttcctcccccctccttcctgactctcttcttcctgttcccctccttcccccttcttcctgtcccccctccttcctgtccccctccctcctgcccctcttcttcctgtcccctccttccttcttccctccttcctgtctctcgttatccctgtccctgttccttccttccctactccttcctgttccccctccttcttattctccctccttcttgtccccctccttcctatttcccctcctgccttccctcctccttcctgtccccctttcttcctgctcctctccttcttgtcccccgtccttcctgagccccctttctgtcccccctcctttctgcctcacttcttcctgttgcccctcctcccctcccccttccttcctgttccccctccttcctgttccccctccttccttaccccttccttctgccctcctccatcctgcccctggcttttctgcttccctttcttcttgcccccatctttcctgcccctttctggccctagaccctggtgcttctcatgttcaaccctgagttgctgctttttgttcaaatggccccaccctgttctctgctggggtttccttgaccacggggaccaggtctcccctggacgcctttttccaggtgcccccagcccatacccatcctggctctgtccgcaaacctgtcctccagaagggcctgtgggtgaccaggctgcagccggggactcccagcactcctggagccctggactctccaaaccaggcgtgattcccgctgtgctccacggcctctctccagagccctggctgcctgccgtccatgcctctgggaggctgtgtgtttggaaatactttttggagctgagaagtgcaggttttcctgcgagctagccacgtggcctcaccctgcccttctcctgtccgatagtgagttttaccctagaggcagtttgagccacgccacgtggtcttcttagcaggatgcctgagccctaccccactggcttcatgctgtcagggaggctgggtcacaggcccatttactcactgcagggtgtgatggtggggagcatgtggagcagcctggctcctaacataaccccagagcgctcctccctcccagtctgcagccacagcagggctgtgtgcgctccacagagaagtgagggtcttcctgacgatggttgatttgcagagacacccgggagttgcatctgtcactgtcccatcacaggtaaagccaccttactctattggttgacagaatgaagactcagaagatctttcaagctgggactatgttctcgaactgagaaaatgaaattcaatcaggataaacgtgagcttctgcacttgggttcaaaacaatcaattgtacaagcgcagggccaggagaagcggcagtgaagtgttttatatgaaaaaaacttaggggtttgtgggtgtcaaacccattaacgatcatcagtgtggtgtggcggccacaggaatgcacgctgtcacaggtggcgttagggacagagggcagggtgatctcaggtctggaaactgtgctgaacagaagctgaatagaaagaactggggtctgaacccgggacagagaaggtgggtggagtggagagtgggtggccccagtgtggggtcttgtccagaggagaggggatgagaccacagcagactgagaccagtgatgggatgtgaaccttgtagcagccaccttctcctcctccaggcccagctctgagcaaccttctccgtgacgctctccttgacctcccaggcaaagtctgttgcttctgtgctgcctcccaagtcttctcccttgagacttacagtcagagacccagatttttttcatctttatgtccctaagacttatcagagagatgcaaaaaatactggttgaatgaacaaaagaatgaacaatcagagctggttgccttcctgcaggccttcatgctacagaggcatgttcgggaaaggctggtgagcctttctcagggatccaggactgttgatgatggtggtggtggtggcggaggaggtggtggtagtgatgatggtcataatgatgctgatggtggtgatattaatggtgagtatgatgatgatgataacagtggtgtggtggtaatggtcatgatggtagtgatggtggtggtggtagtggtggtggtgaaggtgatggtgatgtttatggtggtggatatgctgatgatggtgatggtggttgtgatggtgtgatgctggtgaaggtggtggtggaggttaaggtggtgaaggtggtgatgctgatgaaggtggtggtggaggtgatgtggtggtgatagtgattttggtgaaggtggtggtggaggtgattgtgatggtgtgatgctgatgaaggtggtggtggaggtgatggtggtggtggtggtggaggcgatgatagtggtggtggtggtgatgctggtgaaggtggtagtggaggtgatggtagtggtggtgatgctggtggaggtggtgatggaggtgattgtgatggtgtgatgctggtgaaggtggtggtggaggtgattgtggtggtggtggtggtggtggaggcgatgatggtggtggtggtgatgctggtgaaggtggtagtggaggtgatggtagtggtggtgatgctggtgaaggtggtggtggaggtgattgtggtggtgatggtgattcttgaagggtggcctgccccaccacacctgtgggtgtttctcgttgggtgggacgagagactgagaaaagaaagagacacagagacaaagtatagagaaagaaaaatgggcccaggggaccagcgctcagcatacggaggacccctgccagcaccagtctctgagttccctcagtatttattgatcattatctctaccatctcagagagggggatgtggcaggacaatagggtaatagtggggagagggtcagcaggaaaacgtgaacaaatgtctctgtatcataagtttagaaaaggtgctgtgctttgatgtgcacatacataaacgtatctggtgcattaaagagcagtatgccgccagcatgtctcacctccagccctaaggcggttttcctctatctcagtagatgggatatacaatccggttttacaccaagacattctattgcccagggacgagcaggagacagatgccttcctcttatctcaactgcaaagaggccttcctcttttactaatcctcctcagcacagacccttcatgggtgtcagtctgggggatggtcaagtctttcccttcctatgaggccatatttcagactatcacacggggaggaactttggacaatacctggccttcctaggcagaggtccccgcggccttctgcagtgttttgtgtccctaggtacttgagattaaggagtggtgatgacttttaacaagcatgatgctgccttcaagcatttgtttaacaaagcacatcctgcatagccctaaatccattaaaccttgagtcgacacagcacatgtctctgcgaccacagggttagaggtaaggttacagattaacagcatctcaagtcagaagaatttttcttagtacagaacaaagtggagtctcttatgtctacttctttctacatagacacagcaacagtctgatctctctttcttttccccacaattctggtgaaggtggtgatggaggtgatgatagtggtggtggtgatgctggtgatggtagtgatgaagatgatggtgatgctggtggtggtggtggtggtggtggtggtgatgatgttagtagtgtgttggttctatggttttggtgctggtagcactgctggtggtggtcatgatgctagcagtgtggtggttctgtggttttggtgctggtggtggctgtggaggctgtgctagtggatgctgattgctctggggagtgttctggtgcaatcccatttagtcctctgctctatgaggtagatcttattatcctcttttatcaacagatggaggcctggagtaattagtcatacgctgacatcctcacagatgacaagggagggacccggtgcccaggcctcctgtggtcagtgccttccctgtgccattcttctcgggcagtgctgccaagggtcaggtggcttccttctggggagcctggaccgagtgaacatcccctgtgctcagcgatgccccgtgtgccataaaacagtgtctgcaggcccgctgctccgaaagtcaagatgtggagaaggagcagctcaagcgtgcactgcccaagccacaagtgcaggcctttgtgaggtcaccaccctttgggtggcgagtctttgaggaggtgaacccccaccctttggagagagcaagtctttgaggaggtggacctgccccccagcccctgccattggtgctgccatttcgtcccttggtctagagatgaggccccctctccgagtttgctgagctgacccttcagtccctgtggccagcttcagggtgtgcatgaggctgtgacctgatcatgccccttctctgcacccatgcggcccacccccatgttggagacacagatgtgtcattttgcagccttgcacccagagctgttgtgagtagacttgaccctacacgtcttgggctggtggctgcaggtgagaattggactgggactggaggcagcgagcgaggacatggcggggacagcagaaagcaatttccgacgacatgaaaatatttctctgacactctcgttaatagtgtgaaactcgttctcacaggtgctgtgaaaaccatggaaaaaattatttagacctcactggcttgggggcattttgtttttccattttgtatgactcacggatgaagaacatcaaagcgagattgtaaatgtgactggtctggcccctggcagctggaatggggggatctggtggtctcctacgtgcgcagcgctaaggacgtcaaggaagtgcctcgtggagaaggggcaccggtggcgtccggccaggctgctctggcagtgtctgtcagaatccgccgggcccagcgggagggaagccccgtgcaagagactgctgatgatggcactgtacttgcggggaacgcagtcgtgttcttagctcctgtttgcagagcccagggccagactccaccctcccagcagcctctggggccagcgttgttccatccccagcttcagaaggggaaagaatggtttaacgtggtttgcgaacacacctgagatcactcagccagcaaggggcaggattcagatgtgggcccaggtgaacccagctccagaccctagcgctgcccgtggctctcccggcctccgtccctcccagtcagcgtgttaactcagctgggctgcgttttgtatgggaggttggacaacgtgcccgcctgccaggacaggggaggtttgtggcagggcctggcagtggcagaacaatctctcatggacaacatgcttgccgaccgcttctcccacagcctcgaacaagaagggtttgtcttaaatagttatttgtgtctctctgtttaccagcacgaagtgctctggctaaaattagatgataaagtctgtgggacaagcagagtgctcagctgggattcctgtggaccctgtttcggttggacgaggagggggcctgggtgccaggcagtcatgggggggctggctcaacccagggatgggggatggggttgaaaggaggagtgcatgattaaatggcagaggaggcactgagcatgcgattagagggagcagcagcatgagaagcagcctgggctggggggccgcggccacgggagcctctaatttggtgaggtccatgtttcccgtctccatggctccaggcttatggggctctccaatgaaaactttgcagtttcctcagctcacaacagagacgcagcctggatacggtctcattagcagaaaaggcagaactgattctctcagcaaaatgctcccatctctgccagagccaaggacaacatgctcccgccgtggccgccgacccatcttccgtcgaacgtggccgccaactgtgccgtgggcaggggctctgcagcagagcggaatggccgtaatgaccctggcctggtggcggaaacttccagggcactttaatgacctggcagggggcagaatccaggaatgtaaagggggaaaatggtcagttatcagagcgagggatggcatgaaaacagctgccacctgcttctttgggcagccacagggccagctgtctggagccgctggtgctgggtcttggcttttaaagttgagcagagtggttcaggggctcagcccgggaagccaagacgtggaacaggagaagcctgaatctgccaggcgaattgggcaggtgcctgcccctgctcctagggctgtgtgggtgatgggacaaagttttgggaactgggagcccacggccgttctgtgtgcaggatgtgtgacttggcacgatgtccttgactccaaggtgggcagctctggggtggggactgtgggggctgcaggcagagactcaggagccccagtcagccctcctcccatatggcctgcgagagtggcgctgcctctcagaccctccattgctgcatctgtgaaatggggatgggagagtggaaaggagaccttgccttcctcctgggggggctgcaagaatgggagtagggccagacctgtaaggaaagtctcttttgccgaggcgtgaggtagggctgggaattgggtcagtgtgaaacaccagggtctttcccgaagcatgccgggcacaggcggtgcacgctgaggatatctgacatgtcaacacaacctgtcacgttggagcggggaagtggggtgggcttaggacaagcagcctcaaagaactgtgggctgttgttgagggaggggactgagtcccaggcacctcggggccatctccagtgctgtgccaggacccatgtgtgccacacacatgcatacctgttcacatatgcacacaaggcatgccataccatatacatatgcataaaagtgtgtgcatgcacccatgtcacacatacacatgcatgtatactgtgcacacgacgtaggcatgtatgtcacgcacacacaccgcacatgtgaatgcaaaacatatgtgcacagtacacatatggcctcctgcacccatgtgcacacctgcatcaacacggtaccggacacatgcacgcacacgtatgtatgcacacacacagtgacacaacacaccagccaaccccagatcctggcgcttggcctgcaagcgggccatgggcctacaagtgtggggttgctggctgggcttccctgcgtccagtgggtgtttggccctgcaggagggctggaaaacagcacgaagaggacagcagcaagggagacccagcacttcacacactcatctcatggccagggcaggacaggggcagggcggcacatcatgctccatatcctgggtggtgatcggcctctgcctttccagggcaagggggcggctcaggaagtaggcggctgccatcgttggtaagaggacggaggatggggagaaagcaatgaagggtggagaaggggcgtgtctgaagaaggtcggaggtgacacctattgccctgctcagggattggatgtgtgccatgaaacctggcagttagatgtgacatcagaggagagccacaggccactgctgggcagggcatcaggttggttccttgcgcttgtgtgccaggggctctgatagcacctgggagggggactgtggggaccatgggcctttctgaggtcgtggtcaggctgcttggaggttcttggggtcaaagtccacccgtctgagagggcagctgcagctaagaaattcctggggtgcctcagtgcctcaggaagggtcagggcacggcccactgggcaattctgacctacagccggcctcttagagacccagggttgggtcctggaaggctgcaggctgaggtctctctggggtttctttggctgtgcgtgcgcgttgtgacccagccccaagctccagcttcctgtccccatcccctgaaaagccacgagctcacccaagcccaagcaggggctgcccaccagcccctggccctttgtttccaggccgccagcacctcccgccggccagtgccgggcaaggctccaccaggagaggaggcttcatcgaccaattttcctggtctgtagtttggagcttggtttcatatcacaggatgcactgtgaaaatgctctcagcatacaacatgaagtcgtgatcctagctttgtatttgaaagacagtgtgcgccagattatggcggtcgggctgggcatgtcctctccagcacactggggagtggctgccggaagccctgggttgagaaggattctgagggcaccagggcagagttctgcctagggctttcgtgagcttcgggcagagctgtgtgtttggtccacacagcctggagggggtcaggggaggctgagatttcctgtgatgaaatggggagactgtggctcccaggggctggttgcctggctggtaggtggctgggctggacgtctccacatgctgacctggcttccagagaggagccgactctgagtgaatgttccagaaggaggagtgcaggctcaggaactgccagggtaccactgacagaaggaggggcgtccccgcatccacagctgccttcaaggtctgtgaggggcggctccaggcctggctgcatcttagaatctcatgagcagttatggctcctgaatcccagtccccgccagacccaccacatggagtctctggggatcccagggttccgcgggtgtcacctgctgggtaggacacagtgtgtggctgcgcgtgagtcagggaagatgcctctctcaccctggacccatcacatctttcatcagtctagtgatggacacaggtctcagggatgcaggaggacttcagtgtggccctcactgtctccatccaggaccccccatgataaccctctagagccccctcaactgtccccatccagggctgtcagatgtcccccccatgggacccccatccagggctgcccaggctcccccatagtaccccatctaggaccaccctgtaacctccccatagtacccatacagggctgcccaggaccccccatgaccccgttagggctgttctgtgcctctcgtcaccccatggcaccccatgactgtgtttggatcccatcactatctcgtctctgctctgaacactggactagccaccaacccacagccccgagggcagagctggaagtcccatgcacctgggcctctggactcgcaggaatcaggtggccccaggggtggcccagggcagaggcaggtgtctcactggagtcctgcggggtgggttacagcctttccctctgcttcagctcctcctccgcccagtccttgtgggggtgcagacatcacagagccctcttctcagccctgcctggaaggtggcacagaaggagcgctagctcgtgcagccatggggctggcccgtgggaggttgctgggcttcaggggaggcatccgctctgtcttggagcctggagcagatccctcactacggccccatctgcctggggtcctgcagagaagctcctcctcaacagccttgctgggcacccaggtgttcagggtcccctccctcacctgcatgtgtagggaagaagcagtgggtgggctggaaagagccctgggccaggatccaggtctagagcgaccctgcttctgcagcactctgagcctgagccttagcacctgcgcctcggtttctccttctccacgggggtggtgtagggcctggcagacccttgccctttggcagtggtgcccgcagaacacaccggctctttctagtgtgaaaatccacctgaggatttggtggggaaatgattcgaacgaagcacgtgcatttgcagaggagggggttctcgaagtgaagggacctcatgcccagtcctactattgtctgttcactgctgcagtctgggggtgtggtgggcaggccacaaagcagggctggctgagggccaggtcagcctgggatcagagcgccgggcacctggggacacctcaggctttgtcccgcttcgtgggtgttcgttacctagccttgggccctgatggtcgtgcaggtgtgcctgggtgctgtgtgcccacaagcactgagaccagtgccagcaccttatgcagggcctgcaaggtatggccgctgtgctggacaccctggggtacggggttgtgccggacacgcccatgatccaaggagcttggggcttccggggaagcagagctggatccaggggtgcatcagggcccaggaccacagctgcccctgaaggcccctgaggcttctcttccttctttgaagtgcctttggagaacatatattcagatgtcaaattgccagttgaaaggagaacatattttatttgaattggatgaaatgtgatccagaagtcatgttgcttaataaaagtgtgtggttttgattcactgttcctccttgtctgctggagaatttgaaacatgggccaggagcctctgacatccaaagatgggggagagagagaaggagaaagagggagagggaggtgaggcaggtgggcagctctgctggcctcagcgggtggagagtggggcatcccgtttgagggttggtgtcggggagggaaggtgtgaaatgctgagggctgcgctaatcagggccccactcttgcttcctcctcaaaatgcccccagtttactgtgatggggtctcaggggcagggggcagcagcaggtagctgtcctcggtcactccccgtccccgtgctctgtccctttgtgggtcacagcccccgaggtgaagtctggaaggagaggaacctgtcacccagtgccctcctcagcccagcagatgccccagcccagggaacaggtgcaagctcagctcccgacgaccgccaaccctcagctgcttcctgcaccgctgtcctgaggcaccactgtcctgaggcaccctgcggagaggaaggacccgggttggagggggctcggcggtgctgtccatgatgtggggtgatgcggggggttcagtccctgaaacttcagatgaggcagtaggtacgtggcggccagggacgccccatgctctgggcctgatgcctgcagggagagcacccgtctctgtgctgctccatctgttctgagatgtggagacaggggaggcagggctgggtcagctagtgtcaggggccccgctgcacacataggctccaggtcctggccactgcttctgtggctctgcagttgggaccagtgatgtctcctgtcccagcctcttctatctgttaaatggaggtgacagaaatttcccttgtgagtcctgagtcctgcaagggaacgggtgctggcgtgcacccaggcaccggacggacccctgaaccctggctgcacccttctggatggggcgaggcaggggcaggtgggcagaagggctgtggccaggctatggcacagtagtgccgagaaaggtgggtccgtctgcctctgacccagaggcaggtatggatgtggatgtgtggctgaagtcaggagcaggaacttaccacctggcagagctgctgcctggaatgttgggtgggcttggggagggttctgagctcctcgctcatcatttgaggtttttaaacacaagttggggtcacccacgataaccacagacacataccccactctcttcccctttttggtgctgagagccgtttcctgttgagccccgaggtcctcccctcggcccctgcctcgcaccactccctcccctctcaggagcactgtcctggctgctgtggcctcttccctgccaccctctcacacctgctgttgggcccccaccctgtgtcctgcatcagccccctgctgacccccagttcctccaaacctactgcctgctgagggcttttcctgagcacatgccttcccccattgacctcaaaatcttttgcattacttattgagtgccttctgcatacaaggagttttgcctggaggactctacagctctgtgaggtcaatgctgccgttttatgctaattttttcagagagaaagcagggagcagagaggtgtgtgtgaacaggctcatcccaggccacacagccaggcaacggctggagctggcatgtgggccgggcctgtccggcagcacagagcttactgcttttccaagtgtgcctgcgggctgggattccctccgccccgcccgtgtgcgcagtggttgtgatgctcccacccgctccatccaagtctcagtgcctgtcttgctgtggccagaccctcgcaccaaaagtcttcgtggaagagagcagccctcggaacaatgatgggtgtgcgcacagagctcacagctgtgaatgtctcccagcccttcccagaacactggcaccctgggagtgagggtgactcgccagggtcagaagtacacagcgcaaagccacgtcacagccaccgcggctgcaggccagagtcttcaaggcggagacaaagctgtcactagactcctcctggcccagagaggggcctcggcgggggaggtggtgcctctgcttggatggagtgaaggttccgatgaaccaggctcaggtgaaccaggctcgggtgaaccaggctcgggtgaaccaggctcggatgaaccgtggagaacttgccatcctccagatggggttgggcaccctgaccctgcagcccgctggctactgtggctctggaaaagtgtgcagatgtgatgcagggtggcaagatgagctccagacccagagcactcagcacctggccctgccccaagtccccttgcctgcggcaccgtctctggtggcgggaccggagacgccaccgtctccaggaccggagcacctggacatggtcctccaagttcttttccctcccttgagtgtggtggggcgtgtagtggttggcatcttgcaggctgccttgggctgatcctgccccagctgctgggggaccctggacaggtgacctcacaggtcctcggtttcctctgttgtagagtggggattagtcggacacaattcatagggttcttgagggcacagagagaccaggtgcaggctctttaccttgtacttgatctgtggtaaacatgatctaattcgtcatcactgtcattactataatcattactatattggtcggcttctatgcatctgattatggtcaaaagatcctctgctttggaacacccagggtgctgccagggtgactcctagcgtgcctgtcatcttcatctctgcagatagcgtttatgagacctgcatttcttattcctactagcagcccttttatttctcctgtgtacacattgtggtgagagaataatggaataaattgtttacacatcatggttagaggaagaaggaataagtgcttgcatgcttttcccggctgacacagttagagtgtaggctgctcacaatgaatccgaaagttcagttgttagcagtgtgggttcatccgccttgtagtgtggggcagtacttccttcccttttgtggttgaatgatattccattctatgcatataccacactctgtttatccatttagctgtcggtagacatgtgggttgcatttatcttttggccattgtgactaatgctactatgaacacttgtatacatttatttgtttgagtccctgttttgtttggagggtgaactgatttgggtgaattgtttatgcatctgtttcagttccggagattggaattactggtcatatggtaattctagttttaactttttgagaaaccagacatcacctctttaaaaatactctcttccccagtggttgaggggtaatggcaaaggaggcagggtacctccaagccctcggggtctagggcgggtgagagtgcaggctgtttctcacaacaggcaaaagctgccagcactgcactggcatctggcaggtgctcaacaggtgtctggtaaatggatgagtgaatgggtggtggattgatgggtgggtgggtagatgggtggatagacagatgaatggatgggtggatgggtggaaggatgagtagagggacggagagatggatggaaggatgtatgtatctggatggatagatagatggatgaattaatgagcagatagatggctgggtggatggatggacaggtggataggtagatggatgaatggatgagtggatggatgggtgaatgggttgaaggatgagtggatagatggatagatggatagaaggatgtgtatgtgcagatggatggatgcatggatggataagtgaatgagtggacagacggatggaggagtggatggatagagggtttaatggatggatggacagatgaatgggtgaatggatgggtagatggatggatgggtggatgggagaatggatggatgggtgaatggatggaaggactggtagatgtagatggataggtggacagatgggtgaatggatgaatgaaagagtggatggatggatggatggatgggtagatggatggaagcatgtatatatgcagatggattgatggatgagtgaatgagtggacagatggaaggatggatagatggtttatggatggatggataggtgaatgggtgaatggatggatagatggatggatgggtggatgggtgaatgggtgggtgaatggatggaaggactggtagatgtagatggataggtggatagatgggtgaatggatgaacgaatgagtggatggatggatggatggatggatgggtagatggatgagtgaacggatggatggatggatggatggatggatggatgggccagcctagcttgagtgtcttttgtgagtggcagcttctagggagaatgtttggctctgaggacaagctcgtcttgtggcttggtctggactttcccctgcttcaaggcatggggctgtgtctcccaggtccccatgcgagtgctctgtgagctgctttttcatgagcgtctcttcttttccagggtgacatccagcagctgctctttgtctcggaccaccgggcagcttatgattactgtgagcactacagccctgactgtgacaccgcagtacctgacaccccacagtcgcaggaccccaatccagatgaatatgtgagttaactctggctgggatcttggggagcatgagcagactacttgggatggttggtgaagagacacataagccatgggacccttattttaaataaatccactgggtgagaatttggagggacctaggaggtaaacattgggatatctgactcactttactaaatagcactgcccagaatgatagggtcacagagtttgtcatcaataaccctctcctttaaccttttgaacaagctccttgatggtgaatgcccagtgctctctcacgcttgggcttgaccttgatggggtatttgtgagcacagatgccacaggtgtcccccatggactcgatccactggaggggccatgtgcagctcgccaaagaggacggagcctgggcttgtctactgtagaatggccagccctcggatcccttgagtgtaaagtgtactgtagagtggcagccgtgcctgacacctttgtccctcttcctgggacccgccatgtccatgggtcagctgtcctccccctcccgctgcacaccctcgcggcactgcagtttttcttatttgcagttcttcctatcacctctgcatgaaaatgctctcccactccctgggcccactgcctctcatttctcatccgtaatattaaatcctgtttatttctccttgggtcttccttctttcaccaccagtcaggaaagaaggaagggtagctttcaggaagctgtgggaccccgtggcccaggccacatcttacaaaccccaggaggggcaggacagagctcccagccgagtccctgctgccccggcctcctgccaggctcctcccagctcctggtgtgggaatgggctcaggacaaggcctactctgtcccactgaagccctacccgtggggtccctgggctttgaggcttggggctgaaggcccgggagcctgctggagacatggtgacggctgcacagactgccattctgttggttgttctggcctgggttccaaagggccagaagccttcacctttgagggctcatctttctctgactgctcgaggggacctggtgttccccctgctttctctcttgtgcttctgatgaggctgcgtcagctttccaaggagctggagagggaggaaccccatccggggacccacagggaggttcacgcctggggctggacggggcgtcgtggcgtgcagatctggaggttgcggaaggaaggacagcaggctggtcgctctgcgggctccgctgcttcctcacggggccgcaattcgctttcagtacacggaaggagacggcgagggtgagacctattactacgaatacccctactacgaagaccccgaagacctagggaaggagcccacccccagcaagaagcccgtggaagctgccaaagaaaccacagaggtccccgaggtctgggctgagcgggggactgggttgggctgggcccctcgaggccatggtgcaggggagggcgaggccaggagaggttgtgtcagggtagagggttgggggctgtctggtgaaggttgcgggggcagctcagtgagggagccggctgttgccatccgagctttgctgtcacggggcgtatcgggctttccgcagtgaggaggacgttgggagatgccaagtatacaggggagcatctgccagcatctctgggccctggccccggtccccaccctgtacgaggcacagggctctagcaggcccaggatgagtttggttctcgggttccttaagtgtgggtgcagctgtggtgggagaggagagaggagagctcaggggctcccccggggggtgacgcagtctgaggtcggcctcgggtcctccccgctctgggctgtcatcccctcacctctgaaattggggagggttgtgagggtgcgtgagcggcagtgagagccggagggtcacacctagcagggcccgggccccgtgcaggagtgtgtatgggtgggtgtcctcctggggaggaggctgtccagcctcagagccattgtcagaggtaaagagggtggggtgtgagcatgggcggtgtgtgtgtgtgcatgaacgagtgtgtgtgagcatgtggcatgcaggcacgggtgtgcttgagcctgcgtgtgtgtgagagtgtgtgtgagcgtgtgtgcatgcgggcacgggtgtgcatgagcctgtgtgtgtgagcgtgtgtgagcgtgtgtgcatgcgggcacgggtgtgcatgagcctgtgtgtgtgagcgtgtgtgagcgtgtgtgcatgcgggcacgggtgtgcatgagcctgtgtgtgtgagcgtgtgtgagcgtgtgtgcatgcgggcacgggtgtgcatgagcctgtgtgtgtgagcgtgtgtgagcgtgtgtgcatgcgggcacgggtgtgcatgagcctgtgtgtgtgagcgtgtgtgagcgtgtgtgcatgcgggcacgggtgtgcatgagcctgtgtgtgtgagcgtgtgtgtatccttccagggaaaggtgacctggtcatctcacattgctctgagagcctggagtgttttgctacttttgttttttaaatactgagatatgattcacccttttctggtgtgtaactgggtgggtttgagtccattctgagcacgcttagtaactgggggcttgcagctgggctgccttcttcccacttgctctgcccccaagccccatggatgggggcggcccctgcacccaagaggtctctgggcctcttgacaggcctgggctccaggcgttgccactgagatgcctgcacccggacatgcggcaagtcccagacctggcaccactgccggcctccgccctgactccagctgtctctgtccttggctcccaggagctgaccccgacccccacggaagctgctcccatgcctgaaaccagtgaaggggctgggaaggaagaggacgtcggcatcggggactatgactacgtgcccagtgaggactactacacgccctcaccgtatgatgacctcacctatggcgagggggaggagaaccccgaccagcccacagacccaggcgctggggccgaaattcccaccagcaccgccgacacctccaactcctccaatgtaatttctttccttcccattggtttggtctggggcagtgggccaagggccagggctggggccacaatgctgagctcccttcttactccagttctcaccttggtgtcctcgggtggcccctgtgttccaccacaccctggccctgggccctttgcagctgggtggcgtaatacttcccaggggaggccattgctgaacaagtttggaatccctggtttgctgagttcatctcaatgttgtcaattttttgcctggaaaatgggtagaatgaccctagcccttccggtctttgaggattcaggtggaaattggatgaggaggggggtggcttgtggacagagtccctgcctgtggcctgggtgtggccaggcaggatggggctgggagccaggatccagacaaatacagcgaagcaggagctggggccgccctggctgggacgggggctgactgtcagcagacaggcctgaaagctctgcccgagaccttggaaagttagtctgcgtctctggacctcgcggttctcctttccaacatggcactgacagttcctgtctctgggggctgtgaagttttcagattcaggaggagccttgcgtagtgtgtagcacatggccgatgcttaacatagccactgtgtgatgcagaatctccactgccagagaggacacctcgttccagcaggtccagacccctgcgtctgcagcaccgccctgggatgcattatcgcaagaccctggggctgtggggtgcagcccctgcctgagcgggtgcacgggtgtgccagctccatggtgtgccagctccgagttgtcagacctggagccctcagaggaggtctctcccagaggggggtctctgcccagttgaccgggtagccatggtgccagcacagggcctgatggatctgggatctctgcccagttgaccggatagccacagtgcccgcccagggcctgatggagaggcagtgcctggtgcgtttgcgaggcaaccctgcgccttcctctccctctgcagccagctccgcctccaggggaaggtgcggatgacttggagggggagttcactgaggaaacgatccggaaccttgacgagaactactacgacccctactacgaccccaccagctccccgtcggagatcgggccgggaatgccggcgaaccaggataccatctatgaaggggtgagagggtgcaggcccccgttccgggtggggttggggggctggtggggcatcatgggggctcctgcccaagagcctcctcaggggtgggcctctacgggcagctcaagtgttacaccctattcccaaaactttatttttaaagagacctcggtgcctcgaatttgctctgaataacgtgtgtatcggagcatactctcctctgggcctgtttcttcgttagtagtcacatgggctcccgtgggcctggcctctgtcacgctcctgccatcctcctgggcctggggagatgcccagctacgatagtgccctcggccttgcgaaatcgggcagattttgtgtaatctggactttctttctcacttttctctctgattctctttccatctgccttttatcacccccagattggaggacctcggggcgagaaaggccaaaagggagaaccagcgattatcgagccggtgaggacattttctcattccctccctgcgccggggtgtccgctgctcggggtcacagcggggtgtgtagggtgtgaacaggtccgtgggcccctgcacctgcgcgcactgggtcacttcgagcaaccacctggtctcgtggagtccacgcaccacttgtccccaggacttgtgaagaatccccttgggtaggggatgttctggactgtgatggagggggcgggataggtgctgatcaaagccggtcctgcacccaagctctgggcatctcagtgctggtcagtttcacctgggatgaaaagcagctcagagctatcgaggcggaggcggagtcccctttgaggggtggaggagaggatgtaaatggcccattccgtgtaaaagatgcgcgcggcagtggtagggaatagttaacacgtggtcgtacctctctgcgtctgttatgcaaccgtttggagtaagtttacagaagctgttgaaacatggaatactgtttatgaaactttatcaagggaatgaaataaaacagcactgtgctgaaattccagctgagtaaaacccaactatgttaggtaatgagatcacgggtgagttcaaaaagttactgttgataatgccctcaagcgtgggactgtagcgaggacgttctagatgcccctcctggttggcgcgtttggtgggggccctgccccatactggggtgtccttgtcccatagggggccatggcctggctgggaggcctccagttctccctggggtctcagagccactaaggtcttgatgccccgccccgccgccggcaggcaggatgccctgtgatcagctgggcagggagtcctgccgctgcatgtggtgggcacgaccggagagcagggaggagccagcaccaaggcccaccctgccatgttgtccaagtgcccacaggaggaggtgtgcgtcctgcaccacggccagtcatgaggctgggggcagctgtttgttctgccgccaggactcagttcctgagggctgagctcaggatacaccttgggtctcccagaagccccctgaccttgcagttcccagaatgtgcagtcacagtgacccgccaccctactgtagagctggggacattctcttggaaccttgacggatggcacttagcaggcctttatacccctggaatctctttgaagcccgtggccagggcagacgggatgtgtcccatctctggggtggaattcccagggtccagggcttcaccccttcctggcctatggaagcgtctggatggctcttgtggggctctatgcccttgctccaggcccaacccaggggtgggacctgccggtgcctacagacacatccttttctcggaccccctttccagtgctctctgggggtccagggaagacagagcttgtctgaggcagaagggtcatgggctgcagggcaaaggggtgcagaggcatgaaaggagactctgaggccaggatccccctgctcagcattgtggaaaacctcagagccaggcctgggctcagggaccagagcagctgtgggggagagtgactgccgtccgcctgggcggactcacccagaagcagggggctgcgggcctgttctgctctgcccaagggtgtttgccagaaggtgaacaacagcagaggctacatccaaggtcccagccccaagctacacttgttattgagaggtgggacatccggttgcatttccccagacttggcccccaggtagacttgaggttggccttgggcttcttttgtgctgtccccattgcttcagtgaaagggggtccttgctcggggaggaagatgggatctcagggtgggcaggtgcccctggctctgcaggatcccagttcggtttcccctccccgctctgggagggccggactgaaacctttgaatgagcttcgtgttggctcatgttcccgagtaagctggctctgtgagtgtagacgtggtgtctgggctccaggagggggttgggagtgtggggtgggcacaggttttccactgccaggcacccgggaaggcagcagtgggcaagggtgggccaaggagagggccgagagtcgaggtggccccacaggaacatcatggctctggaaagtccagttcacctttgttgggaaaagcagcagccgtacaggaacatcatggctctggaaagtccagttcacctttgttgggaaaagcagcagccgtctgggtgcagttaggaaggattccctcccccgggccccagcctgctccaagtgtcctggggcctttggccaggccccctgcagagatcacataaacagttggaatttctcaacctggaacgttgccagatatccttgggtccaagctgcacataaacagatggccaggtcctggggccctgcgggcgtcccggcctgtggaagggggtgtctgttgtctgccccacctgagctccctcttgggagatgcatctgttccaggggcatgcccaggtctttcccactcagtcccgctccctctcattgtcagccagaccagaggctccctaaaaggacaggaatccacggaaccgagaggagacaggttcatccttatccttgtgcttccaggcaggaagcccccagactcagtggctgattttacctgggccacatccattaggggcatccaaatcaccatctccacttgacactgttttttgtttttaaaatatgtgctgtttaccagatgggtggaccctccattgagattgtcttgagttctgccaggtctgaggtcttttatttcttttgttaaaattgtatgcattcggccgggtgcggtggctcacacctgtaatcccagcactttgggaggctgaggcaggcagatcacctgaagtcaggagttcgagaccatcctgaccaccatggcaaaaccctgtctttactaaaactacaaaaaaattaaccaggtgtggtggtgggcacttgtaatctcagctactctggaggctgaggcaggagaatcagttgaacccaggaggcggaggttgcagtgagccaagattgcgccactgcactccagcctggacagcgtgagactccatctcaaaaaaaaaaaaaaaattgtgtgcattgaaggtgtgcagcatgtttgatagagttacccaggcacagacagacacagtgaagtgatcctgcacccaccaccaccaccccatagctgcctctttttcttctttatggtaaaagtgcctaaagtgtactcttttggcaaatgacatctacagtgcaatatcattaactatatcgaggcgttttcctctcgttcctctttcgctgggtcaattttgagagtggcgtccgtggttgggtgggccggggcgggagcggggccacagcttgcctgggaaggttcaggcatccccaccctcaggcgcattcatccagctgttcccagcttccttcagacgctgacctgggatgatctggtgttggcttccctgcaaggtccccgcccgcgttgccccagttccctgagaaaagcaatttgcgtgtctgggaaggcagctgctgtccctggccccttgatggccagtggtttctcccttaatcccagctcagccctgggctttctcagctgcctttgtcagagacggaaattggaaaactggcatcttggaggctgcttggatgagctctctgtgtacagcacacacacgggtgtctctctgagtgtgcatctgtgtaaacacagtgcagagctccccagctggggcaggatgggaggggtggggagatcggtgttccccccaaccgggagtcccctcatcagcctggtacccagcacctctggtgacagcctctggtggcctgtggcctggctggacatctgcggcccccccagccgggagtccccttgccagcctggcacctagcacctctggtgacagcctccggtggcctgtgaactggctggacatctgcagccccctggccgggagtcccctcaccagcctggtacccagcacctctggcagcagcctccggtggcctgtggcctgtggcctggctggacacaacctttgacttgtcagaagtgagcttagttcattgtgagctgctgttacagcacaccacagtcagggtgatttagaatgaacaggacttcattggcccacagttctggaggtcaggaagtcacatatagagggaccacatctggcgagggccttcttgctgtgtcctcacatagcggaaggcatcgcatggtgagaaggagcgggagagaaggtgactgctgccatcctgtcatcaagagcccactcccaccctaacgagcccgctcccatcgtagctgcattcacccatccaggaaggcagagcctggtgacctaatcacctcctgaagatcccacctctcaacacggttgcattgaggattcagtttccaacacatgacttttggggagacacattcaaaccctagcacattctgtcccagcccccaaattcatgtccttctcacatacagtttacattcactccatccggtacccacatcatctcaaaagttcgaagtccagagtctcacccaaatcaggtactgatgagacttaggctcaaattatctatcttgaagcaaatccctgtccagctgtgagcttggggaatgaaacaagcctcatgcttccaaactacatggtgatggggagggggacaggttcccattccaaaagagaagcatgaagaaaggggtagcagccccgaggaagttcaaaaccccacaggacgaacctttctagaataatctttcacttggtgtgccacctcctgggcacactggagggaggcggccccagggcctcaggcagcactgctcatacagctttgcacagcaggtctcaggagttggagcctcgtccttgctgccctcccaggctggcgctgtatgctggtgacgctacagtcctggggtctcaatggtgcctccacttccatagatccaccaggcgtcatcccagggaactctctgcagagcctctgcccctgtggctggtttctgcacgggaccccaggctgtccatgccacactttgacctctacgtggagggcgccatggccgcagttcctgccttccttccctgcagctgcaggataatcagtacccatgggtgtcgccgaggccacacccacaccctccagagctgagccagagctgcccctgggcctgctggagccttggctgggcggctgacgggtgctgtgtcgcaacgtggggagcagacacttgaggggtgcagggcagggaatgctgagttcctgggtacctctttgaaaatgtggtcccccaggtcctagcttgcctcaaagatctctggctgcctcggggtcattctccattgtcttgttgagtagcacctggttcccatctgtcagagcaagtcccttgaggaacagtcgccctgaagtcgtcatggaacacggaggactcttggggcattgggggtgcctgaccctggcgttgccaggtcagaagtggagagaggaatcccgccctggggaaggggtcggaagtgggggtctcagggcagggagccccgtcctgcagggagccgctcccactgctgccttcacagctgtccacattgcctttcccagggctcaggctgacccaagagccaggaggccctgtccccattggggttagagtgaggcctgggtgtgcttgaggcagatgggccctgtggtgaggtgagggccagaggaggagggctgagtgggcaggtggacatggcagggtttcccatgggttctgggctgctgcgtgcatgggaggatgcacctcttacctggagggaggcggggtctggaggttgcagccctggggcctgacggtggtcctggctggggacagaagttcagcctggagctggggcacctatttttcccttatccttcccaaatccacccgagtccccttgtcctggcatccacctcctccctcgagtggctttggcctggcggacctgcctggcactcccctttggggtgatgcagggagcctggcggtctcggctccttttcctcatctcggcgtcttcaggtgcttctcgtggcgctggtcttgcgggagcctgtgtctgtcactggccgctggcccgggttgctcttctgccagcgagtgccaggaggacagccactgaggccccaccacaggccccctttgcagtctgtgctcgtgactccccaggacagcaggagctgagccagggcctcttgtgcatgcagctgaaggccgtccacaccactggggtctggggtgtcgggagggatgggctgcggtctcagacgccctctctctgtctccccagggcatgctcatcgagggcccgcctggcccagaaggccccgcggtgagtatccggctttatcctgtgacttgcagaaggtgctcttggtggggtggggttggtgacaccccttatgtctcctggatggaaaagaggggggctctccgcttttgcagatcccctgggagccggcgctatcccacccccacctctgccttggttggccagttggaacttggaccttgccctgcggccccatcttctaactgccccaactttatttttaattctagggtcttcccggacctccaggaaccatgggtcccactggccaagtcggggaccctggagaaagggtaagaggttgactgtgtttcctgagatcacacaaggtgtggggctgcccacgcctcctctccacactgtgacccgagctgtccctgcctgtggaggtgacccagaggcttgtgtcttcaaatcccccctcacccaggcactcctcacaccagccccgttcagatgtttctggggctgaactgtggctatggggagagtggggcccctcggggcccagggagcctgccagtgctcagcccagacggtggcctcaggaccctgcagttgcccagcaaacggccgcagcagcagtaaccacagcagatggctccggggcctttcccactcctcgcccctgggcagccacaccacgtggaattggccaccccccttgctgggtttgggaacttccttggtctgggttgcacctggctcacaggctcagaggcatcctcgggtgtccctcgccgcgggaggagatggagggagagctgctccctggctgccgcgatttccttctgacacctggtgggcgctccaagtactgcggcctcctggtgtccggcggggcgggagttttctcttcctgctgttggaatgaatgtggatttgagtgcagaaggactaagaactgattcctggacagctggcttgtgggtgggagaaacaagggctgcgtgcgggtgttcgcgggtgttcacgccagggccctgcctgctgtccggggcagagtgaggaccctgtgggtgttgtggtgggtggatgcagggcagggtctggtcgtgtgagaaggtggttcgtgatgtcagagcgcagtggctagggatgcttcccaggttactgcacggggaggcgtttggggagtgtcttgtgcagtgcctggtggctttgcagcagtgctcaggaaaggcgggccagggcgcaggacagtaagtcctggccttggacctggaggttcttacaggtgctcagtacccctggaaagctggggaggggcaggacaggtgaggtcaggcagcaggatgcaggggcaggcggcggcagccttcttgggagcaagagccgagccagtggggatgcttgcttggggaggagatgggagcactgaggccggcctttggaggagaaggattcaggtcagctatgcgggaggaggttgttatcgttctgtgtggctgggtgacctctgagggcagtacgcatcagattgggccacacagtaagattctctgccacgttgcttttcacggtcagggatttggaggtccagaagaggcgggtcttgctccatggcaagggccgtggcgggaaacagagtggggtgggggcttggctggcctctggagcacaaagctttcacagcatccccggcctggcagccacatttccaaaactccagacaggcaacagcgagtggccgctgctcttgcccagccagcaccggccaaaactccagacaggcaacagcgagtggccgctgctcttacccagccaggaccggcatggctggagctctgtgctgggggctgcagccaccccagctcgctctggagaccccttcccccagattcgcgtgagatggggcaacggccaagctcctcctccgcagagctgcctgcggatgggtccacaggtgtggctgggttcgtatgcaaaggagagtgcattgcatggcactgggagctgttttctctcccagatgtaggacagggtggtacccacagggcacaaatgccggttgacacacagggcacccagatgctgactgacactgcctcagtggtgttccacggctccgtcctccttctatccatccagcgtacagatttgtactgagtgcctgcagggctgggcactgctctagcctggggatctcaatggtgtgaaccagaggggtgctggttcacacctcaccatgcggtccctgcctttgggctgatcctggcttgggagtcactggtgggtggccctgccagtgccttgtgacaccgtgacctacccagctgccgtggaggagccaagggccctgactggagaatatcgttggtttaggagctggtcctcctcaaactcacatcagggtccaggagcatgaggactgaggttggggttggcagaggagccaactcctccagggtctgccatccgtggagtcagaggagagacctggagcccaccggcctccccagggcccttccagtgagaggggtgctggttccaggagctgagagctgaccacccctctgggtccagctccggccagccttgttcaggaagccatccctgctcaccgctcagcgccctcttgatgtccagatcttgctcgatgcccgctaatcagctgtgaaagatcactggctatggggtgaggccctgcagtgcagcctgcggtgggccgggctcaggtgcctgtgcggcggagaaacaacattgtctctgccctcggaggttgagcatctggggcctccaaaagacagattaacaagagaagaggcatacgattttaacacttttaatcttctatgcacgggggcttcgcagacaagaagtaaaaaccaaaaaaagtgcttgggttcgggagcatatataccattttaacaagcagcaataggatgtggagaagtggctagaccaaggaaaagggggtttgggcttcgcggggtgacagatggtgggcaagtgactaggaactccatggaggaacgaatggaagattaaggttatcttggcaaagtctgttgatgcagattcactgggggctggcctccctctcaggtgataaggggcgctctccaaatcctggtacagaagcagaggcaggagggtggggtgggaggagggggtaatgccctgcttttaggcagaagaggggaggtaagagaactcttcttgcgtccgtcgattcttacttggcttcagcagaaaatagtcgttctgcaggggagtggcgtgctctgtcccctccgtctgcttggcctcctgtgcctctgtctgggagggccttttccctggggtctggaagagccctcttctccctgccactcccaacctcccgccttgggcttccccagcccttcctcccttccccaagggccgtctggccgtgaccggtttgtgccttttcttcctcactggatggtgagttcctcaagacaggcctcacttctgtgcccttcctcacaccctgctccctgtgggcagccgtgggcagccgtggcaattggctgggagccgtctgtgcacctgtgccgtggcatcccactgggtatcatgcagccctgaccagctgctgaagcccacaccctgtgcctccactggctggccctgggtgttgcttccttcacacactctggtgagccctgcacactctcccgctgctccccttggatgaccttccatgctgcatctgccttctagcacctcaaatcctttcttgctcttgtgcccacggctgcccgcagggagcagagtgcaaggagaggcacagaagtggggcctgccttaagaaactcaccgtccagtgaggaagaaaaggcacagaccaggcacggttagacagcaagaattaattagtaaaggcattggaggaagagctgggaatcccgagatgggaggtctggagcggctgtgtccgggtggagaaggggctcgaaccatcatcccatccagtttccctcaggtgactggtgagcaggtgcacagctggggcaatgtgcccgcagggagatagaggtagacctggggttgaactcagatctcctgtggcagaaggaaggtggccactcttactttgaggttcagaggaaacccaagagagctgggagtccccaagtgagctgcaggccaggtggccgttactcagcccctctctggcctgggtttcttgtgggtctggcttctgtgccacctgccagtgcgtttctgtaggggctgactcttttgcgcatccgggaatatagtgagatatcagtgggtctgaaatcatgaggctgtgcatttgtgaaggttccctatgatgccatggtggcagtgccgtgcccctgtgggtcgctgagcagtgtttgcccagcgaagcccttccctgggctcctcgggcaggtgggggaaggagagggctggggaccatcagtaaagattcaggccccagtgagtcccgccttccatggacttccagggcccacacctgctagcctcgatagaaacacccggaaggcaggcgccacctctgtgctgcttgtgagcgccccctacatccattcgcgtgtgtgccccagagctggtgtccacggatatttgtgcctaagaaatgttccctgtgatcagagcgtctttgaggcgagtcccttcctttcccttccccgtgtgcctctccaaaagccttgcaccccaggcactcctgtgttttaaggcagctcctgaataccgtccagtgttactgtggatttgattgcatttttcaggatgctgtggccaaactcctcctgaatctccgcagtccactggagagtttaacgttttcatctagaaataagcttgcttaccgtctaattgactcccgagagcgccagctggtgttgaccagccactcatctattgctcttaagagagacttcacacagatctttccacctacagcatatttattacttttgggtaaagtagcgatctgcttctgggtctgtgggcaggtcccacctgctggggggcctggatcctcctctgggaagccccagggattcagtatgcaggtttctttcccagccgcctcagggtcagagtggaggcagtttcccaagctttctccaaattgccacacaggggcacctcgctccctgcacagtgggatgcatttgatgccttgggaggaggcccccacccttcaatgaccccattatgtgcagaagcagcctggcaataatgatgctgcccggcgctgtcttatcagcccctcctgtcactcagcaggggctcaaaccttctccccctcttttttatgtgtccaggattagccttccccatgggattttgcgtgagtgcattttctgtgccttgaaaagtttcgtatgtaagccatgccctgaaaaacagcagtcactacctcccagccagaaagtgtggctcacctctacctaacaggttctggtgtggtctccccaggaccagccttggggtgatgccctgctatgccatcccctccccatggcctgctggtgctacacccagggtgggagaggacacaggctagatcactggcaacttgacagagtgagcaagtccactcacgagcacgcagctgctgtctgactccgaaggagttagcttcgagaaaagctgtggggaagaagcaagcagcatgggattcatttgctttcctggctcccaggctcctgtggatgggacacgccaatccagtctctccttgtctttagaagtgttcaggacatcttggcagagctgctcagagaggttcacacacacactcaagcacacacgcttgcacactcacccacacatgcactcacattcacatgcactcatgcacacacactcatgcctacgtgcacgcactcatgcatacatgcccacacatgcatacatgcacacactcaaccgtatatgcacacatgtacacacccacacacgcacacactcatgtgtacacgcacacactcacctatacatacacgtatgcatgcacagtcacccacacctgcacacactcatgcacacccccatacatgcacactcacacccacacatgcacacacatccacatatacatgcatgcacacacacttacacatgcacactcacccacacctgcacacacactcatgcacacactcacccagacatgcacacaggtacgctcacacacatgcacacacattcacacatgcatgcacacacccatacatgctctcacacagttacacacacatgcactcacacacctgcacacacattcatgcacatgctcactcatacatgcacacacatacacccacacatgtacacacattcgcacactcatgcatgcatgcacactcatccatacacatgcacacacatttacacacatgcactcacacacctgcacacacactcatgcacatatgcacacacccaggcgtgcacgtgcacacacatctacatgcacgcgtgcgctgtctgggttcacctccacacggcccttccatggaggctggtctgcaggcttgtgtgcccgaatccccagcagcctggtcgtgaatgacttctggccatttcgagtcacatttatcttcaaagcttagtcccctgaggccactgataggaatctgtccaagcctcaggtgccataccaggagatcagtgggaactgtgggtttctctgctgtagccctggaggcagtgtgtgtctcccaaagcgagctcagtgttgaagattcattggagggtatacattatcatatggaaaagaaaatcaagtacagtttgtggagagagaggtgaagggagcaaaggcctcgggacatttctagagtgaagggacagctggcaggagctgcatgaatggcgccaagtgcactatgctgtaggaccccatgcagggtctgccagggtgttcatcacggtcagttagtggcaatggctgggtgagtccaggagtctttctcacgtgggccccttaaggccgcaggtcttacccagagccccgattattggtggcctatggataaagagcccctcctgtggattttctggttgttagttctggttgaggggtgcggtctgaggcatcaggcttcttgatagggccccgcttccagtcttttagatgggccctagggctcctggaagagtgtctgtctagctcttggaaggggctcagtaggaaccctctcaatgaacgaacgaatggtgggttcatttctttgggatcctcggacaattgatgaccaacttggggtttaaagcaacaggaatgtcttctctcttagttctggaggccagaaatctgaaatcaaggtgtaggcagggccgcaccccctctggaggctccaggtgagggtcttcctcacctcttctggctcctggtggccactggccgtcctctgcccttgtagcttgccggcgcatctctgcagtctctgcctctgtcttcacccagccctcccctgtgtctctgtcactgcctcccctcctcttcccttacaaggactcatcattggatttaggacccaagatctcatctcaagatcctcactcccatcctcaaagaccccaagtaagggcacagtcacgtgtttcaggacctggatgtacctttgatgagagacccttcagcccaccgcgcgtggtcatgcacgtacgtgttctgcacagccaggagatgtccagcaggaagtgaccactgagagcttctcccagccactcccgagctgggcctgcccagggtcgggcctggacagaaccacatgcacacaaaggttctggagagacgcctgcacactgccctcctgctccagctctttccgagagtggaagggagcttttcaacacaaagcctcctgcaggcctacagctcctcccaaacctgccaccaccatgaagagaaaaggctcagagttctctgctcactgctttgacccaaatcccggcctggaaagaggccttgtgcctctcccctgaggttgagccgagggtctcgtggggacagtttcacgtgctgaatctgcagtggcagagggagccactttgtgaggcatctggtcacccagccacatcgtctctgtgcaaaggacgtctggacgtcctcaggaaagaaaccctgttagataccagtggtgccttcatttggaagtaggcacctgatttcttcacctggtataggtatgacactgagagccctcctgtgccagggccttcagaacattgctgtttgaccaagttagggcactgatttgggggccagctaatggagtaacaggaaaatacatgcaaatagcaaaggcaaggtgggatttcttattttgccatattttgcctgtggctggagccaagcagcatccgcatgacctgtgtgtgggcctgctggagcgttcccttggtgtctgacacctgccttgtcgcagacaacagccacatcgctggcccgtgctttgtgtcatgaaaattggaaatgtgactttgaggtgtagccgtgtctttcagcccaggggtcaaagtctttacgttagagaccacagggcttggcaaaggcttgctgacaatgtttctaagtgatagcaaatgcaggttcatgttggtggccctgaggacttgtgtcaaatttgaacacttcggaagggttcatgggggtggcgacattctttcctttcttctccacactgtctccttcttctaggacttcacgttatccttgttcatctacgttcccattctttggaattgttccgggtgtcggtgagaagcggcatcagagggaagttgctttcacagcctggggattggattttcaccaccgtggcttagaacaggcaggaaggatgctgaaaagagggtctttggaaatggacagcagtggacaaggagtggccttgaggagacttcctggcttcctacagcaacaccatgtgagcaggagcatgcatgcacagacacacatgcacacacatgcattcccacacaaacgtacacatgcatacacacatgcattcacacacatgcacacacgtacacattcatatggacgttcacacatccacacacacctgcatatgcatgcatacatgtattcacacacatgcattcatacacacatgcattcacacgcacattcacacacatgcagatacatgcacacatgcattcatacacatgcagacacatgcacacatgtattcatacacacatgcaaacacatgcacacatgcattcatacacacatgcagacacatgcacacatgcaaacacatgcacacatgcattcatacatgcagacacatgcacacatgcattcatacacacatgcagacacatgcacacatgcgttcatacacatgcagacacatgcacacatgcattcatacacacatgcagacacatgcacacatgcattcatacacacatgcagacacatgcacacatgcattcatacacacatgcattcatacacatgcagacacatgcacacatgcattcacacacacatgcattcacacacacatacacatgcattcacacacatgcattcatacacatgcagacacatgcacacatgcattcacacatgcacacacccacaaacatgcatgcacagacatgcatccacacatgcatacacagacatgcatccacacatgcatacacatgcattcacacattccacacgtgcacacacatgcattcatgcatacattcacacacatgcacacaccccatgcattcatatgcacacccacacacatgcacacatgcatttacacatgcacacacatgcctttacacatatatgcacatgcacacacacatgcattgatagtcacatacatgcacacacatgcattcacacattcacacacatgcacatacatacacttacattcacacatgcacacacatacacttacatccacacatacatgcacacacacttacacacatgcactgcacagacagcagcttgtccttgggagacactgaccccaaatcttaaatgcaaggtttggtttggaattgattccgacacaggaatctcagctgtaagtggctatgaggattgtatgtcaatgacaaaacctgggcggcaaacatgttttggatctttattttttaaacacgatttttgtcttctgagagtgttttccaaaatggcagttgggagcaattgggcagtatccattagcaattcagaaatatacacatatatacattctttgacccagcagcactgctttgagggacttacctagtagaatatgttagcacgtctgtcgggcagtgtttgtcataatgcaaactggaaccaatccaacgtgcatcggcagaagacgggttaaataaacaaggagtccattgtgcctgggagatgcaacagatgttgccaaggatatctacagagacaggccatgatttcaagagcaaattgcagaatatttagggacagtatcattaaaaagaaagagactgggcgcggtggcttatgcctgtaatcccagcattttcggagcccgaggcgggtggatcacgaggtcaggagttcaagaccagcctggccaaggtggtgaaaccccgtctctactaaatatacaaaagttagcccacgctggtgtggacacctgtaatcccagctactcgggaggctgaggcagagaattgcttgaaccggggaggcggaggttgcagtgagctgagatcatgccactgcactccagcctgggcaacagagtgagactctgtctcaaaacaaaacaaaaaaaacaaaactccgaagccacacagcctcatagtgatgaatgtgttagttagtgtgtccagcatgtgcgtcttcatctttgcctttgcacttacagaacttgagcactggttacatccggagatgaaaagggacctttcactttcactgtataaatgtgtaccttaagccatttcacaagaaatggagttacttctgcaacaaaaagcaaccagtaaagacaaggcaggcaagtttaggttcaggcccagatggctccacagccttctggatagttccagaaaaaccactcaggttcttggtctttctgtctgggagttgggaatccatcatgggtttcctggcagggagcgtctcactcaggtggtgtgaacacacatgctcagtgtagctgttgctgattcggaagactgcagccagcacccatccgctacactggagtgtaactggagtgtagttggtggaggcttttctcactggggagagggggttaagctccagtctctatgcaagacaagcctcatctactttaggccagctgagaatctgcttgcttttgtgaaatagctttgtgatcaaatattattttgaaaataaatcatcttactggttttacatgcgtatagtggtctgaagctggctggaattggtctagagaatccagtcctaggtatgtctgtgtggccaggttggctgggcgtgaggagggcactgtgtcgtttacatataagtgggttcttgaagttgctgtggctgagtgtgtgctctgctgtgttgcgtgtccatccacgcaagtggctgctccatcccgtcttccatctgagcaggcacaggcggctcgctcggagcccattaaggacaagtgcccactgggcacaggaggcactgggccttgagcctggagtctttgtttcctgttgggtatggagacctaaaaggggcgttcctggagcgacaagagcctgacactgcctcctcaccttcgggctccttgtctctgccttgaggccccagaggacgcctgctgggtctctggatttctctatatccagctcagacctccctcccttcttatccctccctccaaagcctttccgatcctcagcccacagccgtgcccctcccttctccgggtgggggtttctgaaacattcctgccacggggtctcacagcttctgtgcgtgtccagtgcatttcccgggtgggccgcttctccgacgccctcattctcgctgcagcccagccctggcctggttgcactctgacttgtctctcttggccccttgtcttcagggcccccctggacgcccaggccttcctggggccgatggcctgcccggtcctccaggaaccatgctcatgctgcccgtgagtacccttatcagtcggaggtggggaggcagctggggcaggtgggatccaaaccagaccctctgaggctgcgctgtcactggagaggcctgtgggccccgtctcagtctgtggtcttgcctgggtgccacgtcactgctcccagagtgacccttgtcttacacttgcagttccggtttggaggtggcggcgatgcgggctccaaaggccccatggtctcagcccaggagtcccaggcgcaagccattctccagcaggccagggtgagtactgctgggtcccaagaggcctgaaggggacagagcccagccccaggggccaacaggagtgagtgagtcaggctcagagcccaacttggagggaagcagctgtcttgatcccagaatgcctgcttgctggggtcaggagctgtgggagcgtccagtcctcagtgtccagtagggaccccgagagcatgtcagtgtccagtaggggctctgagagcatgtcagtgtccagtaggggccccgagagcgtgtcactgtccagtagggaccccgagagcgtgtcactgtccagtagggaccccgagagcgtgtcactgtccagtagggaccccgagagcgtgtcactgtccagtagggaccccgagatcatggggactgtttggggagtttctcagcagttctttgtccatgctgagggtccgggttctaactttacaaggggcttctgggcccctccacctctgacccagtaggcccaccttccaccgttggtgacctttgcctctgtgctaggccctctgctgggatccagaagtggagccggaaacccacgtggctcctggaaggggctgcctgggctggagctgggctcctctgggagagagcccttgggccccagagcccctcactctcagcctggggggtcctaaggagcagggtccgcagaggagcacttgcctccctattgtgaagtagctcattagtggcctgtgttttctgtagacttggctccggattgctgattgcccacgataggtgtaaacactgccccgtggggcgggtgggtgggtgggtaatcctccagcggagtgcaagaaagctgctaagtaatcccttgtttgagaaatatttatgcagctcccacagcagccagagtagatgttaatgatcagagtgcttaggtaattacaggacagtgtaagcacagagtcgttaccatggagcaaattgcctgaatgatggaaggtggtgtgtagcaaaccccactacctgccactgggtttatgggcttgggcctgcctggctggccttttatcttgtgtattttaattgaagctaaatggatgataggctataagattttataatgcaaaacaaaatattctaaaattcagatggcatctgccagggaaacagagtcacttggcagctgcagaagcggctctgtgggaaagcggtgggccctgcactggtgcaggtgggggccacatgcagagggggcaggtgggttcctaccctcccaaaatacttccccagtggctgggagtgcttgaagcgcctcccatgtgaaataaaatatgtcatgactcagcttgagctcaggtgtaaaatgtactccctatgcccagagtaagaggcttatttctgacctagccaagggtgatgggctgggagcaggccctctctgtgtgggctagagagacaggaaggagggatggggcctatcccccaagggaggaaacgggggcccactggcttgcacctctgcatgtcccacgtcactcccgtggatgctgagagccccatcgaagtcggggggggggggcccttggggagtcatcagacctccttttccagagtctcctgtccctcctctgtccagtctgcccgttccctcctgccacatctcacggctcaggcgccagcaaaccggagcactgctgctggggccctgtctcagcgtgtctcactttcctttgcagttggcactgaggggaccagctggcccgatgggtctcacagggagacctggccctgtggtaagtcattggcaaatctgagagctgggcgtggtgtggggattggcccactccctgtgtcgttggcggacagtggcaggtggccctggggtcctgtggacacagagcggcccttggtccagtgcctgttcccaggagggtggccagggggaccaggggcctctctcggtgctgctccagcccccttgttggtggggggtggggatgggtgactgtgcctcgaagtcacttgagggagttcagcggggtagagctgacatcagcgatcctgggaaacagcctccaactccatcctgaatggaaaggagctggcaggaatcagaggaggaggcccctcctcacccctgcattggagttccaggctccccctgcagagaacacgctatgagctgtcaccagaggagtggctccttagagggatggggtcctgctgcagccaggggcctggggaagtccctcgcacaggctgtgactgccttgtggagcaggggcctccattgatctttacagccctgttccagagttgaagataactaagtgtggggcagaacgcaggatttccagcctcacccgcccctgccctgtggcctcaacttagctctcatctggggtcctcgatgcatgagaaacatacagtgtgtgcccagggagacttgggctgccagtgtcaggcacaggggctgggttccggggcctctggggaggagtgtgggtttgcaggcacacagaggagttcaacaccacaggggccctcctggctttgccacctgccactgggtctgggctcggtcgcctccacacagggcctgactcagggctggcctcccacatctgggggatctggccttgaggggcctgtagcaggtgcatacgctgctcgaagctttgggctgtaacggaccacggtcaggttcaccccggagagagaaacatctccaggagctttgtggtgtttgcgagccccaacaactagaattgtattcctgattaggaagagatccaaacaactgcatttcccggctcctggaaagtcatcgttcttccccccggttctgttcgaggcagacaggtcgcgctttgtgtgctgagcaccgtggccgaagccctgtcccctccccctgcccctcccctgccacccccagcccttcctgtgttctcgagtccccacctcgagcagacattaacacacaccatgtctccctagggtccccctgggagcggaggtttgaagggcgagccgggagacgtggggcctcaggtatgtgggatccttgccttcgctgtctggtgggcgcctcccgttctccggcggcagcgacggcgagcatggagggaccccaactgctgcatgttttcaaggaaattcgtgggaattgtccttgctttacgcagtgctgagggtggagcacaatgaactctgacacctgcggcagaaatgagctggctgtattctgtccctggccttcattctgggcagcagatccgtgtcccgtccccgaagtgcccacatgtttgtggcttggacagccaggcatgggcagggtcgatgagcacagggacaaggctttgctctttctcctgagaaaggcggactcgccactgaccctttgtctcttacccctggcagggtcctcgaggtgtgcaaggcccgcctggtccggccgggaagcccggaagacgggtgagtggtgcgagtgtgtgtggtttagtgacagcagcttgggcgctggaggagcccaaatctggggtgcgggcacccccaacagccagctgggccacatgaagccaggtggctccccttcttgtgatgggtgcgtccatccccaaggctgcctctgagccagctgcctgggaggggcgctctgtgtcctgggcgcagacacagcggaccaggcctcttccctgggcacattcatttagtttaataaacctttctaattcaagaaacttcccaggccctttgggagcaaatgttaagaagacaaaactatcagcgggccttatatatttcgggcagcactgggactccagaaatggcctgattcgggggcatgggcgggccttcctgcgccttacctgctgtcttgcctcctggaattttctgtctggtgcatggttctcctggatggaactggtttgtttgcacatgaccctggcttctaaaagaggacacacgtttcccgagtgctgaccaccacccagacaggctggggcaggccctgggagcccagattgtgctctcaaaagtggaccttttcaaccagcagacctttctggtgaacgagagaaatttcggtgcagggttggatttgtttcagtgtggacctcttcccagtatgttgtctacctaagctacccttgactgctatagtctgagtcaacaaggcaaaaatgggtccttccctagtggttctggatgctcctgacttggggagcaagctgtggttagtgggtagaaatgacccgataagccgcagtttggcaggtccgagggtctatgcagggatctgggcatgaaacagaggcctgggctggataattccaggaggattagcagctctggaatcgactcttggtagacaattgggccatttatttggatctgattctgaaaaatgttttatttccttaaggtgtttttgtgtgtctccgtaaatccttcccacccagtttcactagaactggtttcctagagtgaggttaaaaactggaacaagaggagactcgggaaatgctgtctaacatggccagctgcagagttgcatggtgtcggggccatgcatatgcgtgtgttttaaggcattaagtatgcccagaagatctgctgcagaagaaaagatggtggtgagagaggggcttggagctgaggggtcgattccaaagtggtctgagcagcctcttccattctttgctagcatttcctgcaaggaacgctcgcttgtgaattgtagaagcatctgggtgctttgcggggctgagttgtgctgtgaaatcctgtgaagttttccgacaatcttcccttggtttctaaaagtgtttggaaatctagaagaggctcccaatgggcccctccatttgcccaacagggcgatgtctttttggggagcaacgggagcaccgactgtctccttggggtgtgtttggatttctctctttttgcttctcggctgttctcgggtgccaccttgtctgtctccagtgctttgagaccctaagctgccaccctccagatcttctctctgcttggtggtgggttgggggcaagggcctcatatgaggaggagcccctggaaaatggaagtgcagggtggcagccctctatactcgctggctggggtgcctcgttgtgcagggtggcagccctctgttctcgctggctggggtgcctcattggcgtggaggtctggctgagtttcatagagaccctgttcccttgcagggctctcctgtggtgaaggtggggcctgcacagtgggccccggaaggtctaggtcccctcttcagccccatggccagtcagttgggcaccttgtccttgactgtgtccatagctggccatcaggaacagggcatctgctcaccgtgcagatgctgcctcccgtcgctgtgtggtctgagtgagactgggcctcacttggggcctgggcctcttccttagccaagtggacaaaccagatgtgtcctttctctctttcctctgacctccaaatggtggaaaggagctgtgctgtctgtgatgtcagtggcctgcactcgcctgagtcctaaattcacggtcccctagactgacgcagctcctccagccgggtctcctctgccacattgtggcgtcttctcgaagcccaggggcagtggcgtgatccccctttgacagtctgggatgacgtggtccggaaagaccagccccgtgtgttccatccgttggtgtgaggcacagaacagccccgcccgggctcctggatctgggtcctcgcagcagcccggccactcgggctgtgaccttgggggtgggcgcggctctggtggaacgctcaacttggtttaacggaaaaccatggcccgggggtctcagtgaaccggggctcttttgcattgacggttttgcctcctttgttccagggtcgggctgggagtgatggagccagaggaatgcctggacaaactggccccaaggtaggtcacccaccaccctcctggtgccctggcatcactgtcatccctggggtcatgttgatgatgtaaccaaaatgctggttatgtgatgactacgattatgatgacaggtggctccgtcactggcatttgacgtgaagatagggttggtgggtgaatttcgccagcaagcgtgacagttgcagttcattttcataagggagaaatttgctcccttccagcagtggcgagcagggatgggggtgggatcccgactatgaaaaccatccgtggccgtgcaggtgacgaggcgcatgtagggcagaggcggggcatatggcaagtgcgggggccagggggtcttgtccagtcgggactcctgggtgttgtggaggtgagtagatgttgcccgtggctaaaggcagggctgtgtgtgtggcatgaatgaggctgcaccaggcatgcaccagctgttgctgtcgccactcatgcctgcccgctgctgtgctcagtgtatccacccctctgccccagcactgctgtgagcattgccccggtcttggctcacccctcctcctcgcctcttggaagcatttgtcccaggccacggggggcaggggagatactgaccttccgtgaagagtgcacctggggacagcagctgtgatttggagattggagaccgggcaccaaaaaaatgccagggctcaactacacctgttccctcttaacgggcgtggatgagctctgaagtgcatcccgtcagtcccaagctagtgaggtggcctggggtgacaggaggaaacgcagtcttgttgactctgtctcagaagaccatggtcttctttcaacaacatggctgaaagcctaaaatgtcccatcatcgacatcaccccagatggtgtgcacacccatgagacagggccctgttcccgggctccagggcatgcagaagaggggccggccagagagccaggatgcctgagggtagccagtgctggcccgtccaccaatgggtacgcgtacctcctgagcgcgggcagcccctcggcaccatggatacagctgtgagcggacacaccgggaccctgctctcctggagcctccctggggtgggggagatcagcagcagacactcacacacacgggaaactgcagcggtcgctgaaataccgcatgactaaggacccgtcggggcctgggacttggggatgaaagtcatctccccctttgcagcccatgttcatgtttgcaggggaagaggctgagattgtagatgcaaagtgggggcctatggggagagggctggccgatggggttcagggtgcatagatgctgtgtgaaacgtggtccaaggcggggcggccatcacttggtggacaccaaggcggggtgtccacgtgtgcagggtggcgtctgaggcagcctttctgtcctttttgcagggtgaccggggtttcgacggcctggctgggttgccaggcgagaagggccacagggtgagtatttcctctgtgagacacaggcatgacgatgggcagcagaggtgtctctcgggaggcccttctccttccaggcagcctcagatttcctgtggggtcaggtctccgccattccaacagtcagtatacaaacctcacgggagtcagcaatggcagtgagccccaagatgatgtctttgttgatgggtggccagcccaaaggaattggagctcttatctacagtttgtgacaagtgagccagatgggcctacccacctgaggcgcgtgaagggggcagggaaggagcccttccttttagagatctgtttaatggagtcctttaacatttcaggaaatccaagcagctgccatttcaggggcggccaaggacactttgcaatattaaagtggtggtcccaagggggtggggacaatctcaagtggccatgtggagaccaggtcacgaaaacatgccaggtgtccccctgttccctgttaatgggcgtggatgaatttgaaagtgtgtcccgtgagtcccgagctagtgcggtgacctgggggtcttcctggctgcgccgtttctatgtggttgttggagaacacagatgcggcagctttggataaacggcaacagccaagcccctcgaatcttgaatctgtctcaatagactgtggtcttctttcaataacaacgtgatagaaagcctacaatctcctgccctgttgaggaggtgtggtggggaaggctcgtcctggccgcctgccctgctttctcagcccatttgggggcctgacatgagggctcttcacagcttgtggggtgttccttctctgacctgctttctgtgaagcagatttctctgatggctcctttatattttagcacactgaggacatacaggcacatgagtatgtgagtgcacaccccccatgcacacacacacccacacatacaccacatacaccacacatgtgtgcgcgcacacactcatacacacatgcacacacacgcatacacacccacacacccccacactcatacacacatgcacacaagcacacacacacacccacattcatacacagatgcacacacaccacacatgcacacatacgcatacacacccacacacacccacactcatacacacatgcacacacccacacccacacactcatacatgcacgcacacacacccacacacacccacactcatacacacatgcacacacacatacacacaccacatacaccacacatgcgcacacacactcatacacacatgcacacaccacacacccccacacatgcatacacccccacacccccacacacatatgcacacatacacccatattcatacacacatgcacacatacgcatgcacacccccacacccccacactcatacacatatgcacacatgcacacacccccccacccccacactcatacacacacaccacacatgcacacacacccacgcacccccacactcatacacacatgcacacacaccacacatgcacacacgcatacacacccacacccccccactcacgcacacccccacacccccacactcacacatgcacacacaccacacaggcacacacacacccatgcacccccacactcatacatgcacacacacgcatacatacccccacacccccacactcatgcacacatgcacacacatgcacacccacacaccccacactcatacacacatgcacacacacccacgcacacacgcacatacacacccacacacccccacactcatacatgcacacacgcatacacgcccacacacccccacactcatacacgcccacacacccccacactcacatgtgcagacaccacacatgcacacacatacatgcacacacacatacacccccacacccccacactcatacacacatgcacacaccacatgcacacacacgcatacacacccacacaccccacactgatacacacatgcacacacgcacacacccccacaccccccacacatacacacatgcacacaccacacatgcacacacacccccacacacccccacacatacacacacaccacacatgcatacacacccccacacccccacactcatacacacatgcacacacaccacacatgcacacacatgcatacacacccacacacccccacattcatacacacatgcacacacaccacacatgcacacacgcatacacacccacacacccccacactcatacacccacacacacacgcacatacacacccacacacccccacactcagacacatgcacacacaccacacatgcacacacacacacccacacacccccacactcatacactcatgcacacacacacaccacacatgcacaccccccacactcatacatgcacacacacacccacacacccatacacacatgcacacacaccacacatgcacacacaccccacacatacacgaacaccacctacacatgcacacacacgcatacaccctgacacacccccacatgcatacacacatgcacacatgcatacacacatgcacaccacccacacatgcacacagacgcatacatacccacacacgcatacacacatgcacacacacacgtacacacatgcacacacatgcatacacacccgccacacacatacacacatgtataccaccccgatacacacatacacgtgcacaccagccacacacgcatacacacgtgcacaggctccacacatgcccacactcacacccacatgcacacacatgcacacgtgcacacaccccacacatgcacacaacccacacatgcacactcatacccccacatgcatacacgccacgcacacgcatacacacctatacacacatatgcaccccccatccccccacatgcacacaggcatacacatgcacacaccccacatacccccacacactccacccacacacgtgcactcgcatacacacatgcactcacacaaacacacaggcgcacccacacatccacccacaccccactgctctgttgattgctcccgtaagcatgccctgcagccctccatgatgccttgagaaggggcttggctgttgccatttatccaaagctgctacatgtatgttctccaacaaccacatggaaacagcacagccatgaaggctgtccctgactcagctccagcccttttgcacgactgatgagcacatattgagcacccactgcgtgcgagctctgaggctgcaggcaggcggggctccctgagggtatgagcgtgaggctgcttcacctggagcacttgggctgaggatagctcagacctcggctcagtgtcctgaggctgcccacatgtgtggccctgccttgcgctgctgggtgctcagtccagcaccctcctaccttcaggccatcgtggtgagactcaggtgagagtctgcagcctgcattagcccggctgaggcacacgtgatcttctaaggaaaattcccccattctggaagggtcttttgagagcttgggaatcttactgtcagaattagagaaaaacaaagtgggaccttggacaagccctgcatgacctgctcaggagaggctgacgttgaccctttcacttcctagggtgaccctggtccttccggcccaccaggacctccgggagacgatggagaaagggtaggtattctgccgtccctccgactgctcctgcctgccctactcctcagtgatttgggcaggaaaaccacagaagagaggcccaggtgtgggattggcctgccgcatgtggagggccagctgggagaaggcagatggggattccagtgggcaaagcgattgatcagatgccaagaggctgcggggcattggagagaccctgactgcaacgtttagttactccatcggtcctgctgatggatggagctcggggccagctctcagctctcactgcaggatgcaggtgccccaaaccccactgggaggaaaggtggccagagcgtttactgagctcagcgtctctgcttatctcgtccagatgaggagttagctggaggcatgtgggtggcagaaagctgagatttggaggagcagaagagggtggggggattggaaataaccctctgtgggcctggaggtaggggagcgagtggctgtggccatggggccagagcacaggagggagctgttctccagcatggacgcacaggccggggtctggtatctgccacgccgtcttcatgtgtggaggcgaagtgggatctctgggccacagcacagtgggattggggcatgggatgcacgaggctgtgggtttccaagctcttccctgcaggcaccgcagtcactcagacgccttctttgtatgtgagaggtgtttagggggaaagctttaaggagctctggagggtgagaaagaggagcagctccaggggcatttctgtctcaccagctttcaggctgacatggacggggcacctgctcctgtgtgggcctcagcacagtctgctgtaagatgaggaaggagagagggacccttctagatgtcagtgcttcttgattgagaggacgtgtgtgtgtgtgtgtgtgtatgcgtgcatatgtgtggctgtgtgcatgtgtatgtgcagggagtgcacgtatctgtgtgcatgcatgcacgcatggctgtgtgcgtgtgtatgtggacaagcatgtgtgtatggctgtgtatgcatgtgcatgcacagggtgtatgtgtgtgcacaagcatgtgagcatggctgtgtatgcatgtgcatgcacagggtctgtgtgtccatgtgtgtgtaggcatgtgtaggcaggctgtgtgtgagcatacatgcttgcatgtgtgaggcgggcgggaaggtgcagtggtgctttggcgagggacagtgtttgcaaacagcccgtgggttgaagcagtgagccagggaggcattcccttctgcagccaggaggaagcctcttgctgtactttccaggctgtttaggaccccggcagggacacctggttccccagagggtggcccaggggatcttgtgactctcccctgatgccctgtcctgccccagaggctgtcattcaagaaggtcaccaaatcctttcaattagatgctctttctgcccagcctttcctctggagagctgtggcatgtgagctcctgagccggcatctcagagcctgcaggcttcacctgcagtgtctgcacacctagcagcttgctgggagcgaggacattccaggcctttccggctggtaccagagctggtaaacctggcgtatgtgaagcagccccaagccagagaacccttgtgcaccactgaggggaagctggtgtccaggctaacagctcatttctctaaccttgccttttttctcctctgcagggtgacgacggagaagttgggcccagggggctgcctggggagcccgtaagtctgtgagctgagtgggacggtgggggctcagtgtggagaaaggctttgtccaaggctcctgctggagcaggatctgggatcagccaggagcttagaagagagagagctcgacctgagaacagacggacctgggcatctcccagggaagccaaagagaggaggcacaggcgaggctggctggcaactccaggaggaagtctgagcctgcctacaggagcaagcctggccctcaagggttgttgtgggggtccaggggcagcgtggtggggtctgggggcattgtggggagtcgggggcagtatgtggggtccatgggcattgtggagggtctgagggcatcgtggtggggtccggggtcagtgtggggtgtccgagggcatgggggtggggggtacaggggcatcattgggagggtccagggtcagcatgggtgggtacaagggcattgtggggggtctgagagcattgtagggggtctaggggcaacatggcagggttcagtggcaccatagggggtccgagggcattgtggggggtcaagggagaagcatgggaggtctgaggtcattatagggggtcagggggcggcatggggggttcaagggcattgtgggggatctgagtgcattgtgaggggtcccggggcagcacagtggcatccaggggcattgtggggggggtcacacacctgaatcagcccgagcttgggcccgtttcaatggccacccttccagaggcagattcctccagcagactctgccccagccctgggcatgggaaagctcttccctaagcagacatatatttaggcccagagcaaatttcctgatggataggacattaattactattcatttactgttgctttaaagcatctcttttctcgtagccaagtcagcccggctgcgtgcgtcaggtggtgctaattgatgagaaatatagcaggcactgcatagaggaggcaggggtcggtgcctgcagactcatttgggactaaattataccccagatgtctgattagcctctaaggagaattcatgaactccactctctccttaacacatgtccaagtaataccttctgggctgttagcttccaagaaatgttgctataactaggtattaaaataacgaaggaaacatttaagaggcagtaagtgggggaaggagttctcttctacagaatctgaaaaggttctgtcaaaattaagggcacttgaagtccacgtacctggggtgaagcctctgtaattctccgtgggtggggggtgtgagtgccctgtggcaggcagttctcccggaatctcactccacctgcggtaaaggggaggttctgcacgagcctcgccgaccggagagggcgtgccagctcttgcccagagtagcgtcctggaaaagatctgtaccccacgcctccttctgcacattcagtcttggggttcccaccagggactagtttcacctggtgctctcctgcccgcaccctctgaccctgtgatatcataaaaacaatcgtatgtcgctgcggaggggaattcaggagcgagccggtaatgaggatagggcacaagggctccgtgcagtggaatgttatagcgtggtgattctctgggggagcgtctgctcacctgccccagcaagtgtcagaggagccggtcagcttgaaagcccccctttccctgagggtgccctgtggtgtcctctctgagttctcaccaattccagacacctgcccctggttcccaacaccagggtggggtggagggaggcagcgcagcaggctgggagggagtctgggcctcactcctgggaggccaggaggcctgagtcaccagctggggttctgggtggagtcagggccaagtgggcataggggacagagaggagggctgggatttctgcccgagtttaaatcctattttccctttcctcttacaggggccacgtggtctgcttgggccgaaggggcccccaggtcctcccggacctcccgtaagtcccattaccgccctgcttgtctgcccccatctcggcctttgagaccccgcctcccagccggtggacgcttgggcactggggcagcaagtccgtgctggcccctctggcgcctgcctgctgccagtgtgaggcgtgagcgggacactgatgttcagacgctgtagacacggccccagcaggtgtggccttgcaggtggaggcccgaggctgccggcctcacgcctccgcttcaccctggctgcacttcctcctggcagacagcatgtgctatttcagttataagcagaaacccaggatgtcacgtttcttccctgctagaaagaacttccagcagcttctgtgaacattctggaaggaggctgaagcccttgattccagtggggctgtgtcccggtgggcagctcccccagggccaggcctgcccccttcagccttcccagccccgtgacctggttttctagaacctgaggcctgccccgtggaatgctagggcctggcagttcagttaacctttagctgagggttactggggctgatcagtggacctctgggaagggatttggagtcaggtccttcccttccccagagagcatcccgtcctctgattcgtcgtgggatgggcgtctgagctgagttgagtgggattttcctcttgagcactgtgagttctttcgcattcagttacatgtttttcttcttaaaatcgtacacagggtgtcacgggtatggacggccagccggggccaaaaggaaatgtggtaagtccctggggtcccgtggcctggcttcaggggcactttccctgggcacactccttgcctggctagggaggtccatcgctgtccacatcagctgggaacatgaagggcaggttgcagaccctctgctgtggtgcccaccctccagtggtgagtggcacctggagactttagcatgatggggtgacttgggagttttctgcccaataaatcatttctggtcagttcctctcacgtgttccttcctggtcggatgtctgggcatatttgcataaacgagttagtgctcactccatcagagtcaacctccacagcctcagaggcgctgagtcctggggctgctctctgtggtgggacccggccgcctttcccttcccgctggcattaggcagtggggagcagtttgaaaggatgggaggccagtgagggggcacacgacacccaggaaggggatacagttcccagagcccccttcagtgcctttgctcttgtctcctgtagggtccccagggagagcctggccccccaggacagcagggtaatccaggcgcccaggtaagtgagcctgagagaggcagctcgcagggatccggccgtgggaggcacacgtctccagtccggagccctgggaggaagcggggagctctgtcccctccaagtagcagcccctccccttatctggagggagactaggacctgggttggtgcctggatgagggagacatcaatgagaagatggacagatggcaggggagggttctgagtcaatcagcgccctcaccttccctttctggctctttctccctcttagggtcttccaggcccccagggtgcaattggtcctccaggagaaaaggtaggtgggcctgggctgtgttgcaggccactgcccgcctgcaggtggattccctggccccaccctgggaggacccctggtatccaccagctctcaatgtatatcttggtgctcccaagagacgccaaagctcagagtgccaagaactgggccagaagcatgaggaggattttggatccgtgtctcattgattcatacgtttattcattcattcattctctagtatgtataggggttgctggatttagcaaggaacaaaaatacaggacatgcagttaaatttgaactattgtgtatctgaaattcaaatttaaccgggcatcttgttttgttgttgtttattttggtttagtctagttttgctaaatttggcaacttgactgtatctccagagcctactgtgtcctaggccctggaacgagagctggaagtgcttgcccttctagagcttgtcgcttaaccaggcacaagatagttcaggtagctccaagtgccttggttgcgatcagcaaaaacacctccaaggggctggttctgagtgcatgagaatccccggggggcctgagaaacacagagggctgggctgctgccaggcctgggaccttccaggagctgctgtttatgggatactgaggctgtgggccttgcactgcaggatgccctgccctgccctggggtgttgatgtgaacagaccagggaggacagggtggtgggagcacttgaagaaggcacagcactgtaagagcagaggaggccagatgatgcccccccgggccccagtatgcagcaggtggatgtggagaagaatgggggcacttggtggactgattccgttcctacagcagaacctgaaggtgctgagaacagtggagccgcctcctcctgggcgctaccgtggctgcacgcctcacagccagggacccagtgcctctgaccacacttctcagcaaatgctgtgtgggcagaaatgttgaaaagtaaccttggtggccgacggagaggtcaggtgagcctagggagggcatctcctcatggagtctctggtttgttctagggtcccttggggaaaccaggccttccaggaatgcccggtgctgacggacccccggtgagtagccctgcccacctcatccctccatactctccccacctccaccctgcggatagggctgcaggcccaggctctttggggttgttgttggacggcattgactcattctggctctgttgatgaagacccgtttggtctccagttggactgctcggtcattcttgggttctggacacccttaacatcatggattttaatcaacgagtggcgattgcgcgagtaggaatattagctatttattaggttgtgctgattaattaccggaagtcaggcctgcgtgctgagccgtgaggagggctgggccgggctccaggccatcgcttgcgtccccagggttggaagcgaagaggcagggtacgtggtgtgtatttttagtgttcacacactgagaagggaggtggtgagcaaacgcgtttgcagtgtgtgcgcgcacagctgtggagccaaattagattctgcctggaaatagcgagttggtgacaaatccaatctgtgtctaagctgtgtggaggggggaggtgtgaggaagtagaacacactcagaatgcgtgcgtgcgtgcacacgtgcgtgtacatgagtgtgagctgatttgcacccacaccctctgtaagtgcctgctgtggttttggttttgattattccgttaatgctgagtctgtttcacaaacgagattagcagaattaattattgaagatgcagtatgctttatggttttaataacactgttaaaaactaaacaaggaagttaaatatgttgatgattatcggtgactgctcaccacacagcatccctcaggccgagtcagttggcccagtgactcccacatcacaaactgccctttcttggtcagaagaagcagagtggagccttctcatccccacgcgcgcagctgtggggccccgtggtcacctggccacatgggagtttgcatactgagtggttcatcttttccaatgtgttgtgtcctttaatttacatttatatttcattgccctttctaatgatcagaacagcacatcttgttatagaaaattaggaaaataaataaaattacagtaaaattatagccacctttgatctcatctcctgatttagccattgacagcgggtggacgtgtgtccttccaggctagttttctgttcccgtgctgctggctgtggtgtccatggagtatgggccgcaatctgtggggacagtggctgggcccagagccctgcggggaggaaggggacctgggtgtgaagcaggccacacgaggaaggggggcctgggtgtgaagtgggctgtacccctctttccttctgcggggaggaagggggcctgggtgtgaaggtggctgcacccctctttccttctgcggggaggaagggggcctgggtgtgaagggggctgcaccccaccttcctgccaagatcattctctcggccctcagctgacctaacttgttctccctggaattcccctccccatgttgaaacctccaaagaattggggtccctaaagagcctgcagtttccttttatattctttgggggaaggaaaggcctttaaggtgtcccttccccagcccgaatttaaagcttaaaatgtgagcgtaggtggaccccattcacatgaaggtgcttcgagcaaaaggaagcaaagggtaggcccaaagacagccccagccatctcccacgaaaatctggaggaaagaaaagatgtttaaaaattctcctttgcaaaggcagcacattgagggtaaaccctacagagagagttttctttttttcttgttttggttttggtttcaaagaaaggaagattgccttaaaatccatcaagaggtatgaggcacttcagagcagactcagtgcctagaaatatgttgttgaataaatcctgatagcacacgctggggaaatggctaagtgaattatggctcagtggaatatattcctggtatcacacgctggggaaatggttaagtgaattatggctcagtggaatattacagagccagtaagaattgaatttagacaaatactccgtgacatgagaaaaatgctcacaatgtaatattaaattaaaaatagatctaccatgccaagggcgcatgcatatctgcagagacgacagatgattctatcatacaattagccacagccactccgagtggtgaggtgatgaaggattttaattcctcttccagttgcctaattgtctatgatgaacatacgttacttttttaatcagaaaatatcaaatacaaataatgtaagctttattattttcccattacagaagcactgctcattatagaatattgggaaacacacacaagtagaaagaaaggggaaagcggccctgcccggctttgcaggaaaatcagtcgtggttatcttgttacgtttcctttctgccttttcctgttcaaacattttttagtaagggagctttgtgcttccccccactgctttactctcattctctatctgtaactgaaaatatacctaaaggaatttggcctggatgggaatggaggccgccgtgatgccggccgctaactctgcttggtgctccctgggtgggcgcagttctgagccccttgcaaacgctctgtgcgtctccgcagcggcgctgtgtgcagatgtgctgttatctccagcctggaactgaggaaatgaccacgtggagaggcctgggggcttcctcgagcagccggggctgggtctgcccggtccagagccgggctctcggcccccctgcagatccacccactaggtccttcacagaaaggtgtctgtggctgatagaaagtgtaataaagggccacaaagaacccctcctggccaccctggaccaggacaccctctagttggctctgttcaggtccagcccggccactctgaggtgctggcgccatgagccttgtttccggaaggcggcgtggtggccaagcacgtcccctcccagctggagcagcgggtgaggtcccgcaggtgcctggacttcctcaaagcctccctcaaggggaactttgcgccctcccactcacttgctgctaggataggctgtctgctaggataggctgtctgcaaaggcatcaaacccaattggacagctaataaaaacttaaaagtcacacacgaaccatttaattgaggcaacgagacttgggtcttcttaatgctactgtgtctagaaagagtctcagatcaacgttaggccactcaaggtagaagagcatcttgccaccctctcgtgttatacctgaggaagcgggaggcccagagagggcaagtgacctgcccaagctcacacagcaggttgagtgtgtccaggagtagaacccaccctgccagccttctcatcaccctgcccagcctctttcctggaatcctcgttggtggaactgcatttctgcacagtgaacattgatgatctttctgcttttatcctggaagtttggctcaccgatcctgagctcacaggcattaaaccgagtgacccgcctgggttggaaagtcagagaaacctgcattcctaggaatggaattagtacaggcccaggcaggcaggagacacaggtccttcctagagcctcggctgggtacctgtcacatggggcataggtcctcaccttcgctcagctcccctccatccccgaggccaggtggagacccgagggtgtgggtctcaaacgaggcagctgtttgaagactcacggatgtgctgggacccctcagtcaagtaacacgccttagccctccaccccgcaccaaccttgctttgcttttggttccccaacaatcagagattccaaggtttgcagacagctcagcaattgctagtccgggaagcagggatgccaggaacctggtcccagctcattattgtgcagattcatcttgtcaggtgacctggggaagaggcccttgttggccctgtccccactcgtgggtcactggtctgtggacctgcactggagggcgggctggctctggccgggtcaggagccaccgtgcaggtcacctgtgcacttgggggttgctgcatactccccgcaagtctctggccttggccggggttgggccagggtcaggcttattgttcccattttgcagatggagcagccgaggttcagggcctggcggctcggggaggccgggctgtgcttggctgcctggccagctgccttcgacttctggtgctctcagttttcctggggaggaagggaaatgggctccatgatcatggatgctacgcagggaggggaagcgagggaggctgctttctggagtggcactgactaatcaatgcttcttcttttgtgacagggacaccctggcaaagaaggccctccaggagagaaaggaggtcaggtgggtgctcgccacgccctcctacccttcagcatccaggtggggcgggtccaggtgctctgggctcagcctctgctcagggacatccagcttggaaaggaaggagccggggacactcagcccttcctcaggtgtctccgccaagggacccagcctgggggggacacaggccttttccccaagaagcggggcacccctctctgggtcagtgcccctcaccccaccctccagttgctgcccatgaccggatcgggtgcccatgaccagatggggtgtgggcagcagggcagtgtctccgtgttcagccctggtcttgactctgcacaagctgggtggcctttgagttttggggagatgctattatgaatggggacagacctaccaggtcacgccggtgccagggatggagtctttctatggatgactgtgtccgacactgtgagcggcttgtggttcctcctgcggggcctgctgggctgcgagggtcccatgcagcacgtccaccagcgccttctctccactgcgattcatgacaaagctgctgggctgcaagcacctctgtgggaagagcctccagacgggaggagtagccagtggggactgctcttgctgtcctggtgtgcgccaaccttcgttcaccccaagactgcttttcttgtgtgttgaaaccgcacaccgagctcatggtcgtcgggagcctggggctgagggcagaggcccacctgctccagggttccagaggccccagttgtcacaggctctggaatcgggcctgattaacatttatctcttgaagcagggcctgtgcaggcaagatggggtctggggcctggtcccagctccccttgccaagggtgtggtaggccaggactgaccctccagggcagcagagctagcgccagtcctcacagggagttcaatttccagtgccaggcctgctgggcagtggcacttctccaacgtgctgcctctgagacccagagcggtctgagattcgccacttctgccccgttccctctcttgaaggtcgcagcagccactggggtgaaccctcccctcggcccttggcttccgttcaccatgggagacccagttcccgctgcctccagtggggagtttaccagccctcctccctgggcacagcctcttatcatcagaggtggaggcagcacctggggccaccagagctcgcacagtgcccggaactggtgctgacaggtggttggcacttggagcccacagcacaggcccactgttctgagagctggcttttcaactggaacgagaggcattcacttactccctgggacttcctgagttcctctatgtgccaggcatcctgttagcgatgggatacagcagggagcaaggcagaccgggcccgggcctcagagctgcagccttgcagaggaggccaccaagcccatcctgcctgggagctccagccgctgccgtgacaccatgtggaaagggggctgggagggaggcggtgggagccgttcatcatgctggagtcttgggctgggggcatgggggctggatgcccacccccatgagctctagttgagcatcggcgaggcccttggctgctggaggatgtctcttccctgtctagcagccttgtcccttctcccagccggaagctctcctgatttattccaaggaccttaggctgggaatgcatttctttagggacaacactccttgcagagctccaacgctgacctttcaccgtctcactgttcccccagcctatcccttatttccctgactgccggggtggggccagcgtttgcttcacctctgtgtcccgctcagcatgagacacagccacacctccactgtcagtgcaggctgtgaacacctgtgcgagtctcccacggggggcctctctggaggctctgagctgggatgttcgccctgctctcagcaggaggggtatgccgaactctggagtttcctgatgttccccaggcacctccacactggcatggggctaacggtctttttctgtttggttttagggtccacctggcccccagggtccgattggctacccaggtcctcgaggagtcaaggtgagagagactcacgccactccaggtcgtcctggaggtcagggttgggactgtgggccttggcgtggctggttttagggaattctctgtggtttaatgtccctgctattcagtctggagtagcccagtcctcccagtcacttgtgtggacgctaggtctcaggacagcgggcctgagcaggtgagggtgtgaccagctagagtcaggagggctgatatggagcacaggacagtctgcagtctggtgacgacgccaggggcgcgctggcggccatctgtcaggacgggacacgtccttttgcttcttgcctctttaattgttgccatttgtcaggcttctgtcactctcctcgcagacagcagatcccggctgaagccaagagcctggcctctttcctggggaagctcggaaacatttcttcccagccatttgcacattccgagtgagaaacagagtctgtctccaccgatagcatctgggtgggccagcgctgtcgcaaggcggagttcatgggagctgtccatttattcacaatcattcgtgtttctgccatgacgggctctgacaacctcgttacatggggcgcacagctccagagcaatatcccagacacaggtcccctctgtcacagcccagctaactgtgtttgctctgagctgggtaatgcaatctcgagttgtgctgctctctggacacggcacgttctgtgtagacagacatacccctaggcgcacgcggaccagctctcctcttcctctgagaatggggacttgcggtatcttaaaggctcatgatgattctttccttcaagatgcttttaactggatgtgaaggaatatgtgtgtatatatagcaactagtcaagcttgagggatttgtagaaatgactcaccagctcccctgcccctcacctccctggtctgaagggctttatgcttttcaaacattgttgcacatcagaagtgtgtggccgccctggggcatggaggccaactggaaactgtcgtctgctccgaatcaaccctcctgactctggctggtcacccctcacctgctctgagagcccaagacatcagttttcagtgacatgccccagattacactaaaatcgaggctgctgtcagaaatcaaaccaggttccaaatcaagtgccccacccttgtcccccggaggccccgacttccatttcccaggaatgaggaccttccaagttcacgaggtattgaagagagacctcccaacggttgggagccttaggcgagtcaggtttttccctaaagccagcttctaccagcaaaatgcctagcgaattttataagggtgataatttagtagaaatgctgattatgtgagttctatagcatgtttattttacaaattcctgtcgcatagcagaagcctctgccaactcccatacatggctaattgcataacgctgcttctgtgagctaaaaaggtgtttgctttaaaatgtttatggagaatgctcttatcttgcctatctgattaaaattcattcatgacatgagcaatccagttagacttggaagcagagggtggaaggaaaaccgaggtttaaaattattttcatcggggaaaaagtttctcatactcctgtgcatttggaaatgtgagtggtgtcggcgcctcacgagtttggcccgggtggcagtgatggtggcagggcgtgggattgcgtgggccgagctgccgccatttgaggtgaatagtccttggtgagagggggcccgttattttccaccaaagccctaccttcttcccaggaaaaggttcttagtccagtggggctgctataaccaaaagaccctaaaatgggtggcttgtaaacaacagggaattatttctcacagtcctggaggctgggaattccaagatcacagcaccagcagatgcagtgtctgcggaaggctgctgtctagttccttgatggtcccgtctcactgtgtccacacatagcagaagaggggggacgagcaccctggggcctctggtaaaggcataatcctaatcacaggggctccaccctgtgacccagtcagtcacctccccacagccccacctcctagttccattgcctcaggtattggggttcaccatatgagtttttggtggacacagacattcaggccacagcaggctcgtgttcctttgagttcactgacctttagcccacctccaggcttccctctgccttgcacgtctgaaggggcacctgtttaagcttgactgtcagcagagtcaaatccacccctcgtttagcccccagctgctagggggttgccaggaggccccaaatatgagttcacatccaggccttgggcgaaagcctgtccctctctgggctgtgcgcacatctggtcccagccgtgctgcagctcctgagtgctccttcccggggcggctggccggccgagtcacggatgccccaatccagcccttcccagccagggccacttcctgcatgactggggagtgccctctaatgggaggtgctgctcaccccaccacggacacagcagccccaatgtcaacagccccgtggccaagaagccctgggaagtgctggttctgtctagttggtcccattcctcctacggggatcctgaaacggtagaactgtaggaccgggaggggtctcaggaggctgcggctggttctgtctagttggtcccattcctccgatggggatcctcaaacggtagaactgtaggaccgagaggggtctcaggaggctgcggtcctacctgcctgctctcagcagggcatgggcagggagggagcagcagcgtcccccagcctgcccagccagagggaggagagctggtgccaatgcccccgggtgctgtgccagggagtttagtgctcctgggaaataatgccagccacacaaacccagtcccccaggactcagggcagggaggggcagctggacatcaccttgcattcaggatcagacgctgctgagcaggctcaaccctgattgtattctcagccacacctgcgattttcctgtgcgtttcagaggaaataagcagaatccaaagttgctcttctattttgcaagtatggtgaggactcaaaactgccctaagaaaagaaagtagctcatctcctaaaaagcccttcttggtggggttctggggctgttgtctctgaggcgatgccacgccgtggtgagacggcaggtggttttctggggcccccagctctgtgtcagccagcgtggccctacctgttctcttttcaaaactctgggggcttccagccaggattgctttggaagaaggcatctgctaggaaaaaaacaccaccaagtgcttagaaaccactcgcctctcagcagctggcccagctgagtcacttctcaccttcctgggctgcccgggcccacaggtgctgccaagcgcgtgctgtgctcagtgggggcagtggcctgcagcaggctgttctgagcctcctcgcggcttggctggtcgttcccactcagccctggaatacgcaagctgtgtttgtccggcgcttcctctccatcttgaggtccatgtcccatctcaggctggggtagagactagcgtaggagaggcttgtttggagtcggcctccctgcttgggccagtgctgtttctgagctgtgccctgtccccccaaggcgctccatgctggcccacattagtgtgccaagtgccaggccagacgaaccagagctgctccgagcccaccttgccctcccggctgcctccgccctgtgctgggcgtagagggaggtgtcccaggcctctccactagtggtggcggccaggtgtgaagcagacatgacttcagcaatggtgcctgcaggtgtagtggcagaactcttgcttgtctccggtgctccaaatcctccagtgattatggttcagggcaaccacgccgctgccctgtctgcgtggctggaagtgccttgcagctggcactggagtggaaggcgtttctgcagttacatccgcagctccttggcagagccagggcacgcagcccaaggccagccacctctgcagaaaggagctcctccgtgtctccatcccttcccagagcccctccctctccaggacctggggaaaggccagaactgccaagtatgtgggaagttctgaccaccagagggcagccggcaggccctgcgtcctccagtgctctgtggccccggcttcagcctcagcctggaatcccggtgccgggggcagtgtggcttctctctctctctcaagtcccacgggcaggtggcctgaggtagcccgaggtagtctctctagctaaaagtcaccctgctgggagggctgaagtcaaagacattaacagcaagggtgtggctgcgtaattccaccccacagatttacctccactgccccaggcgcttggcacagtgagagtgtcagagaaatagtcctgggccccgtcccagaaactcctgttcagcagggaggtgggatggtgtgtcctgaactcatgacaactgcaataaatatgttatcatcattcattagtaatatcacagtatcatctcttcatgttaacacggagttgaaatacatggcactgggcttctgtttattgacacctgctgtgtgctgggtgctaggtgctgttctgagagcttagcaggcatttccctcccaacagtggtaacgaggtaagggttgtcgtcctctccacttcccaaatgaggaaactgaggcacgcaggagtctggggcattgtcagaggccatggagggggagctgggacctaatcaagtctgccttagacctcacctcctgcttcctccccaaacctctgaaaggtgggggtgtttctagaagatgatgctataatgggaagcaggaggggtgtgttggctgccgggtgtgggcccttggaagggcgggtccagagcttgggctggaaggtgggggatgggtttgggtctttgcatgaagaacaggagtcagtggagtcagcccaggaattgtggacacgctgggcctcctgaggccacagggggacatatgggaggaagtgtgttgagggcagggcgctggcctcatctgtcagcttcagcgagctcagcctgtcttgacacgcctgcgacagctctagaaaggctgagacttgtaaccattcactcctttttcttttcccacccgcacagggggccgatggcatccgtggtctgaagggcacaaagggcgagaaggtaagtctctccttgcagccacggggccccctgcttagtccggagccgaattccagccagcggggccctcccacaatgcttcttccatgaaaccagctgaggtggatgtcgcctctgagtactgagggggatggatgccactctgtggaaagtgtctctgtttgcagacggaagaagagtaagttgaggataggccctcgggtccccaggggcacatctcctagcagagctgagtgggtccagggtttgtgtctctgcacaaggagaaggccttggccccagagacaacacacggccccccacgtgcctgcaggggccagtggacacctgtcaccctccccactcccaggtgggccgccttgcatggccgctggcacgagggtccacttagttgttagatgttcatccctgggcagcccaagctgcagaaactcacagtgtgcagcagagccaggcagggagggagagaggccgtgccattggccatggtccgtgggggcaggtcaggcctaagcagatcactgtggtgaagacaaagctaaactacacccccatgcatgcctgccagagtcagaagcttgggtgcagcctgcagcggcgacagcctgagccacatggagctgcgtggccggccacctttctcttctcactgtggtggaaggaagctcagagccaaatccaaggcccagttatgacacagatttaggcctcaggggcggcctcaccgtgccaccctccccaccgtggcctcacgctctgttgtgggttcgccctgccatgccgtgtagccatgcaatacttgctttccgtaaggcatgttggtcccctttgctgggcagactctgggctctcccctggccacggcggcctgcggggctggagtgcgggtgctggcgtgatggtccacgtgccgagactccttatttgctacctgtcgaagatgtcgcttggatcctttcttgtgaaatctgccggccttaaagccattcccgaggggacgcattgagtggccacaactggatcagaaatgatgtggcagcaggaacgctcttgttccacggagtttgttgagcgtgctggtccctggtttctgttcttagtgtctgcccttgtgggaggaccggccaggaggcctgagcctgtgccatctcggctccttcccaagggcatccgcacagcggaatcctaagtcctcatccgggaaagctgagcagtttggcctctccaagagcactgctttctacgtggagcccgtcggggcttcggaacacgagggccttacgaacacagggtccccatcccagaattccatcccgttggtccccgggaggctccctcacctgaggacctttcatcctttccaaggtggcttcacagagtccagctttgccgcttgatcttgtcacgtttgtccctagccagagacagggctgcctgagatgatactgattgggctgtgcaggggatgccttcttgccaggagagctcccgcactgttcccgagggccacgcaggcagcccgacatggtctggggaaggagtggggcagtgccaagggaccgtctttgtggacttctgcattatttgtggccgctgctcagcttccagcactatgtgaacactgtgaacaagtgccttgaggccctgggagccccgggagctggcgctggctggaaagggctggattctcactgcacagaaagctgcctcccttgcgtgtgcccccagccgggccttgaatgtttacgaccggctgagtccccagatcctgtcctttcactctttttggatcaagatgtagcccctgaataatgacaggaaaagcccagccaagggtcccctctctgggagccacccgtgccctctgctgaaggatctgagggcttttgccctgcggtttccgggatggggaacgtctagaccagggactcaaacggacagcagggggcactgacgcgcggcagcctcacttgggtcccaggttcaccagtaacccaggggtgcgcgggccgctgacttcccccgccacccccggcaacacccctacccttcagaaagcactgcctgttactgcagtgccggcaagagcaggcgttagggattctttgcaggggcattttcatccagctccccgtcctcaattgtcaccccctttacccgtcacttcagtgcttcagtgctgatgggacgccacagagtgcactgagaaatgataccgggagctcaggggcctgggcttgctgaggcctcgccatgcagaacattcagattcaaactgggcctgcccaagaagcagggacgcagctctctccagcttcagaacgttacagctgggaacgcagagctcatgggaaagccattctcgagggatgggccccaagcccaccccgtccgggccatgtgctgccccccaagcgtgggggacctggtgctgagtgtggttgtttggagcggggaagggaccgccagggaggcgggtcctcttgcctagactagggcactctcttgtcccatattcagggtgaagacggctttcctgggtttaaaggagacatgggcatcaagggtgatcgggtgagcatctcaggtttgggatttgggctggggaaagctgggtgggcttggccgtgtgggagggggtggggatgtttgccgccacagggcagcttctcagaatggaggtaaactcttggtagagattcctggtgggaaggggacagtggcgtggagcccagggcccgactctctccagctcctcttcacctcctcttcctcagtttgccccttggggactgggaataacctgtggtcgccagctcctccgcccagtgtcccacacagggggtcagtggggctgggttcacttctgactgcacctgtggactgcagagttactcacctgactcaagagggataagcggtgcctgggaagagaaaagagagcagctacggaaatgacccagcctaccgaaggagcgcagctgctgcccaggccacacggccggcgcccacagggcagcacgcgacgtgggtctaggatccctgtgagcctggggagcgtcctggtccccagacagttcttcagggtccctgggactcccacacagtcctgtggtctgtgattttggctcaggagacctggcttatttttaaatgaataatttagctcggctccagagaaagccggtgggtgctgggagggactggggcttgccggcaaccacagaaagtgacgggctgcacgttcctgtaattaaagagaaggtgacgcaaagggcacgaaggaagggtagggagctcttagagcagccagggtggccaaaagactcttggaggtttccccagtaacctctcagcgagcagaagcccagcagaaggaaccgaagacgcctcggcctccggtgggcacagccgtggtgacagctgtgcacgcaccgggacggacatctgtcggctgcagcagggctgtcacccagctgccgcagtcatccccctgcagcaccggctcgcaggtggctttccagaacaggaaagccccacacacttggcacttcgtcccaacctggcaggcaaaaggcagaggcaatctgcacctctgtgggaaggaagggggaggaaggaggggatctcttgcgcaatgttgtcccagttaagttgctgctaaaggcacccattctagaacttctttcctagtagaaggctcctgaatccccacatcccagcggcttctcggtttgatggtgaaagtccttttctcctcctttctgatgcctctgttcacacatgtggcgtccacgtgacgagggtgcagcttcagaagagatgacacacgttcccgtgccagggctccgagagtggagctctcgttgccatgggacgagggtgggatgcaggggtgggacccatcctgagcccagggaacaggaccccatatgcggacctcttcagagagcacagcctggcactttgcaccttctcggtgctctgtaaatgtgtgccgggttattttgttgaacgagaggaacacctcttagggacagagagttcctgacccgatgacagattagagcctcagaattaggaagttattcatttttctctatctgagcaatacacatttctgttgtgggcttgcaccactgctttacagctgctcttagagacagatgatcagaggaggatccatccattgctggacaaagagtgccgggaagggcatttagagactctgccgtagcgctaccattgcctgggcaggctccagagccctctcccctttctgagccccgagctcccaatctgtaacttgaggaagttggacgaggcggaatttaagcccgtctgttcctgggacgcctcctgaggccctcccgtgtgctcgttatgcccaggtaactgccccatccggggctggggtccacttccatacctcctggggtttcagaagcagcagcagctcccagtcactctgctctatttggagaaacagcaattcagagctactattgttaaccaaagttattttagctaagaggcactcaatttagagaaggtaattgggaagtaggagcctgcagccttgagaaaataaatagcaggcaacctcggtgcagagaccagcttccgcagagcccgggagcccgggaattcgcggtacaatgcgctcgctttgtcagtggctccgggagcagctccgtggtctgagtgaggccgagctggtggagcagctctgaccacagggtgcctgtgacctgtccccttgctccttgctctcagaatggtggtggagaatagtgtgtgtgcggggggtggtcttctcacctcctcttttctggcttgcagggggagatcggcccacccggtcccaggggagaagatggccctgaaggcccaaagggtcgcggaggtcccaatggtgaccccggtcctctgggaccccctggggagaaggtttgtgatgtgggacgttcagccactttcttgggagggatctgacaggcccttccccatggcctcgggctcccgttggctgtggctgccctaggcatggggtgggggtgattcctgagcgggctcctgtctccaccctgggttctctctgctgttcctatgaagctgttggttgaatgatgaccctttccttgtcccgggttcgccctttcccagccctccaccatcgccttggaaggctccttcctcccggtggctacaaagcctgcgttctgagccccaacattccaggaccccgtccttgtcacattcccgcctccacagctgggtaataacggtgtccccaccatggcctgaaggtgtggcagcctggcaggaaggaaggccggggtccttggagcaggctctgggcatgcagccatcaataggcctgcagtttccagctgtgggaggctcctgggccagccacacaccctggctccaccctgtttccaccctgggctcaggcaggaatggtgcatgcagtggtccagacttcctgccctatcctgctacgtggacccatacaaaagggctcagaggtgccccaggatgaacacgctgagttgaggcatttgcctctaatcgctttgctccacagtggcaagacctctcctccaggggccttcgcttcttcctcggtgcagggaccatcgggtaccccctggatttcatgggtgctggcagtcaccctccacctagggcaggcagggcttctgcataatgacgtgtgcccccgcctctggaaaccacaccctcctccaggcccctgccagaacgcatgtcctttctctctgctccggggaaacggatggagcaataccgtgctggccattaatgcaactctttcttcccccagggaaaactcggagtcccagggttaccagggtatccaggaagacaaggaccaaaggtaacttctggccgtgttaggtgtcccgggacaggcggagggatgttctgcccggtctccccaccctgcatccggccgtgttaggtgtcccggcacaggtggaaggatgttctgccgataacttctggccatgttacgtgtcctggtgcaggcgtgggggttgtaccgccaggcctcctcaccttgcatccagctatgttaggtgtcccgggacaggtggagggatgctccaccggccgtctccaccctgcacaggttcatccactccccatccttgggggcgtgtgtgacactgtggctctcagcctccaccgtgttcactgccttctgcattaatttgccgagttgaaaggaggctcttgggcaatgagtcttctgccccagtcggcacagacacctggggtccttctgggatcctcctggagtcccctgcagtcttctgcacctgttgcttggctggtggcccttttcccctgggttgtccatacccagaatccgtgggatggtcgcctctcaactctacctcaccggcgatttgaaggctatttgctcataatggagtataaaagaaaaaggaaacctttcttatgtgaaatcatgttcaggtttaagtgaaacagctccttgaggctttggaaatcattgaaaatgttattttttttcaaatctcacattttattattcatggttcttccttaaagaataaccagctgcctgcactggagacataattaacagccgaagcggggtcccgtctttctcagatctgcctctgcccgaggcatctccttttagcctcagcaccttttcggtctcactggagcagtcttgttaacaggaggacgggcgtggtgggctgaggctgccctccaggtatttccattctcattaaggaaatgctcctgtccgtccttcctgtggaatgcgaagccccctgctccgtgtgtgtggatgcacaccccatatgcaggagaggtagcttgctgtgaaacaggaatttcatttaggatctaacagtggctcgttgaacgtgggtgtgatgtagctgctgaccgcagcatcgtcactgaatgtggtcaaaggggctgatgggcacttttcctctcttaatatacatccctctggggatggaaagaagagaagtttgggaaagatgggtggtctaaatcaagtccaggcaactttttggaaaggaatggtacatgtgtcctgggcagagactagaagtagccatcagcacagtgacccggtttctgaactgagctctgtgtcacctgcactgaggtttcctgggtcctgccccctgcctagattggcaggcgggcgtgtgagtggcttggctgaactcagtcccctgtgagaaatacaaggtttggacatgtgtgagctcttcatggatacaagtgtgcattcaggacaggattttaagccagacaaatagagacctgccaaagacagtggccagcgccaaccctgtgggcagctgagcgacctcactgcggtgctgcttcctgtgtgggtgtttggatattcaccaggtcagagtccctaaatccatctctggtctgtgtgcaccttgcaaacttctagaattaaagagctggtaggtgctacagtcagtgcataaatttgcattcattcccaactctgcaagctgctgtgctttatttaaagggattgtgggacgccaacacaacgtgcacgaggcacagaaaatacaatgtcacagtgcaatgttcatgtctcacctcagttcagctcagcagtgtgtgtccctttctcccaaacaccagccaccctcctatggatatgggcgcgtgggggatggtggcaggggagggagcatgatgaaactccatttggctttctagagctgaagcctgtgaaatgcttaggaaatatttattgagtagagaggatggataaagagataggtggctgggtgagtggaggggtgtggataggtaggcagatggatgaatgggtaggtatgtgggtgtgtaggcagatggatagacagatagatgggttggtgggaagagaggtggatgaatggatgggtgggcaggtggggtagatacatagatggatggatgagtgggcaggtaaatagacaagtggatgaatggaggggtgggtttataggtaggcaaatcgatgaatgggtaggtgggtaggtagacacatggatagacataggtgggctgcttggcagagaggtggatgaatggatgggtgggcaggtaagtagacaggtcgatgaatggaggggtgggtttataggtaggcaaatcgatggatgaatggatgggtgggcaggtaagtagacaggtggatgaatggaggggtaggtggataggtagacaggcaaatggatgaatggttaggtgggtaggtaggcaggtagatgtatacataggtaggccagtgggtggataggtgggtgaatggatgggtgggcaggtgggtagacagttgggtgaatggaggggtgggtggataggtaggcagatggaatgaatgggtaggtgggtgggtgggtaggtggatagacagatagatggatagagagatagatggatagacagatagatggatagacagatagatggatagacagatagatggatagacagataggtgggccagtgggtaaacaggtgtatgaatgggtaggtgggcagatgggtaaacaagtggatggatgggtgggcagatgagtagacaggtggatggtggatgggtgggtagacaggtggatgaatggaggcatgggaggataggtagacaggcagatggatgagtgggaggataggtagacaggcagatagatgaatgggtgggtgggtgggtagacaggtagacggatgaatgggtaggtgggtagacaggcggatgagtgggtgggtgggtagacaggtagatggatgagtaggtggataggtgagaaggtaggtagacaggtaggtgggtggttgggtgggtgggcaggtggagtctggggcagaggctgtgcactggcatgcaggtggtcccccaggcggcccatgcagcatgactcattcctggcccagctctgatgcctcctccttaaactctctttcagggctctattggattccctggatttcctggcgccaatggagagaagggcggcagggtaaggatagcctggcccctgggcaggcagcttgttcggctgcctcggtgcctagcaagttggttctccagccgacggcctgtttatttctcactctcttgcttctgaaactgctctcctgaatggctggccttaagctcttgaacttcagcaccacgtgttggtgacactctccagacgctgggctgggcaggtatgtgataggaaggggcagaggcaggaaggaagtgtgctgagaaaatggagctttctaattagcaccacaatccagaaggctctttcaggtcattctgaaaatcagattcttctcctctacccaagtgggcttttcctccaagctaattttaaaaggaagggaaaaaggagattgttttttcccttcaaaaatgtcctgctacttaaccgtcgtccaaatttaaagtcatttaaattaacattaacttggacgggattagcaagctgccattgtcataaacacccaccagcttgcagtgtggtttgagtcccctttgtcctcaccctcagcgaaggaacagggggccgggctgagggagctgtgttctccctgcaccttctggagcccccgctggcccaggcctccctgcaggagcggtcctggatgcttgttagtgaaatcacagtgcctgagcattgccacttgggaaaacaggagagagatggtcctcaggccttggactctgagctggccttgtccacggggcatatggcggggacagagaaaggccagtctgtggtgtacatgcaggacagcatctgcagagcaggcctgggggacatgctccccgaaagatggcagagctcacacctgccttgtagccccagccatgatcctgcagccctgcccagcccatcctcctatgccccatcctgctgtcccagggcagacagagctacagggttgcagctccctcttgggcctgtccctcctggccaaaaccttatgagcaaacaaatgtgttctgccagattcacaaaataggaaaaagaagtctgttctgagtgtaagttggcagcacagacccaaggagactattatctccatctccacccctctctgtctctgtccttttacccatccatccatccacccacccatccatccatccatccacccacccaccaacccatccacccatccatccatgcatccatccacccacccacccacccacccagccacccagccatccagccacccacccatccatccatccacccactcacccatccatccagccacccacccacccatccacccatccacccacccacccacccacccatccattcatccatccatccacccacccatccattcatccgtccacccacccacccacccatccatccatccatccatctatccatccacccacccatccatccatccatccatccatccatccatccatccatccatcttctattatctgtctatctctgtcagtatctatccaacccatccacctctccatctgtctctatccagctgtcattcttcttctggagaagccctgagtagtgcctttgggaatacactgtcttctgaaatactcttaggtaccactgtgagaaacatggggaatgtgaggtaccccggtgggctgctcctgtgctgggggacctttcacactgcactgcagtgagagtgtctgggagaggatatggccttctgcagctggtcatgggctgtgactgcaagccctttccatggaggactgtgtgggaccagggacctcgtggagcaactggagcccttgctcactcccatgctcctgactggggctctgcccctcatgcgtctcagcctccccaccggcgagccgaggagcttagatggatgctccagatgtccagggcatcagcactgtgggtcacgggacacaacacaaacctgactcaagcccagacctgccaggcaccacatgccccagtcacacataggagctactcacagcctttctgcagcctctgggtgtctggccctgcccaaggacatttcgttcactgctgcacctggctggtggcacaacccacaacacagacctcaggccaaaagggcgaggccgtgtgcttccccttgagccatggtagtggtggttcatgtgtgtgagatggagccctggcctccttcatctttgccatcacagctcttcagagcctcccgttcaggacactgagcacagcctttgcccgcatgagccttcagtggcatcgtcactgcagaatgaagcctgcagcactgcctggctttctggacagggttgatgctttgtaccaagttcggggaatgacggagagtgtgggtgccctctgatctagtaggttgggcttcccgaatgtccacaggaagctgagggctgggctgtccttgcaaagggacccttcctcttttgttgactgcagaagcctcacttaggttacccagaagcctctgggcgctggcttgccttctgcgcctcggtgaacagatgctgcctcccaggtttcgcccttggccgcccttcttttgccttgggctttggacttggtagtcttgggtgcagtccattcacttaaacagcacatgcatcgcgagtcctttctcagtgctgggtgttctgccaggctctgaggactctggtggtcaaagcagacatccctctggcatccagagtggaacaccacctggtaagcagcactcagaggagtggtggctgtgatgatgaaggacaagggtgagtcagggaaaggtcataggcaccagggtctgacccagaaggtccagggaggcctcctggagcagtgacatttttgctgagccctgcaggagggacagaagtggataggtgaggtatggaaagcaggcagagctgtggggtcaggaggtgaggagccgggggccggcacagggccgagcccggcaagggagacgtgggagtgggctgtgggctgcagagcctgccggggcagccagctgctttgggggaagctctttatcctgaggcactgggacctacggaaggttttagccagggggaatggcactgaagattgtttgaaacagctctggtcccagtgtggggcaggaatgggaaggggaccattccaagggttgaagggaaagccagtgggatgtctgtgctcatccagagaggtcttttatttatttatttatttatttagagacagagtctcgctctgtcacccaggctggaatgcagtggtgcgatctcagctcactgcaacctccacctcccaggctcaagcaattctcctgcctcagcctcctaagtagttgagattacagatcgcctggctaatttttgtatttttagtagagacaagatttcgtcatgttgaccgggccagtttcgaactcctgacctcaagtgatctgcccgcctcagcctcccaaagtgctgggattacaggcgtgaaccaccatgcccggcccagagaggtcttttagaagatcttagatattccggccagatggatgcttctaggtgctaggatgccaggcctgagtgtccgcatgcatgcgtgcatgtgtgtgtgtgcgtgtgtgtacatatgtgtgtgtgcatgtgtgcgtgcatgtgtgtgcatgtgtgtgtatgcatgtgtatgtgtgtgtgcgcacacgtgtgtgtgcgcgcgtttgtgcacacgtgtgtgtgcgcgcgtgtgtgcacgcgcgtgtgtgtgcgcatgtgtatgtgtgtctgccttccacatgagggctgcctgctgtctgcctgctgtctgtctgcctggtcctaccttctgcagagctagcgttggttctgtggaccttgactatgggccagacgtggaaatggcaggaacataagctgctatgtcaagccagctgaagccaaaggaagaggagtgggtgtgagcaaagtgtcgctttgcccctcgggcctcgggccaaggagggatcccaggagccccttcccgggaagggggaaagacccgctcttcagatgcacctgcccgaaagtggaaggcctctcctagctgtgtttgacttccccagtagaaggtcccctctcaagctgcgtttggcttcccagcatggccattgctgggactgtccactccttcctaagggcaagaagacaggtgcccacaagcaatttgcaagggagaaggaaggctaaggaggctggggggggcattctgttccacagctccagtcacagggactcgagattctttggcttgagttagtttataaagaaaacagatgagcaagatgcctgctgggagccccagatggcgttgcggtcgagccggtattttgctaactgccagggccccagcgcctgtgcctcgggcacagtcagtttgggttgcagtcatttttgttgcaggattaaacctgtggtccaggtcatagtgggactgttttagggtggagggttttcattctaggggaggatgggaatgagtaaatctggcagcccgggctcattcgcacctaaatgccaggagtcatcaggttggccgtgggcatcctcgcctgtagaacgcctatcactggaagaaagcagatgtttcgttaattttcatatgcaaatatttatttgaagccagaggatatcaccatagtaattgaagaactggaaccggagcgcattgttaaaaagctacataattaactcatcatcataaatggttttaataaatgcatttcaaaatgggagactctaggaagcagttttgactctggcagcaaatgaatgaaagatgatgagcggaaacttatctgatggcctccagccatacagatccaccttgggcggagcatcagaaaccagtcaagttcagccaggcacggtggctcacgcttgtaatcccagcactttgggaggctgaggcgggtgaatcacgaggtcaagagatcgagaccatccttgccaacatggtgaaaccctgtctctactaaaattagctgggcgtggtggcacacacctgtagtctgtcccagcaactcaggaggctgaggcaggagaatcgcttgaacctgggaggcggaggttgcagtcagccaagatcacaccattgcattcattccagcctggcggcagagcaagactctgtctaaaaaaaaaaaaaaagaaacaaaaaagaaaccagtcaagttcaggaagctgagttgggacacggtgggggatgtaggggcccctgcgtgttcagcccgtggcttccgtgtaatgtagcttaactacattttccagctctgacatctttgcactgcatttgttttctgtggtttggaaaatgcaaaacaacaacagaaaaaagagtataaattctattagaggagaagccgatgactcttggatatatgatttatatattaaattccaagtttgcgcgtctgcagagcctgttgaaaatttaatggctaatattcttaactgtagcaaaagtaaattatgtatgaaaggggttgactttcttctcttttcttgcaataatgatttccctccctgctgaggacagagagagaaagagagatgaggaggaggggaaggagggaggaaggaggaggagggatgtagcggtgctctgaggaaagaaaccagataatagtataaacatccatcagactgcaggaggaaaattggatttcagcaggacttgtgcaggagtgcaaagctgtgtgtgtcgggtgtgcggtgagcttctcgccctgataaatctcctattaaaacacggaaaaggtgggtggcggggaggcccaggttcctcctatcctgctctgaattcacagtctctcaataacccgggagacagctgccacctgagcagggccgggcatttagagagtgactgaccagccccttctctgattctaggggacccctggaaagccaggaccgcgggggcagcgaggcccaacggtaaccaccctttcagcttgtgggcatgtttgggaaacgggagcatggtttagggagcacgtgccaggggctgggggaaggcagtgtctgtgtgtcgggacttgagctgaccttccttctctcccatctgtccagggtccgaggggtgaaagaggcccccggggcatcactgggaagcctggccccaaggtatgtttttggcctcctgggcggtgggcggcgtgaacccaagttgcaaggctacagagacgtggagcgtctgagggtgtctgtgaccttttttattaaaaaaaaaaaaaaaggcaggacattttcttaggtgtgtttaagaagcttgtcccctccagcagcctctggatgcctcagatcagatgtaattaagtggctgagaacgatggtcatgagaagtggccccagcagagcagggacagggcctcgccccaacacctgggaccccaaagacggcagcagggggccaggcccaccgcagactcacccgccctggtcgggaggccccatttcctctcttgaaaggggtttgagagctgcagaggcctctaccagaacctacagaaagtgctttctggcaggggaaggcccaggccggcctcatgcacattcttcccaccgaggggcattgaagccactccttgggtggagaatctggacacagacccagcaggcaggctactcctacctgtccaggatgccactccagagcgggttcctgctgggatgagtcttccaagggctgaggggccgagctggcccgtccctcggctgaccggaatgcacccacaggccaccctgaactcctccaggacaagctctggggcacttctcgtgtgccccgtgacctgacctgaggctcacctatgagaactcagagcagcagctgtcacatgggggtggccctagagcgggtccctgcgttctgcctttgcatgacttttccaggtgctcgaggctggggcacagcctttgtcccactcaggagactgttctggaaatgtccagccttgtagacactgggctgtcagctgcatgcagaggcacggggacaggcaggctttgatagccacagatcagcgccaatgccttctgccccttactgagggtcagggccaccttcaggggtgcacacaggcaatatttgactcagacgttttgatgacgttgtgggccagagtcttttcatccaaataataacaatcataagcttttcccccctctccttccctctcaagggcaactccggaggtgacggcccagctggccctcctggtgaacgggtaagcagctggagccttcgggggtgtctccaagggcagagcctgcctcgaatgccccctgcactttgtcctggggtgggctggggccagggaggcacgcctcagaccctgctgaagggtagggttttcctaagatcccaagggtgggtcacgccctgggagtgaactcttccgtaggtcaggggcctcgaccgcagccctggtcttggggtttgggagtggccgagatgacaggaaatgggtcctgggccccatcctgcccccgagggtgaggcagggtgagggaggggctggaataatggaggaaaggccatgggggtgggaagaaatgacacctgcgttcagagagccaccggcacaggcaggtcagcggcaggagctgctcgggagagacctcttgtcctcaaactggcctttctctgttcccagggacccaatggaccccaaggacccacaggatttcctggaccaaagggcccccctgtaagtaatggcttccttgctgggccagcactgcctgtcccctccaaaacccacctgtcccctccaaaacccgcctgttttctctgaggtctgctcggagctcctcacagtggccggtgggtggagggaggcccgaggtgaaattctggctggtcagatgagggggagacccccccaccgccaaggcggctgtggggcagtctgtggctgtgtcccactgccgggcccgctggcactggagagggctgcacgctggggtcctctctccttgagactgaagtgattttctctgagttctgtgttagtgccctggggccgccatcacaaatgaccaggaactggcttagaactgggtgtggctcttctgtcacagccctgggggccagaagttggagagcaaagtgtggtcagtcagagctggcaccttctggaagctctaggggagatggggtaccaggcctctcccgggggctggtagctgctgccagtccttggcacccagtggcctgtgcacactcaccctggccactgcccccatcttcacgtggacttccgtctgtgtctctctgtcttctaatctctttctttttttgttttttgagacagagtctcgctctgtcgcccaggctggagtgcattggctcgatctcggctcactgcaaactctgcctcctgggttcaagccattctcctgcctcagcctcccgagtagctgggattacaggcatgcgccaccacacccagctaatttttgtatttttagtagagatggggtttcaccgtgttggccaggatggtctcgaactcctgacctcaggtgatccacctgcctcggcctcccaaagtgctgggattacagccaccgtgcccggagcccccacgcccggccatctctttcattttataaggacaccagtcactgggctgggcccacacccatctaggttggcttcatcctaattcagttacactggcaaaaaccccatttccaagtgaggtcacaggcacaggttctgggggtcagagcttccacatgtcctttttggggacacacgtcgccttatggcaggtgtgatgtatctcctccagtatggacaaccatctagcagtgggattatgacccagcaggcatggcggggctggtgggaggaggttggactttgcaactggacagacttgggtcctggcaccggctgtgtcacctgctggctggacctcaggataccaactggcctcttatgcctcggtttctcccttggtagatgagggtgacaacagcacgtcccatggggcagttgtgaggattttgtacgaggacaggcaggagccaaggacagctttagatttgttgtcactgtccccgtgcctgccaggtgattgcttttctcagaggatgtgcaggggcaggagccatggaaataacggtcactccacgtggcattaattctcaaaggtggttgcttctcagacacgaatgaacctcctttcctttggttttttcttcagggccctccaggcaaggatggactcccaggacaccctggacagagaggcgagactgtgagtatcgagggtgctgggggacgtggctggctggctctctgaccaccctgcacgtgggcacagccctcgctgcccagcgccatctaggaccctcctggcctgggagagacaggttggcctcagaaaggctcccaagggccgggccggcttccgctgactcagagccaggctgtgaggcagggccagggcagagcagtcatgcaggccggcagcgccttatggcatctgtgggcagaaggcaggtgttggctttgggctggttttggaaactttggtgagaggccacatttaaagacacacacagattatcctgggccgactgaagcctcatgcatccagccttattttccctctagaataatgctgagtgctaccccgcttgagggatacgtcttttaattgagaaagtgctgggaaagggtctacatgttactcagcgtcattcagtcattcgatgctgcaatacttcaagagggcggctgtgggccatgcaccaaccccacccacgttcacccgggcccttccagctccaatccagggggtctggaggatgcctgcaatgtccctttttacactaaagaaaacaagcgccagtcaggtggaagtggcctctaactagtcactccgctgggcacatggtctttgtagtcagagactcccctttgaccttgcccttcactttagaaatgcatatcacaggctacttcatccagaccagaaaggactccagtgttttcagttgggagaaaaagccctcatcagaaatgggatcattttcctggccccatcagcccttcgaaatttggcccagctccctaaaggtgtgtttcaggaaagggtgcaggcacgcctgtaacctggcccacacctacaagcttggggctccaggctctgaatatctggggacgtgcagtgtcgggtgacttcctcgtcaccacgctgtgttccttctccgagtgcccacctactctgtccagcttaaaggatgaattgcacagatgcaaacatttcccacagaggagagtgaggggcatgccaggatcactgcaagggtccctgcagccaggtttctagggatcaaggtctctacaggactctcccagcaaaagcaggtcccctcgtggaatgggtctctgagtgccctgttgaatatattctccatgcctgctttgaaaaaatcccctttgtctctctttggttcatcgtgatgaaacctcttttaattataccttcactggtgttctgcacggcgcatgctgcctgataaatggagattgctttgctcttttgtttatagagaaaaattaaaacatttcttctgagctttgcatatttttctctaatgccttttcaaggagacaagatagaaggttttacatattatgtgcttttctccctctgacttattctggacggaggctggtgaaagaattaagctgcttgtctctgctcagaaagttgcacatgtacttccggctgccttctgccaccccggccacctctctagacacatggcgctggagtgatgcctgtgtctctgagagccacttgggacatagcatctcctccatgggctagtccagacaagccttccagaaagagcttctctgcagtgttgatttccttcttttttaaaaatatgaaacaccaacggtcattatttctcctaaatgtgagccagaaacttatttctcagcaaagggctaaggtcatattctgtcctcaacagccagggtggccgagggccctggggaggccttttttgtttcgtgttaactttgacattagcaaaacttaaccaaggctccgatctcccttcaggctcttgagctcttctccccgggtccactgagcagggcatgcccttgacacccatccaccgttccttacttctgaccccataagtgcaatgaacattagaaacgatcattctagcccacagctgagctgggcttaaagaggcgagccctcctagagtttgcaaagaagctaagtctgggctgggcacagtggctcacgcctgcaatcccaacactttgggaggccgagatgggcggatcacctgaggtcgggagtttgagaccagcccggccaacatggtgaaaccccgtctctactaaaaatacaaaaattagccaggcatggtggcaggcacctgtaatcccagctactcaggaggctgaggcaggagaatcgcttgaatccgggaggtggaggctgccgtgagccgagatcgtgccattgcactccagcctgggcaacaggagtgaaactctgtctcaaacaaaaaaaaaaaaaaaaaaaaaaaagaagctagtctgctgtgggttcatgtggccccgtggcttggtgtgaggttttgcctctgactgctggacagtgagtcagtgagcccaggcctgaggccgctcaccctccagccctagcttggcctcagggccagccaccttctcctccagcgtctagagtttgcctcgaggcctccgggtagaaggtgtgcatgtctccaccagtgtcatgtggcacctgcagatggcttctcgctggcacctgtcatgctctgcagacgtgcctggaaaagaagcttatgttgccttaaggtcatctttctcctttgagggagagtacagaagtcgtggcgacacccacagccaagccaggatcgttatctacgcgtgagcatgcagagcgggcgtgagatattcccgctgaatcaagctaaaaataacgcatccaagctgccgagttatgaaagcagctggccctcgctcttgcctgttttaaatacatgctgaggagcacgcgggcagagtcacccgtcgtgcatcagaggcgttcacgccaaagcaggtcagtcgtcacagagccactgctgagaaacagccagaggtagtcgcgggtccagaaagggcaccaagccaactcagaaaaggagcgtttggtgacatgataaaggcgaatcgcgtcggcctaaagatgcagaggcaggagagcagccagtgagatgagcttgtgtggcttcgttaccctcgtgaaattagtgcaaacgcacggtggctcacgcctgtaatccccgcactttgggaggctgaggcaggtggatcacgaggtcaggagttcgaggccagcctgaccaacatggtgaaatcctgtctctactaaaaatacaaaaatttgccaggtgtgatggtgtgtgcctgtaatcccagctacccaggagggtgaggcaggagaatcacttgaacctgggaggcagaggttgcagtgacccaagatcgagccactgcactccagcctgggcgacagagcgagactctccatctgaaaaaaaaaaaaatgaaacaagagacatgggcctcttacacaaagtctggaacatctactctggggggaagggaggtggggggcaagcgtcctgctgagaacagtgcagggcagggtggcgcaggccactgcagcaccgtcagtgcagtgactctctcttcacagggtttccaaggcaagaccggccctccaggcccccccggcgtggtcggccctcaggtaagctccagccttcccagattccatgggtcactcggtgtcacttgcccacagggaagagggtcccagcccgggcatctgttccctccacgattccggaggtgcaggtactgctgagaggttatcttaggtcctgaatgttggtcagcgtgaggctcgccccacgcaggagcaagcacagatgtgtttgccctcaacacaaacccaacacgcagggcaaggaaggctgcccaaggctcacagggtggctggggccagacctgggccagctcaggagctgggctcatccctgctgtgggtgtccaaggcagccgagtcctcctgccactggtccctgtgggtgtcacgggcctgcgattctaaccgcagaccagtggcagatcagtgtcaggggcagcttagagccaggattgatggcttagagctgcagaacggggaggggtcaccttgtgtcctagaaagcgcacacctcatgtagcggtgagtaagacgtagacctgctgcagccacagaactgaagggcatgtgggctctgcccctggtgtggcttttctcccatccttggcctgtcctgtggctgaatcagcctccctcagggcacatcccaggaaggcaggcttggccgtgcctcctgaaggcgccaggtgggggaagagggccacgcggggcccagcagatgccaggcagtgagcagcgtaccaacacccaccctctagatttttgccgggaagagaaggcttgcaaaggcacttggaggtttggtgtgcccgcagcagacctttgcgtccatgaccagggctgtccttagatttaggaagagattctcactcccttgcaagtcactcgaaacgtctgtggctgacactgattttccccacagggtcccacgggagaaacgggcccaatgggtgagcgtggccaccctgggccccctggaccccccggtgaacaggggcttccgggccttgctggaaaagaagggacgaaggtgagtttctggagccttctgtgtcagctcaggcgtttcctcaggaatcattttgggactttgtgtttttcttgcccttttctgatgaatgggtaattcgtcaaacagacgcttctcatgccggttcactccccagaccgcacgttttgctcacttttccttgattcactccaggagtcgcgctgacctgctcagggatgggcttgaagggggagcgcaggggtcaccaccatcctccaccctctgctctctccccagctgccagccctgctcccagaaatggataaaaagctctgggacttcatgtgtccataacacgtttagcagaaagtggtccttttaaaaacccctcaccccagccaggtgcagtggctcacgcctgtaatcccagcacttttggaggctgaggcaggtggatcacctgaggtcaggaagttgagaccagcctggccaacatgacgaaaccccatctgtactaaaaatacagaaattagctgggtgtggtggtgcgcacctgtaatcccacctacttgggaggctgaggcaggagaatcgcttgaacccgggaggcggaggttgcagtgtgccaagatcgtgccagtgcactccagcctggttaacacaaatgaaactctgtttttaaaaacaaaaaacaaaaaacacagtgaaaccccgtttctactaaaaatacaaaaaaattagctgggtgtggtggcgggcgcctgtagtcccagctactcgggaggctgaggcagcagaatggtgtgaactcggggggcggagcttgcagtgagccgagatcgcgccactgcactccagcctgggcgacagagcgagactccatctcaaaaaaaagaaaaaaaaacagccctcaccccaagagcctgagaaattataaaagtgaaaagcaaacgtgtttttatcccacctcttggtgccagctccaactgcccccttttcatatctcctcccctgggcgccccaggttcactggccataacttgctgtgttagcacaaaaatagcccttccctttcagctcttcaataaggaatgcaacaaaggcaagctctccagcctgtaggaccacagaagagtaaacctgaaaaataataaagtgaagcaaatgaagaaatactgaaaaaaatcacacacccgggtgtgcatgtagatataggaataaatacacatgtgtacatgcacacgtgtgtgtattctagacacaaagagagctctccgagcttggaaaggcggccacgggcatttgacctgctcgtttgaaaacagcactgtgctccatgttggaccccagagaacattttggaagatatcaaagctttactgtacctcagggaaagtcgaggctaaggggtgactttttttcagaaaatgtggtttcgggcttgaagaagttccttaagtgataagtccatttaggacgatgcttttaatgctatttcgaccatggatttctttgtctgagcacggtcttacaaggagccccaaatctatggaaaagatagacgtgccctcagctcccacatggcccatcgtagcccttaagggccttgggaggaaggaccccggaactccgtggagcaggggtagagtcagatttgcacgcagagcccgccagatgagcgtggcttccaggtggaggctcaggctgtgctcccacgtgtgggctgctgagtccagtcacgactctgaaaagtggccaggagaagcccaatccaacccaagtccaggagtgtctgatgagaaggccccgacccttggccttgctccggggctggtgagaggtctgtgtcgctggctccaggagagaaggccccaacccttggcctcgctctgggactggtgagaggtctgcgttgctggctccaagagagaaggccccagcccttggcttcgctctggggctggtgagaggtctgcgtcactggctccaggaaagctcatctctgactctgttttcagggtgacccaggccctgcaggcctccctgggaaagatggccctccaggattacgtggtttccctggggaccgagggcttcctggtccagtggtgagtgagaggccaggcggggaatgaaatgggacaggtgcagccctggaggcctctccccacgtgcccttgaccaaccttttcatggctttgcagggagctcttggactgaaaggcaatgaagggccccctggcccaccaggccctgcggtgagtcaaagcctttgtcccatcctctttcttgaatcctactctccaggtcagaaggggcagtccccgagagcccagagcatgcagctgccccagacccccgaggagcctggggaggatgtggaggggggaaaatggccttcagggagatgcggacggcgcatcccaagctggcagccaggatgacgaagggtcccaggggcacaccgaggaaaggagagtgctgggcagcctggagggcgggaggagccactctgtgttgcctgtggagcatgctccctggaggagcaaggagaaagcctacacacctatcgtgggtctgggctgggccagcaggggaagaaacagacacgggtctgcagggactctgaagatgcacgctaaagccaggctgcccacggcgggggcccactgggcaggatggccctcacgattaggccaggtacccacccatccatatgccagcccccaggcaaggcatcccctagaaaacgcaccccatggaggagcacagcagagaggggagtgggtgccccatgggcatgggggccctggaggggaggggttgccctgcaggcatgtgggccctggaggagagggggtgccccgtgggctctagagggaagggggtgcctcacagacatgtgggccctggaggagagagggtgccccgtgggcagaccctcaaggggagggggtgccaggcttctagaagagggagcccattgaaggcaagcacaccacagggcacactgtcagacaccagggggaggagcacctgggagcttggagttacaggaagacacagagccccgaacgctagaccaggtagtctgtgcttgcaaagggccatagggagccactgtgggctctagagtgagcaggtaagtggagtgatcagctggtgctttacaaagtcacgaccacgcagtctgagagcctttgaagcagactgttttcttgctccacctcagggatctccaggggagagaggtccagctggagccgctgggcccatcggaattccagggagacctgggccccagggacccccagggccggcaggagagaaaggggctcctgtaagtactgccttggattgggggagcccttccctcagagatgctggggtcgttccgtgtctggccttgtccctccccctgtgatgtccccaggggtatttccttgggattggggatggggtggggtctgcggccctctaggacagagcgtgtgtcccatgggaacctggtgacctgcctgaggagcacaggaggagtcctggtgccggccacattctttccgccatcagctgagccagaggagccctgtgggatgatgttgggccggtctcagcctgtccacgcgtgcatgctggtgttccccacatgcgtggacagaggaaggggccgaagacagtcagtgcgctgtggacttggtctccgtccagcctcagtgccacctgtgtggtcgggccacagctgcccactgtgtgaactgttccctgctgctggcccagacccatggctgggctcttcctaggaaaggatgtttggaaccggggagtcctgtttcttggttggggggcaggtgtagagagcagatgtccagcaaagaaggggcaggggatgggtggataacggaaagacaaggcgcctccctctgtgtccaggaaagcccacctgctggtaagccccgaattttgcaggctttgtgaagcctcgggagtggggaggagcatgtcttgaggccacccagatcttggtctccaagaaggagatgagcgagcgccctttttgcctagatgcttcctgctagcctgctttcgtgaataacccacaaaatgccacttaccgtccagaagtggtccaccctgacccgtatttggcttctgccacacaattttgcagtgtcccctacctctgcattcaatcagctctggagaccaatttaatctcaacttctccttcccagtacagagggtcagaatgagcttgagttctccaggggaattggcagataatcggtgcagaccatctcaaattgagttaggtctgagtgctgattgttagaaagctgttttctttctctttttttgagatggagtcttgctgtgtcacccaggctggagtgcagtggcgcaatctcggctcactgtgacctccacctcctgggttcaagcaattctcctgcctcagcctccccagtagctgggattacagatgtgtgctaccacacccggctacttttgtacttttagtagagatggggtttcgccatgttggccaggctggtctcgaactcctgacctcaagtgatctacccgcctcagcctcccaaggtgctgggattacaggcgtgagccactgcgcccagccagaaactgtgattttcttgtacgtttcactctcagtggctcatgggtggcaggaacagcctacattccctgggcaggaacttccctggaaaccacattggaaacatctgggccattgagaatctgttcaatacattattggcaattttggtgtcttctaatcatttccagtgaggcacccaggacatggatccagctggattctgtgccagaaaactgaagccaactgggcagtcagtgtatagagtgcacacaaagtcagctggaaatggcttggttcacagtttcaagagagtaaatatttgagcagaaaccttgcaagagttgctctatccaggcagaagctcgtcatcctcccagaatagctccagagggaaggaaaggccaagcaaaggttggacgtctctgagaactcccgacctgaccaggaatgtaggacaggaagcttccacaaaagccccacacgtggtctttgcattctctggcttaagtagggtagacatttctatgaataggagctcagtttgaggagcaggacatgaattgtggagggaggaatggtaagacgaaatagtgatggatgactaaatcccggctacatttagaccagaacattgaatgtacattctctattccatgtttcccttcccaatgtgcacaccctccttctgtgtatctgtcggaagatagggatccctgtctgcagtgagaaaatataggctgctcacagagtgatgcgatggctggtcaaactgagcaaagcaagaacttaagaaggatcatttgagattaccaagcaggcagttaggaggaaaatgaatcaaagttacaaggacaggaaaaatagtgtgtgcgtatgcctgcaagcatgtcctgtgtgtgtacctgtgcgtgcatactcatgtatgcatgcacatacatgtcagtgtgcttctttatatgtccttgtgtgtacatgttggtgcatattcacacgtgtgcacatgttggtgcatattcacacgtgtgcacatgcgagtatgcttgttttgtgcacatgcatgtgcatgcatgcatacctgtgtacataggcgtgttcacatgtgtgcatgtatgcacatgtgtgtgcgtacatgtcttcatgtgtgagcatgcatgtccttgtgtgtgtgtgcagggagagtgtctgcagagaatgtaaagaatcagaaagctggtgaaagctggagctcaggctatcctggtgactgggcttggctcccggtcactagcttagacaatccacatacaggctcaagaatttggccggctggatttggatcctgtctctactgctcactaactgtgcctcagtttccccatctgtaaaagagcagcctttcctaggatgagtgtggattaattgaagcgatgcaccagaagttcatggtccaggggcgggctcagagtcggccctcagtggccctggctgaaatccattaggactgtggggacggtcaccctcaccaactcccacttcctgccagcggatccctctcttgggtaatgagctggtggggggatgttcccaggttggagccacgtttgacctgagatcttctgtattctctagggcgagaaaggcccacaaggcccagctggccgagacggtctccaggggcctgtggggctcccgggtccagctggccctgtgggtccccctggagaagacggagataaggtaaggcaaatccagagtgacccatggctgggcctggctgggcagacgggtgtgggggagggtggtgaatttaaaggacaggatgctggcaggtagagcggctcagccagcggagtgatgccacacccaccccgcagtcctggcattaggggatgatttcacagcagcccactggtaaatggtaatacacgccgtccccggcacgctcgagggacttagaaaccacaccctcctgtgtcattttgaggttgcctgcaacatttgctgtgagtagccacagcagagaaaaatgctccccggtccccccgaataatttcaaattccgaaactgcggagcccggtttaatgaggttttgctcagtatctatttttaaatgtctccgcttgaattatccaggctcccgttcattaagaatgtgctttataattccaaaacgatggctgcaggagcttgcattttatccttcatttaacgcagacagtgaaatttcgctgtgctgtaactttctattgatgacccctctctggggacatttctgactttgtcacctctgcatggataatgccttacatctccgggcgggagacagccttgcaccgacaggaacaacagagaggattttaataacttcttcggcaacatagtaattgagttgcctgttgttaggttgtcatggtagtggcccaatttgaaaaacagagtaaatattttcaatatgacttttcccacatcttcaagtctactaaaagcctgtcgagcatcagatcgagacctcgtcccttttagcccttgtattaaaaaggaaatcaagctaatatatggaaacatttattcgtaggaaagttttagggccacctggaaaggacactgttcttaatctccaagaaaaattcattacggggaacagaaaaggtccaaacggttgtcaagctttctaaccgaatcccccacaccttcccctagggagagatcggggagccggggcagaaaggaagcaagggggacaaaggagaacaggtaagtattggcacgggggcgcgcggcagcccccaggtcccggggggcctcgtcgcaggctgtaggccgtgtgccatgcacgttctcttccaacgttgctgatgactagcgggacatgctgtgaaaatctcccgtgcatgtgtgttcccacaacgtgtgtgtgtgcacacgcgtgcatatctgggagtgagtctctctgtgttagaatgaacaggaagcatccaccggttttgcgaaattaaataaatggagtgtttctgtcctagagggcttgggttctgcagacacacccattgccctctgaggtgagggaaccagaatgctccggcagagacagcaccattgaccaaatgcctgttcatttttccccttttggttttttcatctgttcagaaatcctagtgggttcttgcaaaaaccccatgactctgctaccagctccctcccgatgagtgacatgtcttcttatcctgtacagccaggcctttcccccagtatgttgattcctaggcaagcaggatccgtgctcctgggaggcctgccacagaggctgtgtccttcttccagccgtgggttgggctaccagggccaagggcactgtaccctccttgcttgcctccttcccatggtcccatgcgggaggtctcttgaggatggcacagcaggggacatggtgctgggcgcaagggctccagaggagcttgtgatcctggaccctcactgttgaagggggcctcacgtgcccctgttgtgggtgcatgatgggagctgagatgacacacggtggtctcgagagacattgggggcagctctttgccatccagaaatgggctcagggtggaaccaagatcctcatctgcttcccagagcctgcagcaggcttgcatcgtggtgcaaggaacgacacatttggagactgaactgacgacgttggatgcatcagtccccgggctcaggatgcggtccacccctccctcagccttatccacgatccaagaagctacctatgtctctgtcttgttccccgcagggtcctcctgggcctacaggtcctcaaggccccatcggacagccaggcccctctgtgagtatccatggtcaatgaccttcgaaaagccccacgcccccccagagctgctggcattgccagcatcctcacccatggccggttatttccctgcagggagctgacggcgagccggggcctcggggccagcagggccttttcgggcagaaaggtgatgaaggtcccagaggctttcctggaccccctgggccagtggggctgcaggtaactgtggggttctcaccacaccgggctcctccgcttctgacgccccctgtgtcttcattgtgctctctcctcttgtctttttaagaatggaaaactaaagccaggctgcagggggcctcctgggcctcctcattccaactggaagtgctgtagcttcccagaattccagacatgcccgcatttaccacacttcagcagtggcatttatttctgtgctcattgtggaaactgatgattcgtgagaaacatagtaacagtgacttctaaatgcacctcctagagatgacaacgataaacatttgggcatgtttcatggccatgccttttaaatgtgtgtattctcatgcacagaggcgcatatgtaattgtatttggtgtttgacaatgaatcatgtcataagtcagagagaaagtttgttcccagctttccccattttccatcctccattcccgttttatgttacgagtgtgttgaatgccattacacatgactttctatttatttggaaaacatgatttttagtcactgcacagtaagccagcatctggtggtgacataatttacccaggcgtcccctgctggctccttaggctttattgttttatgggttcctgccataatcacctttgtcgtaaatctttgcaatcttctctgcttatttcctcgggccgattctgagactgggaaccccgggacgtcctcgtgggtagctatgcacagagaagcaccttcccggggcttcgggggctcagtggtgctgtgtgggtggaggtcgtgaaagctgtgtgtgtgtttgacatacacatgacagaacagcgcttaactgggaagtttcctgttctcagggtttgccaggacctccaggcgagaagggtgagacaggagacgtgggccagatggtaagtgtgcctgagactccaaggccttgccgtactagcggctcatgttttggggaaacatttgcgtttcctctgggctcagtggtctctcccttttcctagggccccccgggtccccctggcccccgaggaccctccggagctccaggtgctgatggcccacaaggtcccccaggtggaataggaaaccctggtgcagtgggagagaaggtgaggctcgtgcctgctctggtggcagatttgcggttgtttgaggagtgtgtgtgtgtgtctgtgtgtgtgtgtctgtgtgtatgtgtatgtgcgcatgcacacgcttgtgggggtgcatacacgtgtgtgtacctctctgtgtgtacacagagatgagaagtactcatttctgtgggcatggctggtttattcctatgaagggcattttgaaatgtaggcagatgcttgtgaaatggaactgggaactctgactgtccatttgtgacagccttttgcagaatttccagacgatgccccaccagcaaagcccctgcctcctccaagactcagctctggtggagatcatctattccttaaataactggtgtttctaagcttgcagtttccatttcagccgaattattttctcaaatgggtcctctccatttgatctgattggttttggagcccagactccatgagcgtcatggacccagtcgtgtgtgtgtgtgtgcctgtgtgtgtgagctcctgtgtgcacatcggtgcatgtgtgtgtgcctgcatgctgggtgggacagcatttgcctgactgcaaaagcacctctcccagttcccctggacaagagggaagacagagtgtacatccatgcacttgagccccctgtgcaccgtttccagagctttctttctgacatcaatcaggccattaaattggaagacgccttccaccgctgctcattttttatgatacagaaattaaagaggaatatgccctgctgagaccacagggtgatggtgtgcggcttctgctcagagaggcggtgttttccttggtgtccccgctgtagggcgcatgtttctgttcacctgctgccactgtgcatgccctcttccctgcgtccctctggcctgtgtccctgaggactgcgtgcctgtcctcctgcctcggccctggccatcccccacctggagtgccatcctagccacttaccagcttctcatagttgccctccacaacccttggagcagcgctccgggaaagccttcacagacagtgttgcttgcagtctggacactctgccctgtatccatcacgtgcctgccacattcctcacgcacctccaattctgggagtgtgtggggacagcactccccagaaacccctgggtcctgggtgcccaggggcaggcagacagcaggcaggatttggcaaatgcttgaaaccgtagcactgcgttcatcgcggtgctcaccgctgccataaccacatgcactgtctccctagggcgagcctggcgaagcaggtgagcctggccttccgggagaaggcggccccccggtgagtgagcgggcgctgcgggaggggtgggatatggccgagcgggtgtgtggacggggtgctgggttggaggctctggctctgccttagcttttccatccacgaaatgggagttgtaacccctcttgtgcccatttcatggaatgaccgtgaacaaggtgtgtgatgtgggagtcagcatgtacacgcagacctagcaatagctacctgtgcccagtggcctgcagtaactctaccctctgtagtgtttgctcctggccccttcgcggggcagctgctgtcacctcgtccccccggaccttgagggccagactaggaatatccaggccttctcaggccagatgaatgttcactatgaggccagcccaaaggtggctttcaggcccaggaccagctgggtggactcgggtcttctggttctagctgctccctccccatgagatccgtggagtctgtgggcaccccttgtggtcttcactgactgatgtctggtccaggagtcagtccctcccacccagagctgaatctcaggctttgagggccccagaaagtgaaggctcctcaggtccccctcagggtgcacacaggagctgattctgcccagggcttggggagcgacctggcagccagccccctgcagggctcagcagatacttggaaaggctggtctgaatggggtgagaaaaccggggaggcccaccttgctctgggcggcgacgtggttggctctgaggacttgacactggcctctttcctccagggacccaaaggagaaaggggagagaagggcgagtcaggcccttcaggtgctgccggaccccctggacccaaaggccctcccggagatgatggtcccaaaggcagccctgtgagtattccagacacacctcaggggccctgcagcaggggcggggctctgcactgggatcattctgactcactggcggtgcactctgctctgagaacagcttcaagaccattccatgtgttgggtaaattttctagacactagaggttttcataccagctactgaaccaaaatagtggagatgagacagggcgtggactggaggagaaagccctgagtgattcttctctgtgggccaggcggccggctgagatgcacgagtgacagccaggctttgggaagttgcccccgcccttggccggccctgattttgcatcaggaggggcttcggagaggcacattccggaagtctgaaggtccaggttctagttgcagcctggagctcccaggaatagacctgtgggcggaacgcctgccccttgcttggctctggaaagcaagagaccagctgacccctgccatgcccactggccaggcttgctggctctgggacatgctgcacgtggaagggtctctgggccataaagtgcactgggttgtcggaactgctggaaagtcttaggagctggacggtggcaggtggccatcttgaggtggtgacatgattggccgtgtgtggtctcagtcaggttgctgatggccttggctgcttccttctttcttcctttcagggcccagtgggttttcctggagatcctggcccccccggagagcctggccccgcggtaggtgctcaagagggcaaagccaccggatcccccacagtgctggcctgcctctgccagccccatttcccctctttctggtggttctttgtgatgaactcccactggggcaggcaatgtcccaaaaggcactcgtgttccggtgatcagagcaagaaaacgcctttgaccccactgaccatgctctgtgctggcaccagaatggatttgggttttgggaaggggctggagatgcattgggaactggtgcatgaactcagggtgccatccggggttcagcaaggagctcgcttttgcctccatagggtcaagatggtccccctggtgacaaaggagatgatggtgaacccgggcagacggtgagtccacaatctgggctggcttcctggtggaggtgtcagtgtattcttgggaccttgcagcttgcttgactcatttctgggaaaaactccaacctagttgatattgattcctttatgatatcgattcccttatgatattgattcccttatgatgttgattcccttatgatattgattctggacagtgacagagctcatgaactccctctgagatgcacgtgctgtctcagcagcaggtttgcaggcagccccagggcttccacgacccaccatgggctcgcccgggaacgtcagatcttacccacagctctgcctagcagggccagtgcctctcctcaccaggcccttcctgccttaccttgaccgagatcacactggacgttgcatctgacgcttggcgttgagtgttttaaacaccgcttcaagcccagaacgtctttctgggacggatcgacccccatgggccctgggcaggactgggcctggaggaggcccctgaggccttgcagatgcccttgccccaccttgcacccagcctggccaagcgcgggggactgcggacctgagggcaaaggccatgtcactgagttgagaggagcgtccactcagagaaggggttagggatctagcctcgggctggatttccctgacagacacccccagtccaccacttcccggcctgtgtcctgggacgattcttgtccccccttctgtgaaaggggatgccagtgcctcgtccctgcccaggttgtggtggggaccgaaccgtcattgtgtatcaagagtcagcactgtgagtggggaagttctcttccaaaatgcagaaaacccgcaggatgggagttggggttccttacgctgtcacagcccgggtgcgacactgtcttaggaccctctgtgctagccccaaaagaagagagaggcggccgcagggctggccgaggagtaaatagactgaaatcgccatgtgttttgcctcaattgagtctaacgggccccaattcctcacactctgttctttctcccaataccagggatcccccggccctactggtgaaccaggtccatcggggcctccaggaaaaagggtaaataatcctgcaggcacatccttgctgtcaaatccctgcatgaaacacccccgcccctccccgtcacctttgcttgggccctgggtgctctaagctgcactgatgaggaagggctcgggtgtggcatgttctccacttagcctcggccacatcatcacctaatcacaggcttgccaggtcgacgcagctgctccttttaggacaggccgcctgctgacacggtcagtgatatccatggtgggagaaagacacccgcaaagctgcaaaggtccttttcccctggctcaggttttactgaaaagccagaacaaatgagaaggcatcttttgcagattgaatggtccagccacttgctggtggggcagtaaacagctgcctggtgcacccaggacggaggccacacacaactcgcggcgtgcactgcgcctccccacgtggcctgagaggcctttacctgggactggagtccataggactcatgctgaggacccgtgtcactgcgggtggcccgggagcagcctccatgaccctgcacccctgccctgcagcccggcacaccctgagcacctgcacccgagctcgtccctctgcccctgcaggccacacacacacacaccctgagcgcctgcacccgagctcgtccctccacccctgcaggccacactcaccacctgctgttctcttgcttctttcagggtcccccaggccccgcaggccccgaaggcagacagggagagaaaggggccaaggtaacgtgttttggagccaggctgtgaccgcgtagacctcccccaggggagcccagagggtggggagtggacaagcgtgtgggcagagatgtccatggaggctgagagtggctgccccaggggcacctggctcatggcctacctggggaggagacctggttctctctcaaggaggcagccaagtggtggccacaagactggggccgtctgccttgcccacctgagggaggaggcgggtggtgggtgcgggattcagggagcccaaggctgagtagttatgtcccccggagccctgcgacctcatgcctggtctttgagtcggccagacctgagccgcctacctctgaagtggaccgtgtccgatggtgaccgtgtctgctgcggggcccgtgcagaagatgggacgccgtcacccatgcagttggcttggggcctggcccagagcacacgggaggctattctgtcagtgaggtgatggcggcccggcctggcactgtctgcctccctcctggaggcgcctgttgttaaggagacgggaggttgtgcggttccatccctgctcgggcagtggcgctgtgacacccggtctgtggtcggcgcagtcagcggagacgggatccctgctggcctgggagatgatcgggatggagacttgaccagggcagcttccacaggcaatgaaatgtggagaattagggcaaccccggatatggggtcacctgggactcctccagaggtgcccagggtttccgagcagtggtcctgggccagggtgcctggagcctagagctccggacctcattctgccctccgccgtcctgcagggagaagccggcttggaaggccctcctgggaagactggccccatcggcccccagggggcccctgggaagcccggaccggatggccttcgagggatccctggccctgtggtgagtaggctgtgaggggcagaggggttgccgagtggagggacgggggaccagcaactcatgcagagcgtctctgtgtttcagggagaacaaggtctcccaggatccccaggcccggacggtccccccggccccatggtgagtcacattcctcatggtgagcatagcgggtgggatgacttcgccacccaaagccccaaggatgaggactctgatccccctgcctcctcccacagggtcccccaggacttcccggcctcaaaggagattctggtcccaaaggtgaaaaggtaagaggggcctccctgccccagcaactgtgactcggggccttcaaatttgtggccgtgggtctcaaactcaacaagctcttgatccgtcacctaaatgtgtcaagcacctgctgcaggctggtggtggggaacctgaggggtgacaaaggaaaatagacacgctgtgtttgaggcttggcccctgcctctggggggtcctgagcagctcgggagatcccggaggcccctgcggtattgacggagaaccttccagctaggcacagaggccccggctgatgggtgtccaggatcccaggttgctgctctccctgggctgagcggccccagatcctttccgcaggaggtgtgaggacatttctgcagtgggagcaaagcccttttatttttctaactgctgggaattgttttccacttgcattgatttatttacaaacataaaaggtactcaggagtgagatggttgtatatgaagcagaaggcagtgagggccctctcatttccactctgacgtccgccaccactgcccccagccccaaggcaaatgagagctggggctgccttgcgaggcttgccctgggttcctagaagacaaacatagacagcgagtgtcatggattcttctttttttagaaaaacaacccatgattgtaatatctataatactctgcatctttctttccgtgtcagtccacaaactttgttttagttccgtataggagcaggcgttcggatttgccataggaaattggagagcgtatacgaagagaaagacagagataaacattaccactcaggaaaacccctttatcactttggtctgtctcagtgtctgtggctccctgtctgtttttagacgtgactgtggccagcgaagggccacctcggacctgccgtttcgtcacctggcccctctgttgagcctgttccccttccaggggaggctgaccatgatgtaaagcttcctgtgccatggctgtgctgcgtgctaactggcccaccgtggccgagcatgaggcgtggctccctcaaatgccccttcctgtcttcattttcccacagggtcatccaggcctgatcgggctcatcggtcctccgggtgaacagggtgagaagggcgaccgtggtctccctggcccccagggctcctccggtcctaagggagaacaggtgcgtgagatggcacttcttgcatgtgggctgtcgagaggcattttagatccctggggcaggcacccaggggacaggaggcccatcagagcccggaaggacgtccacacgtcggttgagtccggtcatcctgcttggcagatgggaacactgacgggctgggcttgcccaggtgcacagtgagctgggcagagccgtctcccagctccatgccctgactggcaggcggggcttcctcctcatgaccgtggtgtcccccagagctggagggactcggaagtcaggtcattctgcctggttcccagccctgtgggagagcctgtcacccaccgcttgcccaggaggtcactggtgacaaccagccgtgtttgccagagctgcgggcagagtggctgttctggctcctgcttccaccttgtccccagctgcccccaaactgtagctcattggagtttgcagcctctgcaaaccatagccaaggaaacgccatgcagagagcttcactctgtcccacaactctgagtgacttggaagtggcctggggagggtgacgtgtgccatggaggcaggagaggggatgaggtgacctgtagtgcctctgtccttcccccatgagggccacgggtccttattcctgtgtgggaatctttccgtcccgagcaaggtgtgacggacacacacacgcacagtatgctgtgcccacccacgcccatgcctcataggatgcgggggacagggcaggagcaggcagagcccctggaggctgggagtaaggtggcaccctcactatgggcccggggaaggttgcaggacatggctgaagggtggagctcattgcaaaccctacctcactggccagtgtcctccatgccattgactgttttcctctgccggtatccccaggccacagcagggtcgtcggaggagtgccgcccagggtgtggtggcccggcaaccacgagaattagagaggcatccagggtccccacggccagcggggaaagcacccctgtgtccaccctgtttgctcacctgccctcaccccaaaccatggtcttggcggcattgctgatgaaggtgtcgggttggtgtgcaggcttgggtagttgtggggtccttacaatgagccacagcccaagttcctgcagggacaaggtgaagggagggaagcgctccctccccagtgaaatacggccatcagccctccgctaccctcgcccccagcttctgcccggagagagctctgagtggaatccagggctgtagggagagaggctgcaggtggctccagctgcccgtggcaaagctggtcaaagctgttctgtgccagcagctcagtctgggagggagtcagtggggagaaggggtctgagcggaggttccacgctccaaggatgcagaaagcacatttacaggcaggacaggacagtcagcatggatgggactccctgcccaacccctccgggcttagttctagaggggagactaacaccatgagcaggaaacagcaagaggggcccaagccagggccacaatgtcagggcagtggtttctgtatttccaaatgaacgtgaaaagaggtgctcagcctgaagtcctcggtggcctgggggatgagagtgagttcctggcagcccagccgggggagcagtgccgagggctggcagccttggggtggatgctcaggtcgatggctcccctgacatgcacagcccaggatcagaaagcagccacaggaggctgctgaggggccaaagggcataccgtggggaagggacaggggagccgaggggtgtggctgggtagcagggttgcagccccgcagctcctcctcgtctgaaggtgataacctgcattttctggtccttttcagggtatcactggtccttctggcccgattgggcctcctgggccccctggcctgccggtgtgtatctgggaggggcttggtcattcctgggagggcagggagggtggggataagccttggggcctcagtgtggagctagagaattgtggaaaagtcacacgagaagctggaattggggcctccagggtggatttgcccattaactcaacattggggttccaggagacagaagaaaggaagtggcgttgcccggccatggtttttggtggggaagacagggacaggaaacggtggccatttcagggaacgaggccacttgtctgtaggcatctggggagggtgcggaaggtagtagttggctctccagccctcccaattcccaggagcccggccagcctggcccagacaagagcagttagctgccctcctctggcaccgctgcctgggtctcacattgctgggagacccagcattcccagggcatccccacagccgctgggctgcaggtacacatggcccccgggggcccctggcacgctgagggctggcccctgctgtgtgctatcagggctggggggtgcattccatcagccccttctgagccaggacatgctcttttccgctgcgccccccccgcggctgtctgagctggggtttcctagccagggtgggtggtaggctggccgggggcaggtaggaccaccctgtgtctccacgaggggtgagcaccagccaggccccgaccctcctcccactctagccgggcaaatacaagcatagactcttgagggggatgcgggtgggagaggggcgaggggcgagaccaggctgggcaggacatggagcacggtggggctggagctgagacccggcttgctgacgttctgccctcctctctctgcagggtccgcctggtccaaaaggtgctaagggctcctcggtaagtaacatgctgcccagccaggccaatgcctggaaggtaggggagggcgacgggtcccctggcacgggaacaaactacccagacaaccgtcctagctcaggccctgctgctcacgatcctcccatctttctacactgacccatggcggactgaggcaggtgggctgctcgccgcctgccctaggaagggctccatccctctctgttctcatctcaaggatccaggagggtacaggggtctctgccattctcttctctgctgtggctgatagggccacctcccccacataggtctccagggaccattctagagctgaaggtggattcaaagtcccctcatacctctgtgaccaagggttgattcttttctttctccccagggtccaactggcccgaagggtgaggcaggccacccaggacccccaggccccccggtaagtagcccttgaagcccagaaagcgggacgggggctctggctagctccgagggaattgagaaagcaactgtgtgtgtgtgacccctcctgagactcatgaagcccatgtggcatgcccgggccttgtccctcgcacgcagccggggaaatgagccacacaggtctatcacaggaagcttacaggccaattggccctgagaagaacagctggccaggagagagaggatacacgtgtgtgctgtgtgtgcatgcatggtatatgaatgtgtgaacgtgtagtatatgcgtgtatgtgactgggcacgtgtgtgtgcatgtctgtatgtgtacgtgcatcctgtatatgtgcatgcatgtgtaatgtgtgtgtacatggtttgtatgtgcatgtgtgtgtgcatgatgtgtgtatgggtatgcatgcatatatgtggggcacatatgtgtgtgcatgtgtagtgtgtgtatattgtatacgtgcatgcatggccgtgtgtgtgtgcatatgtatatgtgtacatgcatgtctgggatatatgtgcatgtgtgtgtgtgtgttgggatgggggagcactagacaaggccctggaggtgaaaggtgaagcccagtttgaaccagggcatggcgagtgcactattggacacccccctttggttgtggagtctctccaactcccatcgtcatcttagctgtggccttctggaagtgaatggctctttgcatcaggaggcattcatgtggccccactgtgttcagccccagctagggctgcagaggccagactggggagacctggtccctttcctcaaggcttggccttttgtgtggctgagggcaggatggcagatgcaagcccaaggctgcaaactgttaagtttcagctctagagagaaaggagaggtgctccatgctggcaagcacctggcagtggggatgggtgtggaatgttccagagactggaggaagggatggaaacagttctaaggcggacagatgtccatgtagcccaggttgccaggccccagggaacccctgcagatgtggccccagctgtccctgctctgctcatatcctgggacccttcccatcctccatcacccaccgctgctcctgttctgtcccccagggccccccgggagaggtcatccagcccctgccaatccaggcatccaggacgcggcggaacatcgacgccagccagctgctggacgacgggaatggcgagaactacgtggactacgcggacggcatggaagagatcttcggctctctcaactctctgaagctggagattgagcagatgaaacggcccctgggcacgcagcagaaccccgcccgcacctgcaaggacctgcagctctgccaccccgacttcccagatggtgagggcctgggggggcaggggtggccccccaaagcgggcatggacctgcaggacacatggagtgtggcaaggacagttcagccaggcacagcggaagggacaggacgggcagccgcagcctccccatctgtggggccggggtgcgcaagagcctcccctcttgaactttatggaggcatctcagggtgaggccgggtgcagaggccaaggctttgaggtcagactctccaggttctcatctggtcttaggcattttctggcggggtgacctgcttgaacctcgtgttcctgacctgtcaaatgggaacagaaacatctcccaggaagaggacagagttgcgtgaggcagtgcctgagaggctggcacagtgccagtggaagtaagggtcagtgttaggaccggcagcagacgctgtgcttgggcaaacggccttcaaactccgcgatactgtaaaaacacatccttctcctcaccatcatagcctcaggcaccaattgaaggataaattcccattagcttttcttccccctgggaagtttgaatgttccccctgcaagattcgagggatgttcatggttccagtagactctgatcctacatgcatgaatttccagagttccttccagaaccctctctgcatttctgtccacccagagagtaggccggaccccaaccctcctggccaccagaacacgtacccagttgcttcatgcaccagctgtgttcttggtgaatgagtttgtccacatctctttatgggcccagcaggagaagcaaaatgcaataaagtaaaccccagaaaggcccgtgttggcggcattcctggggcgtgcattttaactgctggactgaaatgtcacagcggcttccggaaccatccagggagcaatccttctgactctgcctgcctccctccccgtctctgaaatccaggtgaatactgggtcgatcctaaccaaggatgctccagggattccttcaaggtttactgcaacttcacagccggggggtcgacatgcgtcttccctgacaagaagtccgaaggggtgagtagctgtgtccctccatggccccagcggggcaggcgtcacagacagggccatgccgagggcttcaagcatttcttgtatatgcagctttaagactgaaagccagaaatgaatccgtttcatcagtgaaactgttctttcagaagtagacctgaaattgttttaagaaattttttagtaataaaataggtttgtgcagcccggggtcaggaagggttggagggctttccacctggcatcctgccgtcccagggctgggacttcactcactggttgataaaagcttttctccggtgactcagtggtcccactgacctgagacccccattaaaaccctttaaaggaattgggagcaggtacaataacgtgagcctgagacatcttccggaagctgccctttgcctcaattcttattatccagcctgtttctgtgggttggccctggtccctcctgagtgctttgttttgaagtctgtttagtgaagaattcggggtggggagctgggctctgttgagattttgtggcatgtcacttaaatacccacctctgtggcctttcggaggcctcagcgctgtagcaggagtttgtgtgcatgtggatggtgtgtgggcacatgtggatgagtgtgtggatgggtgtgtgaatggtgtgtgtgtgtgtgtagatgctgtgtggttttgtagttggggtgtatgtggatggtgtgtgtgtagatggcatgtggatgatgtgtgggtgcatgtggctggtggatgggtgtgtgtatgggtggtggatgggtgcgtgtggctggtatgtgggggtgtgtgggtggtgtgtgggtgtgtacatggtgttcgggtgtgtgtggctggtgtgtgggtgtgtagatggtgtttgggtacttgtggctggtgcaggtgtgtgggtgtgtggctggtgtgtggatgtgtatatggtgtgtgggtgtgtgtggctggtgtatgtgggtgcatgtggctggcatgtgcatgcatgtagacgggcgtgtgttgctatccctcaagcatgcacctgaggcaggtccagccttggcccaggcgaggactgagtctccctgttgctcctggaaggtgaccaagcctgcagctctcgtgcccctgcatcagcttgaacggcctctccttcatgagctcgcagttgtcgcgtggccccaggcaaaggccgcccatttctggggccgcagcggtttgctgtgcaggtccagacctgtgcgcccctgcagcctctgcttcctaacaacctcagtgccccagaagcagtttcctgccaggggaagagcagctacgttctccccagggaccgccatccccttacccctcaatcacgccctgaccgtgctgagctcagtagccactttgggttaggagcccactggctgcagtggaggctgcacatggctggagatctgtggggctccaagtgcaggggtcccctcccccacctgaagttttaactccttgagaacctgccttcctagtgacaaaccctgttcagagagaatccaaacacgggggccttccatctcggctctcgtttccctcagtctggccagaggccccgcgtggaattcccttagaaaagaggtttctcggccctccttcgcggcctgcctctgcaaatgggtggccttgccgctgtggaaatcacgggccagactcctccaaactcagaggtttcctgggaagccgcggctggtgttcacggcacagcagcgtggggctgctgagcgaccccaggctcccccagtgttgaccagccaggcgtccacaggctgcagcctcgggcctgggctacagctgcttggccaagggcaagtggagacgctttccgaggtggcccccttggacccggaggaggctcacagcagaggctgggggagcccgcgcttgcccacatcccgggactcttccaggaagaagctgccttcacgccgcctgggcttggcattgacagtggcagatttggaaacgagagagggtgggagagctctgggtggcgtgagaggcagatgggacacccctttcctccaggggatccccttttctggccttcttggcacaaggccagctcaagaagaaggctggggggatcagccagggatcagtcttctgtgtcctcatggcgcacaacgtgagccccagtcagtccaggctggggacaggccggccctgggggcccttccactccacgcctgcagcaagtgcaccctcaggcagccggggctccccttgtcctgtttttgggacccagcgtgcaggtctcccctcagaggaatggctgctcacccacccatccatccgtggcgtcactgaggcctgccctgctgggcccagcctgtgtgtctgcagcctcggcctctgtggaaagcaggcctcaggtgggagccctcccaggaagcgggcacaagtagtgccccatggcagcgtgagctggctgcacatgatccaggcaggcagccgaggagcagccctcacccgcacacgtctcagtccccaggaaggttctaccacacacacacacacacacgcagatgcacactacacaccacacgcacagatacaggccacacaccacacataccacacagatacacgatacacataccacacaccacagagatacgcaccacacacacaatacacaccacatataccacaccacacatcacacagatacacaccatacaccacacacataccacacacacgataaacaccacacataccacacacacacccataatgcgccatacacaccacacataccacataccacacatagatacgcaccacacatcagacacacagataccacacaccacgcacatgatacataccacacatcacagatacacaccatacacagacattacacacagataccacacacacacaccacacatcacacagatacacccataacacactacacacacaccacacatcacacacagaccacacattataccacacacacagcatacacagatacacaccactcatcacacacacagatgcgtaccacacaccatacccttcacacagacataccccccacaccatgcacgcgcacacacacacgcacacagtctggtgccgcagcagccaggcaaggctgtgaggatgggatgaggatgccccacccctcgcctgcagtaaatgctggcttttattaccattcccttggtccatcattcattcattcattcgttcattccctccctcagtgagcgtttccagcagtgactgagcaccaggcgctggcctggggcctaacatgcaaaacgagaggcagagcgcacccttcctgggcagcagcaggggctggagggctggggccaggctcctcacatggcctccagtctctccgagggctggggccaggctcctcacacggcctccagtctccccgagggctggggccaggctcatcctcacgcggcctccggtctccccgagggcccaggtcaggctcctcacgcagcctccggtctccctgagggctggggccaggctcatcctcacgcggcctccggtctccccgagggcccaggccgggctcctcacgcagcctccagtctccccgagggctggggccaggctcctcctcacgcagcctccggtctccccgagggcccaggccgggctcctcacgtggcctccctaagggccggggccaggctcatcctcacgcggcctccagtctccccgagggccccggccaggctcatcctcacatggccttcagtctccccaagggctggggcccggctcctcacgtggcctctagtctccctcaaggcccaggccaggctcatccccccaaggacctgggccgggctcattctcctgtgacctccagtctccccacaagggccggggccctcaggctgcactgaaggcgctcggtgggtcctccctgcagcccccccggcgtgaggatgcaggcgcgggggccgggaaagcctggggccttgctctggaggccggagaagtaacccttttgttctgtttctctccctccccacctccccgctgcatgtttaggccagaatcacttcttggcccaaagaaaacccgggctcctggttcagtgaattcaagcgtgggaaactggtaaggtggcctctggcgtctttgcggttgtcactttaaacccgcccatctcgtatcttacagagtaaaatggcccgctggcccaaagagcagccttccacctggtatagtcagtacaagcgggggtccctggtaagtggccacctcggcccggccacctcggcactgcctgcttgcggcacggctggctcgcggctctgcatggcacccatcgctgccatgtgtgccacaccgctcttgccaaaccgctccacatcacgtgacagcaagactcagctaggtgtggagtcctctccccagcccccgccaccctgacaagagtgtgtttctgcctggagtaggcagatggttttccgtttctgtgtagggcgcgcagagctgggtgtgggccccagcctgagctgatcctctgcccacagacggtgcagccccaggcacctgagcactgaggtcagacgctccagaagcaggagcgctttcactgtgtctgatggcagggcagaggacacagatcccagaccacttaagccattcagagctccttctaggacctgcaccacggatcccctctccccagctgctcagggctgagggctgtctctctgcccaccgggctgcagattcccagttacactgcacaccactgtacgagtcacgttttcacttttggggatcgagtcttacagaatccatccctgaaaggaaacgacattggcctcccaggaaagaaccacataggaggttcttctggccggtgtagtgcccaagagccagtttggacacattgatgtgaggacagcggctgcttctgccgcgtggagtgcccctaggaaccccaccggagtttgatttgggccctctcctggaatgaagagcagagttctgtcttttctcccagcaagttaaaggaccaaggttccagaacacaagacgggttccgggtgtcatttatggcccagattctcctttccctcccttcttgggatccagtggccccactcccaggtggtcctcaaaggagggccttgctctcagaaggcagcccgtgggttctgcggcttgtagcctgaccacttgccatgggttgctgcaccctggcaccagccccagcctccctgggtggacacagagcactggccctgagccgcctttgccctgtctgcacctctgaagcccctcgtctcataacctgaaggcattcacagctgattattcatctctcgtgccctcattgttgttggtttgaaatcatataccagctcctttgcagacactccgagggtctgtgctcaccgtggctgtgtttctggaggcttcccgttttgtggtttgccgtggacttgcagtcctctcctcctttcctctcctgcttttccttttccccgcctcctctgtgctgtgttccaaaaagagctgctggcatacagaaggacctgaaacacccggggacagggagggcccgggaccagggctgcttggcccggagggacagagcgtaggggatgctgatgtgtgggatcaggcaaggaaggggccctgggggtgaagctgctgggggccgaggtggcagggtccattctgcagtcttgcgggtagttaccgcctgcgcttggcactgccctctccccgcaatgacagctctcagcctccaaaaagagcctctcacagcatcctccaaaatgggaaaagcagaaagagcctattttcctcgcttggaggaaatggctgtgaaacctcatttgcagccttcagcccgagtagcccatttccacctctcgtcctgttccacagagagttaatgaaggttggggtgaagggacgacccagggaacacatcagcttactttaggatctttccacggccttatttctagctctgtgaatatcatacgtggacaagaggtagatgggggcctctcaaagatacccagatttttcagccaggtgcaggggctcatgcttataatcccagcactttgggaggctcaggcgggcagattgcttgagcccaggagtttgagaccagcctgggcaacataccaagactccatctctattaaaaaacaaaatgcaaaaatgggctgggcaggttggctcacacctgtaatcccagcactttgggaggctgaggcggatggatcacctgaggtcaggagtttaagaccagcctggccaacgtggcaaaaccccatctctactaaaaatacaaaaattagctgggcatagtggtgtgcacctgtaattccagctactcgggaggctgaggcaggagaatctcttgaacccaggaggcagaggttgcagtgagctgagatcgcgccactgcactccatcctgggggacagggtgagactccgtctccaaaaaaaaagaaagaaaaaaccagaaatgggaattttatctgggcagggctacccacactgcaccatactgagagaatactgcagagaatccctcccaccaggagagcagggcctcactgtgggaccctggggttccaatgcagggcagcgtgccccatgccccgggcccccctgctgccccatgggcactgggggcttcaggtccttctgtgtccggtgctgcccaccgccgctccctgtggtgcacactcttcctcgagtcagtcacgttccctcccagaaggagcgccggacggcccagcctgtcggttggtattcacttttcctcctcaaggtttgcccgtaaggttctcgtggctgcgtctgaaagcgtggagttcgccgatagccctgggactgcagcgtgttccctcgcccctgggaaggcccaggccccaggccagctgctcactttgggctttttctagtggcatctgttgaaaaagtgggtcctgcagtgtgttcaccctcttcccactcccggtgcccaaacactcttggcaatactgaagtcagttcccttcctctgttcaatggggctctttcggagcaggccagaggcagggtccaaaacacaccaccacgaggcagcggttgcataggagtgggcagagcaggtctcaggtgctggctttagcctgcttcattccctgatgctgcaaacaggacaggctgccctgcccagccaggccttccctgcagagagggtccttcaaggtcctgcctaggccaggagagatgtgtgcttcatttcggggagctaagatgcatcgatgtcccctggaagtgtcaggtttttcagaaaccttgagttggcaacagagatgcaaaagtgagatgcatcatggctcaggatgccctgcacgggccttgcacctggtggagctgagcagcccagtcctggatacccagctagtgatgctggagaggccacctaagaagctgcacattgtcctctgatgccttccctggatttgtgcagagactgggagggctttcagggaggatcagtgtcatcagagtcccgggctgacctttggcacaggcagggcaggcagatggagccactcctgtctcaggaagcctgctcactgccctgaggagacgcttctgggaaggggaggagtggtctttcttgagtggccatgccagacatcatccgggacccctgtgcctccaggaggatccccggtcaccccagccatctgcacagccctgaccctccctcaggctcgcctcccctgagcacctcactacagctggcccgctcactccccgaggcctcgtgccccgtggctccagctgctcacagtctccctggccagggccttgtacatcctgggcacccagcagatggtcgtttgttcacataatcttgtgagcaccttcctttgctggtgttggagcatgatgatagggacagggggccagagctggagtggagggacatcgggagggctgggatacagatcagggtccctaagccagccctagaggctggaggtggggaggagccttccctaggagcagtggtctaggctgtgacccaaaggacagcagtgggggcacctcctgccaggtggggagtgtcccaggccgagggaggagccgtgcagtggctcaggggcagaaggaggacacctgctgtccagggctcagggagaagtgtggtgcagctgggagggggctctaagacctcctcctctcacccccagggaacctaatgcccctctctggccctgcacccctctactcaggggaaaccagggctcgcctgctgctccaggtgccccgacccagcgatcgggtgcagagctctgcgtttcaggaatgagaggcaggtcttcatgcaagccatatttttgagaatggttctctgttcactcaacacatacaaacctggcagacccagatcaccatctgggatggaggcacccaggtggcagaaggggagaagaactgtgggtggacgtgcagggagagcagctgcagctggcactgcagtgggtgctggcccaggagacactggctgccgttcaccatgcagcaaagctttatcaagcgcacactgggcagccatggggcgggtaccacggccagtaacgagcaagaaggatgccatcctgccctctctgaacttatagtctgctagggaagacagacactgtgacaaactaaggttggggagggcagccacagagtaggtgcaggagcatctattctgggtaggcttcctggaggaggcagcacaggtgccgagccctgaaggataagcataagccaagagaagtgggtggattatttaaggccctgaaggacatgaggcatggttccctttgttcctgggaacacgcaagagagcccatgtgcgctggcctcggccgggtctgtgggtacagtgcgtttccaggtagttcccccgagaagaccacagtgtgagtgaagcccagggcagtgcggacgtggggctttgttgctgtgtgtgtccccaccctgctgagccccaacacccctgtccccccagctctcctatgtggacgccgagggcaaccctgtgggtgtggtacagatgaccttcctgcggctgctgagcgcctctgcccaccagaacgtcacctaccactgctaccagtcagtggcctggcaggacgcagccacgggcagctacgacaaggccctccgcttcctgggctccaacgacgaggagatgtcctatgacaacaacccctacatccgcgccctggtggacggctgtgctgtgagtatcccgcgccgcgcccagcacccctgctcacgcctccgtggggctcgctcctcactcagcacgggtttacctgtccccaagatgcctgccagagggcagtgagggccccggaccagactctcgccccaggcagccccacagttgcagggagactaggaatcccaggcctatgcagctggagctccgggaacttgggagagttctgtgggttaggatgggaaatctgagacctggccggaaaagccaggggcgtgggtccctcgccccatccagggctgtggcgtggagtgaggaatggaggacccgttgtggttccagtttggagctgggagcctccctctccttggacagggctcttctgggagtggccagaactaagctgggcctgttcccgagagcacggccgtctggaaacactgcagacagttgccagctctccggacagcccggcccatgggccctctccatgtggggagagctgttctggtcccagacaagggaatggaggccggagcggcgggaggcttgctgagacctcacgggcagtcagggctggtattggcgctcatacccatgggccttcccacatgcacgcctttcccctccctactcagtgagctgggctcacctccgctaaggtccccttgagactgccagggccatcgcacaggtctgggatgtgcccgcgtgtcctggaggtgtttagggtgcagctgtgccccaagagcccaggcctgcgggagcctcagacatgtccccctcgtgtggccttttagaggctggaggtgggaatcgctgagaattccagcctgtgggtcttcctgtcactgacattggagcctgttctctccaccacttattcttgagagacctgcggaaagcagcccttagcgcctcgctcctttagtgtttgtagaaaggcacgcctgaggccgggtaaacgggaagcggtttactccgctcccagctctgcaggctgtccaggaatcgttgtgtggtgccagcatctgcgtccagtgatggccccaggctgcttccagtcttgggaaggtgaaggggccagtgtgtggaatgcacaggagagaggaagcgagggggtgccaggccctttttaacaatcagctctcatgggaactagtagagtgagaactcactcattaccccgagggcagcaccaagccccgtgacccagacgcctcccaccaggcccacctccaacactgggaccacatttcaacctgagatttggaagggatgaaggtccaagccatggcaccggcccaggccagctcctgaggggaacggggccggcgttagggccggccctgcagggtgccctcttctgagcaacacggatgggtcctcagtgtgaggcctgggcaggcaggaaagccagagggtggtgccgactgagagtgcaaggcctgtctgtagccctgggagcagagtggacctgggttccaatcccgcctccccctgcccagcatcgctgcggagcacctggccctcacccataggacgctcagctccttttctctgctgcccaagggctgcactgagggttaaagctgtgtctcccagggccatcccgcggccaggccgtgctcagcgggggccgccctcaccaggagtgctcacctctcctcccggctgctactgccttctgcgattggttggggtcagtacttcggatctgactgtggaatatgcagaactcatccctgtgtaaggttgatggatccagatccctggaaagaggcatttaaaaatgccagggaccttacccgtcctccccaaatgagtataacatagcacctgcctcacagggctttctggggagcatgtcaaaccatgcctttagagctcggaatcgtgtctgacccactgcaagccctggatgagcagccagttcctgtgaatatttttagataacatggaccacaaatgtaaggcagtaaacatggaggtgaagagaaatcaggaaccctgtaaaggcgaggcaggacctggagggacagcctcctgagtttggctttgagcttcctggcttccatggcaaaaagggaaactagctggcccagtgggtattgtctggtaaagggagaggaacagctttccagagaggggaatgttccctggaagacaatgctagaaagatggatcccacgaaggacccttggaggttaaagggcaggccagacccctgctccctaatctggctaagagaggcttctgctgcttttaagaccttcctggaagatccaacttcttccatcccagttcctcttgaagctcctgcccctactcattccatcagcaaagcccacttctgcgaggtcccagaagtcttcggcaatgctttctgactcagaacctgacttcctggctccacctgcatcctgggatagggtcaagctgggatcatttaaattccacaagcagagagggctcttgctcagcccagtgtctcccggtgatgagggtgtgctgttggcatctggggaagtgtggccattggtttgcaagacattccactttgccagtctcgggtgtgccaaacgcctccagaaacactccccacgtccgaatgcgaaccaccaatacaagtgttcccttctttctacatacgcaaaacctgaggcccagagagttacggcgactcgcccaaggtctccaggtgtgacagagctgaggctcctaattcccactgcagcattcttctcaccatagccccttcctggcatagctgcaccttgaatacctcagttgacagtgatctcactacctcctgagacagcccaggccatggctgcagagtctcaggatgaggaagctcttccgagaactgggctcaagtctacttgtactatccgcccatcgcctcctgggtctggtcccgtcagccatgcagagggaaccgggttcaagagcagtttcccagcccaagccttctgacatcaaggcccgacggctctctgatggtggacagcaggctgtttggcattctcggcctccacccactagatgccagtaggagccccctaccgagtgacggcaacccagaatgtctccagacacatctcccaggggcaaaatctcccccatggagaagcacccttctacacacagaactaaggtgtgaagggagcgcagagggttcacctgctgcaagggcaaagaggacctgctccttcctgtctcccatggaacccaaagaagctggcacttctggggtgagatcaggaccctcaaagccgagaaccaagtgcagctgccgtccagaccgcgccaccttctcaggcagtcagcagcgtgggtctggttagccgcccagtgctgcaagtgccaccccaaaaggagaccctggctcactctctcgcccccttccccatggcaggcgttcctgagttccacaactgtccttggaagtgtctctgcgtgcagaggagggattgggatcacggggatacccagactgcactctgggcagggagaggagaagcagccccctccccagggctgttctacttctggaaagcaaagattctgactttgaaaagatggagagagaatggcccaaaactgcctaaccccagatggcaggggcaggctctgcggccaagctggacaggtggtttgggtggaaaggtgggcagtggcagcagcgtggagctggggtgcggggcggccatgggggtggcatgcagggacgctggcccggactctcaggtgccctgctgaccccagtccctgacaagcccaaccacaatttgaaaagtcacaaccgtctcatttaattacggaggctgctgcaggaggccctgatgccccgaactcgggccagcggcaaaagccctgcctcagcccccggaggtctgcatgattcatattgtaataacggccgaagaaattggaattccaacgcgggcatcgtttggctggggcgcctgattgacggggccgctgagcgggcccagtggagaggcacaaatcacctgcaagagggcccaggcaccccgccgcataaatcctggtgtttgtgcagctttcggcgcctctggggggccgttctggcctgtaatggttatttatacccctggaataacggggtaacagagcggctcgcagcggcctactttaaatacgcccctctctaagcactctgataattggagcagaggggtcccataaatcccatgaaatcacccgacagctcagcaaatgctgcccgtccctctggggagagactggtgccatcgctgagaagggctgtgaccgacgccactgctgagatgaactgcttgcccagcctcccaggggtggatgagaaaggccgggcagcgccctgctggcttgctgacctgtcgccgagctcacttggctccccaggacagcgccaccttgcagtggcccagtgaagccaggcccaaccatctcactgcactccctgggtgggactgggccagggagcagaggccggaggagaggcaggcagggtggtctctggctcctcgccggtggggagggtgaggaggttggtaccctcagggttcacccctggagggtgtggatggccacctctcattgaatatcctgtgtccagccccgctgcccacctatccttcccagccaccgcagagctgcaactggcccctgccctccgttccacaggagagctgtggccacccccaggcgggcttgtgggacagcagcatcccagctgtgttctgcagggctgagctggccacagggtgccgtctgccccacactcggcattctgtggaactgtgtgttttgctgtcaagtccgggggtgccccatggcgaggtcctttaggacagcgtttctcaaaggccagtcatgaccacgcctatcagaattgtctgagacacccattttttaaaatgcagattccgagtcccaccccagccagacggagtcagcctctctgggcaggggtcagagctgtagggggttaacaagctccctgagaactcgcgttctctctgaagttccaatcccaacttgaaaatcatgccaggctgagccagctgcagtaacagaaaggtgttcctatcaaggcagggttgtgagaagggcagggtcaggggagaagtggacattaggaggtgaagtttgggactctcatggataatagcaggaacgcatgcagggaggtgagcttcattccttctcacagcgcctctgtgatgtgagcatgcccattttccagctgaggaaactgagtcacagaaagcgtatcggttatccattgcttgtaatcaactagccccccaaatttagcagcttaaaaccacagatgttcgttacgtcaccccatgtccgagggtcagaagcctgggagaggtgcagctggctggctctagctcagggtctgtcttaggtccattcgctgccacgacaaatctcgccagctgcgtggctcataagcaacagaaatttgtcgcccacagttctggaggctggaagtctgtgagcaggttgctggcaaggcaggctctggtgagctcccctctgggctgcagatagcagcttctcactacaccctcacagggtggagtctctcgggtgcctcttttataggggcactaataccactcatggggttccaccctcaggacctcctcaactcccatcgaacggccccacctcctaataccatctttgggaacgggaacattaagatcatagtcagggagaataaggcccttcaaggccacgccctccccataggtcagggagcagaataccgggagagctggagctgctgtctgctatccgaatctccggcctgggagtctgcgctgggccctctgcagggctgcatcctggggtcactgcctcccatccgggagggaaccctggctggcccctacttgtttatctgatcatttcttttggggatggggcagtggaaggagatccttcccaggcccagatccagctgcgactgtaaatccagtctgggtctgaggtagcaaaagccatctgcccaggatgcgtttgcaggctcctggtttgcgggaaaggtgcggcctccagggcccttgtcttgggggaagttgacgggacagcagggccagctcagcctcagttataaagaacactgggagttatatttgggtggctttggggagggaccaaagaatctcacacctgcgctgcctgtgttctgggagggaggcggcctctcctaggcttccatcccacatcccagcgcccagggttgtgctgttttgagcaagggatgggtgctgactcatcctgcaggccaggttcattgcactacccctgccctctgtgcctcagtttacctaagactcctctagaccagatggtgtggaaggtccccaccccttcccatacttgtggaggtgaagacccagcccaccgagtgcctaaggcagtgtgtggcaggtggtcgtaggggggtcttacttggctcaaggctctgccggtgccgcctcggactccttccttttcgaacctggagcccccgtttgattttccagtgtgccctgcttgttctgtagctggccctgggtcctggggaggctgcctggaagtgaatacctggggcatcacaaggagtctggactgggcacggtgggaaggctgatcagcttcaatcctgtgtgtgcctcagccacccctgaagccttgggagggtcctgtcgcctcgctgatgcccacaccaccccacctccgacctgtgcagggggactcttgggacatccaccggggttaaatgcatgctctgatcagccatatttcctccaacacttgcccgggcaagcgcagccctgggtaggagacaggacaccagcctgggttttggagccagacagattgtggggggtgattggtaaaccccaagacccccaactgttcttaaccaccggccatctgtctccctcttccccagaccaagaaaggctaccagaagacggttctggagatcgacacccccaaagtggagcaggtgcccatcgtggacatcatgttcaatgacttcggtgaagcgtcacagaaatttggatttgaagtggggccggcttgcttcatgggctaggagccgccgagcccgggctcccgagagcaacctcgtgacctcagcatgccattcgttcgtgagtgtcccgtgcacgtcctgaccctggacagtgaaggcttctccctcccctcccacctgacttcatctacgcctcggcaccacggggtgtgggaccccagcccggagagaacagagggaaggagccgcgcccccacctggagctgaatcacatgacctagctgcaccccagcgcctgggcccgccccacgctctgtccacacccacgcgccccgggagcggggccatgcctccagccccccagctcgcccgacccatcctgttcgtgaataggtctcaggggttgggggagggactgccagatttggacactatatttttttctaaattcaacttgaagatgtgtatttcccctgaccttcaaaaaatgttccaaggtaagcctcgtaaaggtcatcccaccatcaccaaagcctccgtttttaacaacctccaacacgatccatttagaggccaaatgtcattctgcaggtgccttcccgatggattaaaggtgcttatgtttttgtgagttttaagtaaatatttgt

SEQ ID NO: 36391 - DNA, 109865 bp, Homo sapiens
tccccggcttccgagcacagcatggcggtcaaggtgactccaactctctgctgctgcttttattgcataagagacattccgagcgccctgcctgcagccccccactgcttcccattttattcattgtctaggtcttagatagcttgtcctggggctccggcttgctgcggggagagctgtgcggggcttggaccggaggaggggatgcccggctgggggaggggaaggaggagggattgtgagttgaaggggcttgtacggtaacacgggtcagtgaaggaagagtaatgtcctgtcctaggtgcatgggattgtgagtccggagttggagggcatcagaaagggtgtgggaggaagtggcaagtaaagctggggatacctagggtatcagtgaattgcggtgggggagggagtaagtattgagtaatttggggcctcaataaggccgagggcagtggttggcttttgcgttgcagattgcagggtatggaaagtatttgtatttgtggcagctctcatattttaggttggatggggagagggacgcggagataattacatgttgggtttgctttttatggagaaaggctgctaggccaagtgattaatttgggtgatttaactttcctgttgatctactcttgttagcttcttgatttgaaggtgggtggttactactgtgttgctagtagatgtggaataaagtaaaagatcctcattgccttccctttccagtccagaggaagcactgtccgatagctttgctgtatcttaggctattcgcacctgtttttctgccctctagtcacagttatccagtttgacagttcttatcagcaattagggcttttagtttgttttaaactaaatgataaaagataggagcattgattgttagccatgtgacctctaatctgaagagattgtgtggtctctagtgaagcattaactggcttttttttcttttttgcttacaggtgcagacaactaagcgaggggatcctcatgagttaagaaacatatttctacaggtaaattggcttgcatagtgtgcctttcattgcaaaaacaaaaaacgtacatgtccttagtcctattcatgccttaactttgaggaatgttcagttttcatgtattctttcaaacatgaccggacaatatagcttatacttctcttaataaggtttgatttaaggccttcttttaattaagggtcgataaaaggttttcctcaagttactgcttttttttttacatgacttaagatatatattttgaaaaaaaatttccagcttaagcacagagaccaagataaaatttcaaaatgtattggcattcttgtatagttaataggtatgatgactaaaattctcttccttgaaagttgcatgtttacaaagttttcctacttatgagctatcctccatgtaatttgttacagagataagaatattatagctattcttaatttgtgtgtcttacttacattgtatccttaagccttggggattttaccccaaaatgttacctcttaagattcttgcaatggtctaccttaacttctaagcttttagaatcagtgacttggctgtagacttaaaaagaaaagaaaaaagaaaaaaaaaaggttggcttagttttttgttttgctttcttttcttaaatttcaaaagtttcctatgcaggaaattgtacttaagaagtagatgtaggccgggcgcggtggctcacgcctgtaattccagtattttgggaggccgaggcgggtggaccatgaggtcaggagatcgagaccatcctggctaacacggtgaaaccccgtctctactaaaaatacaaaaaattagccgggcgtggtggtgggcgcctgtagtcccagctactcgggaggctgaggcaggagaatggcgttaacccgggaagcggagcttgcagtgagtcgagatcgtgccactgcactccagcctggggacagagagacactgtctcaaaaaaaaaaaaaagtagatgtaaagggaggcaagctaaggtgtttcaccaaatattgcatttctctctgaaatcttttgagaactttctattctggacctgggttcttatgaagacactttgaccttgggcaggtccctgctgtgtattattttcctctgtgaaatgagaggtgatctccaaggttccttcccattccaaaagtctatgagtctattttaggaacagattctaacatatgctgatgagcctggaatagatgacatttttatttgagatatgtggtttgcttaagctattgttgggtaagacgctgcgtagttgagcatacatatgtgtagtttatgaaaaataatttgtgaaaatgggaatcttaaaggtcataatatctgataagggaagtatttttttccagaacagaagtaattataataacagaaatggtccatttatgacttgaaacctttattccttgcaggcattcttgaaaatagccaaaaatatatcggtattcaccataccatgtgattatagtcaattgttttgtgaagagttcatgtgatatagttaattttatgttctagactaagtagatgcggaagaaatgagttgaaatgctgcatgatgtagtgaaaagaatactgcctaggtatctgagtactgcctaggaatacggagttaattcccagccctgcatttatctggttcttgtacccttaggctaatcatctggccttcctgagtttcagcttctcatgtgggactcagtgggacataaaggaatgggaattgaggtctttctagctttaaaaattctatgggaaaaaaatatactgtgattctgtatggatttgttttttgtttttgagtgggggtagaggtgggttggaggtatgaggagaatggcgaggactgtccctagctctttgacaacttttttttttttttgagatggagtctcgctctgtcgcccaggctggaatgcactggcgtgatcttggctcactgcaacttctgcctccggggttcaagcaattctcttgcctccgagtagctgggattacaggcatgtgccaccacacccggctaattttttgtatttttagtagagacagggtttcaccatgttagccaggatggtcttgatctcctgacctcgtgatctgtgtgcctcagcctcccaaagtgctgggattacaggcgtgagccaccatgcctggccgattctttgacaacttttaaatcttagcttttcatttactgttttgcatatcgtcattatctttttacacattattttgatgatgcctttatttttatgttgaaaatttgtggaattcataactgcttatttagcactaagtatgaaacattgacacaagcattattgatagataagagagtgatagaatgtaaatactcaccttcagaaaggcctaacgcagcaagaaagataacaatataggctgagtgcagtagctcacacctgtaatctcagcactttgggaggctgaggctagaggatcacttgagcccaggagttcaagaccaacctgagcaatatagtgagacctcgtctctgcaaaaaattttaaaaattagccacacctggtggcatccatctgtggtcccagctactcaggtggctgaggtaggaggattgcttgatcctaggaggcagaggttgcagtaagccaagatcataccactgcactccagcctggcaacagagcaagaccttgttacacacacacacacacacacacacagacacacacgatacagtattgctagttggatcaatttgaggatagttaccaagtaaaagatttttattcctggcttgaatacttcaaactatagttatttgaagctttgcagtactgtttagaaacagttttatgaaacagttttatagatgcatatagttgattaatattttagctataatagaagacaaaaatacatgctaaccgtgtatttctttagcacttaacatatttacccaacaaatatttacaaaggattatttgctgtgtaccatgcacttttattcaatacaatactgttcagtagcagacaccaagtcgaatatcaagagagacaacagagccaagacctaaatgctgatggacatgtgattggactagctgctctctcaggcccatgccatctctcatggtttgtggttgagggaatcaagaatagtgaaggcaaatgcatagcctgtggtagagcaatcagattggcttcttacatcatagtggctgtgtaataatattgacaatggctaacatttattgatcatttagagtgtgcttgagattggcctagtgctttaaggatattaatgttagttttcataacaactttatgaagcaggtttaatatccttgttacatagatgaggttaaattaatgtcagactatgtggtagagccagattcaaatcaaattccagagcccatacccttaacccttacataatactactggtaggatattgaaatggggtgacttttgaaagacagaggtatatcaggggataatggcagagtgttaagaagttaaaaaaaaatctggttacttaggtgatgaaatttaaaaagtttctttacactgtaactgtctagaatagttagccaaggaatttggatttgaaacagtagggagccactgtgggtttctgagtaggcaaattgaagtggtgaattctggcagctttttgtgtatgttggataaagtatgaagagattggaagtagcttaggtgataagctgagaggctactgaagtaatacttttgagaattaatgacctagagtggttgatggctggggaaatgaaaagcaaggacaataccagcgatgtaagggaagaatctatcgaatttggtattaaatatggaagtaagggaagaagtagaagtgaacctgtcagttttaggataggtgttaattgataaggcatctatttagataatattttttggggggatggggttagtttggttgctaaacaaatgtatctcactaagttaaagttggatttggacagatacaaatttgtgcaggtggtagatgaattccttgtatataaagcaaggcagaggatcaggggctgatttataagtgatatctccaattgaagtaggaaggaggaggaggggaaatagggagaatggtcccatgaaagtttaaagtaggagtttcacaagaaggatataattaaaggttaaaatgtagattattctgttattagtatgatttagtttggggaggattttggggtcacttgagtttagaattatctgagctacttaaagactataaagagatataattttaaattttagagtacagttgaaaactctttgtaaaatgtagatctgtggcattaactgtttaagttcacaaatagtcaataaaaattcctactttcaaataagaatattttgttaaacttttgagccatgggtcaaaagtcatttgtaaaacaataaaatggccgggtgtggtggctcacacctgtaatcccagcaatttgggaggctgaggcgggtggatcacttgaggtcaggagtttgagaccagcctgggcaacatggtgaaaccctgtctctataaaaaatataaaaaattagccagatgtggtagcgcacgcctgtaatctcagctactagggaagctgaggcaggagaatcgcttgaacccgggaagcgggggttgcagtgagccgagattgtgccactgcacttcagcctgggcgacagagcgagactcactgtctcaaaaaaaataataattaaaaaaatatatatatatttttatttgaaagtactggtatatcagctgggtgcggcagctcatacctgtaatcccagtgctttgcgaggctgaggtgggaggatcacttgaggccaggagttcaagaccagcctgggcaacaaagcgagattccatggctacaaatatatgtatatagatttagctgggtgcggtggtacatgcctgtggtcctagctgctctggaagctgagatgggaggatcacttgagcccagaagttcgaggttacaatgagttatcattataccactgcactccagcatgggtgacagaacaagactttgtctccaaaaaaaaaaaaaaaaaggaaaaaagaaaagaaagtggcaactgacttatttatgtatctatgtttagtgaaattgtatgagaattggtgtgggagttcataagaagggctttataagagtaaagcattattattttgaatatagggaaataggttcatttttcctgtggtgttcattgcttctcaagttttgatgagctatgtttctattagttaaaaaacatcaacaacaacagtatgcactaagattctgcctttttctgcccacctccactctgccaagttcatgaaattggagtacaacaaatgaattcttatgtgttaggctgtgctgtaattttacaactggtttaagctaagattttaccattaccacccttacaactgtcatttcttgatttatcccttttttcttttaacctctctcacccacacactgtcattgattcaatttagctacatcagcagtgtacagtagcaaaaggagacaatagaagcagtgaagaagaaggtgaggtgggacagcaggaacataagtctgacaaatttctaaatgaagagttaattttgtctgtcccttgtggcaaagtagatttatcaaaaacatttaaatgaattattttttaatctctctctctttttagttaataggcttcttttgtttgctggtgtgttgtatagtaaaggcaatatatgttaagactgcaactatatttgccagatcaaaaatttactgaaatgtagacctcaaatattattttaattttgttcttttttcattatcaccaatgtaacaatgaagatcgtatcccatacaaaattatgaaaatgtgcttttttcctgtcttattttaggttagagaataaagaggagaagatactgttaatgtaaagcaaagggcgattcctccttagggtttttacaataacatttatttttaatagaaagatatgttcttttattcaaatagtttatgtattttatttacttatttttgacagtagcctggagctgagaagggaataaagcagggcttttagcaggagacccttactctttgttgaaatatacattagggctgtgtttccaaaagtgtggaaggtataccacaatattagagtaacaataagattatcaagtattaaagggtgatacagtatttgtggaaacaaagactctgaaaagcaagctggcaatggtttaaaataaaaagaaaatatcatttgaacaaacaatggtattttcttttggattatttatcccagagaaataaaaatatttgtaaaaatataagaatatagggcaagatgtggtggctcatgcctgtaatcccagcactttgggaggccaaggtgggcggatcacaaggtcaggagattgagaccatcctggctaacatggtgaaaccctgtctctacaaaaaatacaaaaaaattagccgggcatggtggcgggtgcctgtagtcccagctactcgggaggctgaggcaggagaatggcgtgaacctgggaggctgaggttgcagtgagccgagatcgcgccactgcactccagcctgggcgacagagcgaaactctgtctcaaaacaaaaaaaaaagaatatatatgtacaaggttaactgcagcactgaatttttcctcaaaaaagaaaaaaaaaaaaaacagcctaggcaacgtggcaaaaccccatctctacaaaaaatacaaaaacctagctgggtgtggtggtggcatgagcctatagtcccagttacttgggaggctgaggtgggaggatcacctaagcctaggaggttgaggctgcagtgagccatgtgcaccactgcactccagcctgagtgacagagtgagactctgtctcaaaaaaaaaaaaaaaaaagctattatattaaagaggagtggtagaagacttatggaataactatactatgaaagttatgcagatactaaaaagaatgagttaggcctagaccaccaatttagagaaattttgcaatgtactattaagtgagaaagatgcaaataagtatatatagcatgattctgatttgtaaaacaaagtcatttcatgtatgtttacatataatatgtttgtgtatgatttaatgagcactgagaaagttatgaaaggataaatactaggttgttaacttgagggaagaataaagaggaaaataaaaatagtctcaatgtatatgtattaagctttgagcaagtgagtaatttaaaaagtaagaatttagcaattcagagcctgaagctacaagaggatttcccagcataatttggattgaataaacccagtatgagacacacagaaaaggatctatagttttattaaccatgctattataattgagggttttcaccagttcctcagaaatatggaaattgaagatgataacctatttatttatttatttatttatttatttattgagacagagttttactgtgttacccagactggagtgcagtggcatgatcttggctcactgcaacctccgcctcccgggttcaagcaattctcatgcctcagcttcctgagtagctgggattacagacacatgcctagctaatttttgtgtttttagtagagacagggtttcaccatcttggtcaggctggtctcgaactcctgacctcaggtgatccacctgcctcagcctcccaaagtgttgggattacaggcatgagccaccatgcccagccttttctaaatactttagaaagtatttaacataaactatatagagttctcattaaaaaaaaaaagaacagtattaggcattaaaggcagactagcaggatagtgagactttgtccttgaatcaagcagaaggattgaaaaataataaaaagataagaaaattagtgttattaaatgccatgtgatgttctactaccaatcaatacactttttttttttttttgagacggagtctctgggctcactgcaagctccgcctcccaggttcacgccattctcctgcctcagcctcccgagtagctgggactacaggcgcccgccaccacgcccagctaattttttgtatttttagtagagacagggtttcaccgtgttagccaggatggtctcagtctcctgactttgtgatccaccctcctcggcctcccaaagtgctgggattataggcgtgagccaccgcacctggccgatcaatacacttttaattgcctactatgtaccaggctaagcactgtactaggttctacctttatagagataagatagagctgtttagtgagggtagggacaatacaaaggacctcagtgaaggtagaacctcacattcttttttttttttggtgggggacagagttttgctcttgttgcccaggctggagtgcaatggcgcagtctcagctcactgcaaccactgcatcccaggttcaagcaattctcctgcctcagcctcctgagtagctgggattacagatgtgcaccaccacacctggctaaattttttttgtatttttagtagagatgggggtatcatcatgttggccaggctggtctcgaactcctgacctcaggtgatgtacctgcctcggcctcccaaagtgctgggattacagatgagagccaccatccgtgcccagcctagaacctaacattctaggggcgaggtggacaattaaaaaagcccacagagcagaccacgaggtcaggagttcgagaccagcctggacaacaaggtgaaaccccgtctctactaaaaatacaaaaattagccaggcgtggtggcgggcgcctgtaatcccagctacttgggaggctgaggtgggagaattgcttgaacccaggaggcagaggttgcagtgagccgagatcgtgtcattgcactccagcctgggcgacagaggaagactcagtctcggggggaaaaaaaaaaaagcccacagattggctgggcacactggctcattcctgtaatcccacctctttgggaggctgaagcaggaggatcacttgaggccactagtttgagaccagcctggccaaaaaagtgagattctgtctctacaaaaaaaaaaaaaaagataaaaaagaaaagaaattagccaggcatggtggcctgtgcttgtagtcctagctactaggaaggctgaggaaggaagatcatgtgagcccaggagtctgaggttacagtgagctagggtcatgctactgcactccagcctgggtgatagagtaagaccctgtctcttaaaacaaaacaaaaaacaaaacaaacaaaaaaaagcttactacagattgtgacacgtccaaggaagtaaacagaataatgagaagggccatcattttttaaatcatttttcaagagagtggtcagtgaagggcccttaggaggcaatattaagagctgagaactaaaagggaatgagggtgaagtggtggagggaattccaaagggctcacacgtacaaagcttagatatagaaaagggtttgatgtgttcaacaaacagaaaggccagtgtgcctgaagcattggtaattaagtatgggggtaaatggcctcccaaagtactgggattacaggcgtgagccactacgcctggccgattctttcaatttaatgtcctcctgtctatagagttcctagaacatcttgagctggatgaaactccttttcatccagagggcagcagagtgtacctggagcctacatgggatttgtagtctaacctgggtttgaatcctcatttgaaaccttttgagctcaggtgtttacttttggagcctgttttctcatctgtctaagaagggataatgacacctagcacatagggatgttctaaagattaaataaaataacatgtaaactatgcagaaccaaataaagcttagttccttgtctctttccttctcttctaagttgagattaggatgttttgtttgtttcttgaataagatctgagtcccttgtcttctccagatgactatgctggacctagtcaagagactaagatgttaatatgtatttatgattatgtacatataatcagttaattacttacattcttgagacatccatctgaagttattgacaaataccgatttctctcaagtctatgaggttctaagatgttgtatagtcacagtctaaggctgggagacccgagagaccatggaagatgtttgcagagttttcttctgaaacttcattcgctcagtctggacgtgtaaaagaataacggtccagccataggctctgaaatcccaagacacagacttgaaaaaatacatattttttttttgtgcgtaactttcttttttaaaatcaccacctccctgttctgtgcagatttctcttacttagtactgtggaaatttctgaaagcatcttccactgaaaccattgctatggccagcgttgggtttctagaactggaagaaacacacattttgaaaatattagtcagtactatttcagtcttcagtgacaggaattttggttaaacatgcgtaggcttagaatgtactggctctagccatgagtggatcaggagcttaactgctgtcaccagggatcatgcacctttcatctcttagttttggtttctgttgtgctagcttcattctcaaacaggctttgccatgtggagcatccccagattaaaatcctacccattcagcagagaaaaggtactgtttctccaatttctaggttaagtctaggaattattgtcctccctaataccccaagaaaacccatgtactagaaggaggcagtgttctcattggccagatctggttcacatgctcacctctggaactgttcagttgagtcagccccatttgaatgacctgtgtaaattgagggtgagggaggtgtgtatgttcaagaaaaattagcatgcagttaccagaaggggggaaggaaagctaggcacattaaaaccaagaactgtttatgtatagcatataagggattggaaaacctggaagcctaggggtgactcagggaggctgggagacagagatggcaagagattctgtgcctccaagtcaacactgctgtatttggtagctttctagaacattccagtgcagctgtcatactatctgcaaaaataccttaagtgaaatgacaaaaaataaccaaaattaggacccctgaagaagaaatgtatcctcacctcattttttcttcagaaaaattttttctctcagtcttctttctagtctttttcttatggtggtcttcctctccccatcttcttttctgtccttaccctacccctcccatcccatggctcattattttcagcagatctgttcaacacagattgctattgattgtcctacaaagagccaggtactgtgcaaggtgctagaggtatgaggatgaataaggtatccctgtttttaaaggactcatagcctagagctgcttaaattacacatccctacattaatacttttttaaaaaaatagaacattctgtataaagctgaaggcttgaagtccttcctgagctctaccccaaaagccaatacttctgaaggcttgaagtccttcctgagctctaccccaaaagccaataattccctgccacctaagaggtaaccactgttcttggtcgtgtttctttctgatctttccccatacatttacacagaaaatatggggttttggccgggcgcgatggcctgtaatcctagcactttgggaggccgaggcggctggatcacctgaggttaggagttcaagaccagcctggcccacatggtgaaaccccatctctactaaaatacaaaaattagccaggcatgatggcggatgcctgtaatctcaactgctcgggaggctgagatgggagaatcgcttgaacctgggagatggtggttgcagtgagctgagatcacaccactccactccagcctgggtggctgagtgagactccgtctcaacaacaacaacaacaacaacaaaaaaagaaaatatggggttttgtggttttaaaaaacataaataataatagctaatgcttactgtgtcactgttatgtatcaggcactattttaagtattttatataaatcatcatatttaatcctcagaacaactctataaggtaggaacgattagtattcccattttacagatgaggaaactaagccccagaaaggttaagtagcttgttcaaggatatacagtaaacggaggagctttgctttatatattttaatacaattcgccttttttacttaatattatttggagatacaggtatgttagtgtgtaaagaattgtttcattatttttctgtagccctttaaataactttgttatgaaaaatttcaaacatatacaaatctagagaaaatagaataatgatggataccatggatgactagagggagaaaggaaggaggggaacagggtggaaaaactattgggaactatgcaaactctctggctgatgggatcatttgtaccccaaacctcagcatcacacagtattcccttgtaacaaacccacacatgtaccctcttaatctaaaatatgaattgaggctcatgcctgtaatcccagcactttcgaaggctgaggtgggtggctcacttgaggtcaggagttcgaggccagcctggccaacatggtaaaaccccgcctctactaaaaatacaaaaattagcgtggtggtgcatgcctgtaatcccagctactagggagactgaggcaggagaatcacttgaacctgggaggtggaggttgcagtgagccaaggtcacgccactgcactccagcctgggtgacagagggagactccatctcaaaaaaataaaatatgatttgaaattattttttaaaaagtttgttgtaattctaactgaattaataaactttaaaattcatacaaaaaaagagaaaatggtataatgaatcaccatatatctgtcattccagtgtcaccaattatcatggctaaccttgcttcatctgtattacagccacagtggcttattttgaagcagttctcagacatcatcttgcagtatccataaatagttcagtatgtagctcctaaagataaacactctgaaaaactaaccaaatcataacaccattatcacacctaaaaaaagtcttatcatcaatttcttttgagtgtcgaagttctctgattgtttcatatatttttaagtagctttgttaaaaagcaggatccaagctagattcatacattgcatttggttgatctgtttcttagatcttttaatactttctgcaccctgctatgttaaaggtccttatttctctttggtaaaaatcttggtatttaatcaaggcttatcaacattaaggcattccatccccctaggagcagcaccttgattgtcaaagcgacatgatttgcccaagcttatacatatatatgcttcttgtatgttcccatggttacttagactaagagactaaagtatttatttaaggaatgatgcaaattaattattcaacttaatctgccttgggaagcattctagttccagttattgggttctttgggtcattattttatttccaaggtttttggttattttgagtggaaaattgttttggtagatcttctttattatggtagcttcaattgatttcattgattaataagggtctttacctccctgctgtgttagaaattgcatcattcagtagctgacagtagggcttactatagtggacagtgaaaatatattaaaacaacaacaaaaataagcacatagtattcatggaagcaatctgagttaggaagacagagcactgaataatatttttttagcaaaatcagtaaaaggttttgtttctagtatatccaaaatatgcaactgaaagtgctaatcaaaattagatttatacaactgcttttccctaatgctcatgtagttgatttgagtaacattggaaaaattttacattactaattaaaatccttgtttttaaaaattaatatggcttaataaagttgttaaaaaatcaaactggccatatgtatttaaaataatttttttcttataaagtattatttatgatagaatgctcttttattctaattgaactaacataataaggcaaattacacattgtactgtttaacagggtttgtgtgtcagatctgctgtggtctttgctccttatgtagagtgcttgtgtagtgaaagggcatgcattcctgactaaatttggcttctgttggaagtaagagccataatagtgaaggacagtaagagaactagcttcatatactcagtacttgccttggtacatattgtcctcttttattgttcaaataattcatttttctatgtgggaaatgctctatgagatatctgtagttactaaacttcatgatattgtcatttgaattactgaaattgaaaggatgttaagatctgaaaatgtcagttcatctcagttggaacaaagtaatggaggaacagtttgttttgactcatattacagccacatgttggttagacagagataaagctgcctagaccagtcaggaccgatctcgtggtaagcccaggaatactggaagccaacccagggaaactctggcttggagagagatgaaaggttagaacaataatttcttcatgtttgggcaaaagcagaagaattcactaagcaaggagggaaatagagatcctatgcttttctgtttctaagcattttacagtaactatttcaagttatattttacaattttgaagtactttggtgttcaaggtgtcatttttgcctcacaataggacagcaatttttctgcaaacccttgttaaagaagagactccaagaatctgcatgttttgcccaaaaattcttgagttaatggcacaggagtttagaacccaagttttctgacccagttttagtgtccgtcgtgccatcatctctgagctacttgacagcaggcactatgtcttgttgatctctgcatccccagtaccaggcaccaggcatagtgcctggtacacagtttcaaaatgaatgcaaaataacctgaaagatttgatctcagcagatttttggcttaaaaagcagtgtttctagatatattgccttagttttgatgtgcatacttcaaaaatccttaatcttgatacaccatataattttttaaaagtaaccagttttctagtcacaacacatcagaatttttctttatagtctctggaatatcttttagagatataaaacatcaaaggatctgtttatgaacttaaactatttaaacaagtaatttgtatcatttagagtgtttgggctttatgctcattcaaatcattgaattttaagttaacctttttttcttagtggaaatttagggttgtgtgtcagtctttgtaatgtgtagttaatataataatataggttgcatacatcctttttttttttttttttcctgggatggagtcttcttctggtcgcccaggctggagtgcagtgagtggcacgatctcggcttactgcaacctccgcctcctgggttcaagtgattctcctgcctccgcctctcgagtagctgggattgaaggcacccaccatcaggcctggctaatttttgtatttttagtagagatggggtttcgctatgttggccaggctggtctcaaactcctgagctcgtgatccacccgcctcggcctcccaaagtgctgggattacaggtgtgagccaccgtgcccagccggttgcatacatcctaaaggtcacttaaggttaaatttggtaaattgcaaaggagttattgctatccagtttattccagtcagttgaagccttggtatgttgatctgttggcttggtaggcaaaacatttttaaatggcatgatcttctcatttggagctagagatagttcagtgtaattatgatacacatctgtatgtgaaaccctgccatcttttatagacaataattttgattaaatgtatgaggattctaatctcatgagatctattttatttcttaagctttagaatgttaaggctttcctgagcacatgctaactatactcaatgtaaatttaaatatttctggaaatgtcaaagctgtatgttcttttacatttcaaatacttgagttgggcttggaaaaagtttaatcaagaaaatggaccagctatttcagatacatttcagatactgtcagctactttatgtcaatgtcttccatgtgtccttgacttcttgccccagagggatatacaactgcttaagagatatctttgaaatggcaaatgataaactctaaagttacttggagtatagacatacttgggtaatttcatctaaagtcattttagttcatcctttgaaaacacaggaacaaaatgaaaattatattatgaaactattaaattgcttgctatactaagtgtgtatgtgtgtgtgggggggcaacctagtgggacccccatctttacaaaaaaataaaaactgaaaaacttagctgagcatggtggcacgtacctgtggtcccagctactcaggaggctgaggtgggaggatcacttgagtccccccccccccaaaaaaaaaaaacccaaacccctgatttaaatatatcaccaatttttgaggtaccagcttttctttgttagcataatacctaaaatattttagcatttttgactgactgtgggtagatagattctagtttcagatctaaactccctctttggttgtgttgttcaggcaacaggcttacagacattgccaagtaattgtctctaatttaatgagttaattagttaactgtctcctgtagaagtcaagtactgacttcttatggatgggagaaaacttatgcttttttcctctaagctatacactctatctttcagttaaaattaagttaaaatagagtaggagagctggagaaaacactggcaaaatacctcagggtaagtggttctttggcatcatttataaccccagatactggcaaagcctgtttcagtacatgtcaactaaagcatttgttttctttgttagccgctgtgtcctttgtggtttgtgctaaggctgctctatttcctgatagttttaaagtcaagaatgttgacatcttggcgattccatatatacagtatactttaaaaatttttaaatgttagattcaaaaggcccatgtgcaggtttcttttttttttttttttttttgagacagagtcttgcgctcgcccaggctgtggtgcagtggcgcaatcttggctcactgcaagctccgccgcccgggttaacaccattctcttgcctcagcctcccgagtagcggggactacaggcgcccgccaccacacccagctaattttttgtatttttagtagagacggggtttcaccatgttagccaggatggtctcgatctcctgacctcgtgatccacccgtctccgcctcccaaagtgctgagattacaggtgtgagccaccgcgcccggcccccatgtgcaggtttcttacaaaggtatgttgtgtgatgctgaggtttggacttctgttgatcctgtcatccagatagtgaacatggtaccaaacaggaattttttcaccccttgccctttctctctctccccgctctaatagtccccagtatctattgttcctgtctttatgtccatgtgtacctgtaacaggtagagggtcttgactgcaagttgtacaggttcttggcattttgaacagagttggacaaaacgcccagcaaagcaaggaaagaatgaagcaatgaaagaacgaaagcaggaatttattgaaaatgaaagtacactccacagtgtgggagccaatgagcagcggattaagggcctggatacagaaacttctcgcgtccaaatacttcctagaggttccccattggccacttggtgcttacctcatgtaaatgaagtggtggcccgcaattggtctgattggttgcggaaagcaacctatcagaggctgaagtgaagttataaaggtcacactcccgtacaaacatctgattggttgcggaaagcaaccaatcagaggctaagggaaagttacaacgttgtatttctatgcaaaggaagagtctgcctgcagtcggtctgattgcgaacagccaatttcccatctgccgtggagaaaagggggtttgcgaagggagtagcctcaggtccttttgttacttaggtgtggaaagttagggttttcctttcaatttagttctaggaagttggtgtgaaatggcctccagaccctgttctcctgcctcatacccaatatttaattcccacttttaaaagagaacatgtgatatttgattttctgtttctgcattaattctgcttaggataatggcctccagctgcatccacattgttgcaaaggacatgattccagtcttttttatggctgcatagtattctatgaagtagatgccatacagaacgcttgtattgtgtgtttgtgttttttatttagtggttgtagtcctggaggtcaaattcagatattagagaatagacacctctgtggcaaaaagaacaattgttgccaaattttcttaatacaaaatctctgaaatgttttcatgtgctcccccctcttttatcatctgttaatgaaacaaagaagcaacacaagcagttgtgaagagcgagaacaaagatcaccataatcccatttctagtattttcttttttctttttttaaatttgagatggagttctgctcttgtcacccaggctggagtgcattggtgcaatctcggctcactgcaacctctgcctcccgggttcaagaggttctcttgtctcagcatcccgagtagctgggattacaggcacctgccaccacgcccaactaattattattatttttttgagacagaattttactcttgtttcccaggctggagtgtaatggtgcgatctcggctcaccgcaacctccgcctcccgggttcaagcgactctcctgcctcagccttccgagtagctgggattataggcatgcgccaccacacccgtctaattttgtatttttagtagagatggggtttctccatgttggtcaggctggtctcgaactcccggacctcaggtgatccccctacctcagcctcccaaagtgctgggattacaggcttgagccaccgcgcctggccaggattcgagcatttttatgattatatataatgtatacttgtgtgtatgtacctatatattgctaaatttcttttcaaaaggactgaattcgacaaaagcaagatgtataggacggtataaatagtatgctatcatttatataaaaagaaatggtaagaatttcatatatacacacatatatttggatgtatatatattaacattatatatataatttacttgtttatggataaaacatctctagaaggatacataagaaatcgattgcctctggggtgggtaattgagtgattgggaacagaagtaggaggaagactttccactgtatattctttggtaccttctgaattttgaatggtatgaatgtaatactattaaaataataaaaaaccattagcaataggtaaaagtacccactgtcttctttttcatgcccactgtgttggttcaggcctcaagctgtttcacctgtatcttttatttatttatttttttgagatggagtcttgctctgtcgcacaggctggagtgcagtggtgctatcttgggtcactgcaacctccgcctcccaggttcaagcaattctcttgcctcagcctcaccagtagttgggtctacaggtgcgtgccaccacacctagctaattttttgtatttttagtagagatggggtttcaccgtgttagccaggatggcctcgatctcctgacctcgtgatctgcctgcctcagcctcccaaagtgctgggattacaggtgtgagccactgcatccggccctcccctgtatctttgtaatagccacttaccagtctccctgttcgaagttagttcttctctccttcactcaccttttatgttgccatcaaggatagcacagatcaggtatgtctctcctttcttcttaaacttttagtagtatcccacagctcgcagaataaagttcagactcttctgtttagcattcaaagtcttctaccatttggtttcaaactgccttttctactacatgtattagtatacgctctctttattaccatttctctctccaactaagccttctcccagaaaagaaaaaaaaagggggggtattttttgtttcaactttgttcacattagatttttgtgtttttgttttgttttgtttttgtttttagcttgaaatacccattctctccacttgcaattgaaattggatttaacttttaaggtccattccaagtgttgcctttctccctccattccctggccccatcccaccagtcctaagaatgaatcactcctttttggttcccatagtatatttctcataccattgtttgcaacccatattctagttactggtggatggaactggtaacaggaactagtaattgactagtaactaacttgtcagtctccttacattctgtttttagacttccttgtatccatccttctttccagttgcagcggtcttcctcatattgtgcctttcctcactcctgcctattcttaactctagtggttttgtgatcttggtggaacatgtccaattatctcgtacatattaagaataaggaagaaaagcaattgacaggaattgatggaatctacttactattagtgtaaataccttacagtttgctttttctttatcctatgtttatatacttattgttttgaaacttattgttttctttatcctgtgtttatatatttattgttttgaaatttcaaagattattttgtcttcattgtgtaagtgtgtgaaatatctagaggcctgggaggacaataaacttgtctagggactcacaaagggttagtggtagagccaaggtttaaacccaaaaccccttcaagaatggcttttatagtcatgtatagagaacatgactttattttggggtgatatttcttgaatgcttttggtagcaccaattagttaaaaaaaaagtccatattgggctacgtctttttatttttgttctatagcacaagtcatcaagcaacccctgggctactttttttttttttttttttttgagacagggtcttgctctgtctcccaagctggagtgcagtggtgcaatcttggctcattgcaacctccgcctcccaggttcaagtgattctcccacctctcaaatgctttgaatgctaaacagaagagtctgaactttattctgcaagccatggaacaatactaaaagttttagaagaaaggagagacataatctgatctgtgctattcctgatggcaacatggaaggtgagtggaggagagaggaactaacttgggacagggaaactaggaagtcgctattacaaagatacaggtgagggcccggcacggtggctcacacctgtaatcccggcactttgggaggccgaggcaggtggatcacgaggtcaggagatcaagaccatcctggcctaacacggtgaaacccgtctctactaaaaatacaaattcaagtgattctcccattcctctcagtctcccaggtagatgtgactaaaggcgcatgccaccatgcttggataatttttgtatttttagtagagatggcatttcaccatgttgttcaggctggcctcgaactcttgacttcaagtgatctggccgccttggcatcccaaagtgttgggattacaggcgtgagccactgcgcccggccactgggttacttcttatgcaggctgatatagcacttgtggtggtagtctctgtggctttttttgtttgttttttgttcttttggacagggtcttgctctgtcactcagactggagtgtggtggcacaatcatggctcactgtagtctcgacctcccaagttccagtgatcctccctcctcagcatcctgcatagctgggagtacaggtgtgcaccaccatgcccagctacttttctaattttttgtagagacctggtctctccatgttgcccaggctggaactcctgagctcaagggatcctcctgccttggcctcccaaagtactgggattacaggtgtgagccactgtgcctggcctaactcttttcttattgaaagaacaggtggctttgtttagtcagatccacaaatggagatgtttgcaacacttgactagaaagcaaaccaacaatcatttgccctgattcttcttccctgtcttgtttcctagaagcaaccacttgtaactcttttagctatttcatttggtatttcccttcacatttctatattgatatttctagacatttttgactttctgtaatagtagctgaggtcttagcttccttgtactacttcctctcacattcctgtcagtatatttataattttatttttttttgaaacagggtcttgctctgttgcccaggctggagtacagtggcatgatcactgctcactgcaacctccacctcctaggctcaagcaatcctcccagctcagcctcctgagtagttaggactataggcacgtgacatcatgcccagctaatttgtgtatttttgtagagatggggttttgccatgttgcccaggctggtcttgaactcctgggctcaagcagttgcccgccttggcctccccaagtgctggaattacaggtgtgagccactgcacctgtcctatttataatttttattaaattaatatttgatgtctatattattatgactataaatactgtttattttgagccaagtcatggattatgatattttctatttttgtacaattaaagtaatttctcatagttaaaaattaccaaacttttgatttgcctagttatttgtgtacctattaccaattcattcatttgccaaatatttactgagtgcctactataagccaggcatcattcttggtgtttgggatatattagtaaacaaattagacaaagattctttcccttgtgacacattctaattgggagatagacaataaacataagaagtagaatataaagtatgttagaaagaggtgctgagggaaaaaaaagcaggactgttgaggagcatgatgcccttaattcatgattctttatatgtgacctggtttttctctctgaaaacttgtagaattttcacttcatttggatgttctgcaatttaacgatgatgggccaggccctagtgtagatgttcgctttaatttttcatgcttgacattttgtgagcccttgtattcttcagttctgatcttactgctttgttggttgactgaagtaacaatcaatctgatgcaactcaaggagaagggctttggttgttcatgtttggtcatcccatagtatataaagcccttaaattaatgagtttctttgatacaggtattattattattttatttaaaaaaattattgatgtaaaaaattactgatgtcaaagaatattttaatttatttcctatttctggctactggaacttggaatgatgagaggtcttgtttgttattcttttctcattcatttcacttctaaggtttggcagattacgtgtctccctggtgctcttgtagacaggaagcctctgggagtcactttcaggtcctggctgccctttcacttttcttagtcttttcatatcttttatcttaccaatatatgtatttttaattgagataaaattcacataatgtaaaattcaccattttaacgtatacaattcagtgttttttaaaaaagtatatttaccatgttgtatgatgttaccactatctaattccagaacattttcatcatccccaaagagaaatctgataaccagtaagcagttaactcccattccccctctcctttcagctcctggcaaccaatattctgctttctgattctatggtcttgcctattgtggacatgccacttaatagtatcacataatatatggcctttagtgtctgtcttctttcacttatcataatgttttcaaggttcctacatgttgtgcatgtattagtactataaaatgtttttaaatcaggctctgaatatttgatttttcggtatccagagaaaaattctgcatttattatctttattttgattttaatactggcctttaatttaccttttcacaaaccatttattggatataaaatgatattggataatttttcagtatgcattatttatttatttttttagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggtaagtatcttcatgcattttctgaaaactaatgttctggaatatattgttaaaaatttaaaaaaccagctgggcacagtggctcatgcctgtaatcccagcgctttggaaggctgaggcgggcggatcacctgaggtcgggagtttgagaccagcctgaccaacatggagaaaccctgtctctactaaaaatacaaaattagctgggcatggtggcccatgcctgtaatccccagctactcgggaggctgagggaggagaatcgcttgaatccgggaggtggaggttgtggtgcgccgagatcgagctgctgcacttcagcctgggcaaccagagcgaaactctgtctcaaaaaaaaaaaaaaaaaaattaaaaaacccacaaacttacctacgggtatctagaattttaatattagtaaacatgtaattagtaattaccaagttgctcattagtaattagaaaatatgtttttaaaataaatatattattattatattttggggatacataaatcattatgaaaaatgtattcaggctgggcgcggtggctcacgcctgtgatcccagcactttgggaggccaagtgggtggatcacgaggtcaggagattgagaccatcccggctaacatggtgaaaccccatctctactaaaaaaaatacaaaaattagccagacacggtgacgggcgcctgtagtcccagctacttgggagcctgagataggagaatgtcatgaacccaggaggcagagcttgcagtgcgccgagattgcgccactgcactctagcctgggcaacagagcgaggctccatctcagaaaaatgtatttaaaaaaaattttgttgtttttaaatcaaggtgtagcactgctgcatcaatattaatccaatgttaaaaaacagaggagctgcaaagagctaaggcaataaatactggcatcctatatttaaagcatcttgtagggtagctctgtgacttacgggttagtgtaatggtcttaaaaaagagattaggcgctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagtgaggagcgtctccgcccggcagccaccccgtccgggagggaggtgggggtcagcccccgccaggccagccgccccgtccgggagggaggtggggggggtcagccccccacccggccagccgccccatccgggaggtgaggggcgcctctgcccggctgcccctactgggaagtgaggagcccctctgcacagccagccgccccgttcgggagggaggtgggggggtcagccccccgcccggccagccgccccgtccgggagggaggtgggggggtcagccccccgcccggccagccgcccggttcgggaggtgaggggcgcctctgcccggccgcccctactgggaagtgaggagcccctctgcccggccagccaccccgtccgggagggaggtggggggtcagccccctgcccggccagccgccccgtccgggaggtgaggggcgcctctgcccggccgcccctactgggaagtgaggagcccctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaattaaaaaaaattttttttttggaaaaataattgaagctttatgttgaaaaatatgaggatgccaggcaagtattccactttataggtcaaattctgagccaataatttttaaaccacactaactggagatccatgttttgttttgttttggtctacattaaaaaaatattttatatatatgtatataatatatatattttttgagatggagccttgctctgttggccaggctggagtacagtggcatgatctcagctcactgcaacctccacctcctgggttcaagtgattctcctgcctcagtctcccaagtagctgggattacagatatgtgccaccacacctggctgatttttgtatttttaggagagacagggtttcaccatgttggccaggctgatctcgaactcctgacctcaagtgatctgcctgcctcggcctcccaaactgctgggattagaggtgtgagctaccatgcccagcctttaaaaattggtatatactagttgtataattaaactatatattttattcaaagtttataaaaatggtgttatttactgcgattatcaaggatacaggcatttctttttttcgaaaaaatatttcacgggaaaagcctcattttatgttgaataatctgagcagaacgagttccaaataaccaagtatatttcttccattcattcaataggtattgagtgcctgctatgcctcaggtactgttcttggtgctggaattattaatatatcagtgaaaaagccacaaaaagataataaaaaagtgaattatggtatgttagaaagctgtaagtactatgatgaaaaataaattaggggagagtttagggagtgatatttattaatttatttctctatttatttggcaaacattaattgaacagccattgtttgtcaggcactgttgggccttacaaatacaaacataaattaaatgaggcttttggccttcaaaagaaggtaatagcttagtgagaaagaaaatgactaaacaaaggaaaaaagtaacacttctgaaatgaggtgctgtcatagctatatgagaggaatagagggaacccaagaaagcatggttaactgttttgggtggtcaggacagcatcacagaagaggtaatgcttgagtgaaatctggcaggatgagtacaagcttgttagtagttggataagtagggacgagaattccaggaaagggaacaggaacggcatgaaacattaaggggcgtgtgtgtgcgtgcgcatgtgctcacattagtgaatggcaatggaggagggttgtgttgcaagtactttgatgtggctgtggcattgctttgttgctgggggagatgtagttggagtggctgaaggcttttgactctgtcttgcaggtatttttagcctggtagtgtatgggtgtgtgaaaagacagaaataacaaggggcatcttgctagagtgtcagtttactcaactcaggggagaaaagcaatcattatttgtattaaaatcatatatggctgtattatggagtgaatgtaatagttgcatgaattagataaagacaattttggcttgttatggcagtttcagtctacatctccaagcctccagggcctaggctctttctcctacctgttgaggtgcttgtgtgacaaactttgagaaactaggcagtaagtagtctaaaaattatttccattaccacagatgtaaacagattttagaaatggtgggttggaatgggacaagactcgcatgcaatagaatcaatttaggtagctattgtaataaagtagaaagattggtgtctaagttctttgagtccaggattagtactgtattcagttttattgtcccatagaaccttgcacagtgtgtgaaatttactatgtgttcaacaaatatttgttttggaaagattttatatcatttataaatggcaggtattgggaaacttgtataccttttaggtctactctctcaaaatatatcaactgataaatcactgtggatcattcactcataggatctttcaataatgattagacaataaagcaaatgaaaattaattatacctatcataagtccttcatcagaattattaaaggtaacatatatatttagctcttttagaaattatcagagtatttattgttagtaatttggtctaagacctgatttcagaatatccatatattttcaaatgtttccttttatgaccatctgctctattctatctcagtagtgtatcttctttgaagcttcatgtggttctcctaggctgagttgcattgttaaagtaggacattttcttttctttttttttttttttgtcggagacggagtctcactctgacacccaggctggagtgcagtggtgtgatctcagctcactgcaaccactgccttccgggttcaagtgattctcctgcctcagcctcccaagtagctaggattataggtgcatgccaccatgcttggctaatttttgtgtttttagtagagatgaggtttcaccatttggccaggcttgttgtctcgaactcctgaccttgtgatctgcccgcctcggtctcccaaagagctgggattgcaggcataagccaccgcacctggcccatttttcttcttataatcatctttttaaaaagatattctctactgggcacagtggctcacacctgtaatctcagcactttgggaggctgaggcgggaggatcgcttgaggccaggagtttgagaccagcttggacaacatggtgaaaccccatctctacacaattaaagaaaaaaattagccagttgtgatggtgtgtgcctatagccttagctacttgggagagtgaggcaggaggattgtttgagcccaagtgtttgtggctgcagtgagctataactgagccactgcactccagcctgaggggcaaaatgtgagattctgtcttaacgaaaaagaaaaaagatattctcttttctccctctttctattttctaccccttaacccagggcagtgatgaaatattagaatagcttacttggtacgttgtttcctgctccaaaatgtgttccttggttctatcatagttttctgatgatgagtcctatagatatgttatgtgaaatagcaacatataatattgcttataaccactcaagaccaagtctgaatgagtggagctagtatagacaagttcaagtgatttggttaagtgtgtgagaaaaattggtctaggagtggttgaaacacgctcttttgtgctctgcaatccttcccccatgttttccgggatgttaactgttcctctctcttgttccccatctcctttcccccagtagatagtaaaataagtaggagtgtttggatatgggtgcttgctgtagaaagccatgtaacatacaaaacagcattatatattataaatagcacaatcagttgtctaaaagtaaaagccattagccaagtattatttgtgggattgtggcttaaactttgaagttctggtgtataatgaaaagcaaaatgattttatgcatttaatgcagatctcagagactataattgtgtgatctaatctaaaatatttagactgttgcttacttgaaattgtaacttctagaaccatagtttctatatttagtcctagtcagaattttatctggaggttctgttctcctgtgatgtagaaaactggtgttcttttcttctactttttccccaagtgttttcctttatgttacacaggcatatagaggaaccttttatgcagaaatcttgattgttttacaaattataaaattaacattaatattttgtcattttattagttcctatttactaaattaaaaaggggcttcgtagaaaatttttaaaaaacacaccaaattcagaaaatatatttttcaaagttataaaatgaatacatgttctttctaaaaagtcagacaatggggtaatacggtaaagagtgaaagtacctccttatccccattacaaggaaaactaatagagtgtgaactaatcagtagtttcttcactcaacagttagtagcttgtggtttgcatatattctattaaagtcttgattgggcccttctagcaataaaggaatccatggcaggataaaaggaaaaggagccttaaaaatattctggagccaggcatggtggttcacacctatgatcccagcactttgggaggccaaggcaggaggatctcctgaggctaggagttcaaaaccaaccggggtaacatagcaaaaccccgtctatacaaaaacatttaaaaattaaccgagcatcctggtgcttgtctgtagtcccagctactcaggaggctgagacaggaggatcacttgaacccaggagttctaggttacagtgagctctgattgcaccattgctctccagctgggagacagattgagaccttgtttcttaaaataaataaataaataaaattctggaacatgcttgctttatgttagcattgcagactatttcttgctttcagaaaaatattgttgcattataatgcagtaagtatataatgactgtgggcttaaaatagaggagagtatcagagagactgtcaagtggcctatttttctctcattcctcccaacattttattatgaaaattttcaaacattcaagaaagttgaaagaattttatagtgaacacccatatatctaccacctagactaccacagagattatattattattattattttattatttatttttatttttattattattatttttgagacagggtcccactctgttgcccaggctggaatgcagtggtgtgatcatggcttactgcagcctcgacttcctgagctcaaatgatcctccctacgtcagcctcccaaatagttgggaccacaggcgcctgcctcatgcacagctaatttttatttattttggtattttttgtagagatagggtctttctatgttgcttaggctggtcttgaacttttgggcttaagcaatcctccccctttggccttcccaagtgctgggattacaggcgtgagccactgtacctggccagattctactattaacatctgactattcttgctttttcatatatccatccatccctctatccttccatcaatccatcttttttttaatacatttcagagtaaagtgcagccattgatatagttcttaaatattttagcatgcacattatttactagtgttttttgttttgagggttttttgttgttgttgtttgttgtgagacagagtgtgtctctgttactcaggctggagtgcagtggcccgatctcggctcactgcaacctctacctcgcgggttcaagcaattctcatacttcagccacccaaatagctgggattacaggcatgtgccactatgccaggctaattttttttgtatttttagtagagatggggtttcaccatgttggccaggctggtctcaaactcctgacctcaagtgatccactgacctcaagtgatccacccgcctcagcctcccgaagtgctgggattacaggtgtgagtgaccatgcccagcctttgagtgtttttctttaaatgtaggactcgcacatagtaagaaaacgtaaatctcaaaagtgtatttgctgagctttgacaaatgtatgcacctaggtaacctcaagtgactttttttatcgtgttaaaatatacataatataacatttaccattttaatcatttttaagtggacagttcagtggctttaagtgcattcacattgttaggcaaccattatcatatccaaggccaggcgcagtggctcatggctgtaatccgagcactttgggaggcctaggtgggcggatcacctgaggttaggagttcaaaatcagccatggctaacatggtggaaccccgtttttactaaaaatacaaaaattagcctggtgtggtggcacgcacctgtaatcccagctactcaggaggctgaagcaggagaattgcttgaatccaggaggtggaggcggaggttgcagtgggccgagatcatgccattgcactccagctggggcaacaagagcaaaactccgtctcaaaaaaaaaaaattgttgtatccatttgcagaacgtttttatcattccatactgaaaccccataccaattacataatgactccccattctctttccttccactccaaccagcccctgataaccagtactccacttattgctactattttagctatctcacataggtggaacaatataatatttgtccttttgtgtctgccttatttcatttagcataatgttttcaaggcacatctatattacagcatatgtcagaatttcattcctttttaaggctgaataatgtactcagttgatttattttttagagatagagtctcactctgtcacccaggctgaaatgcagtggcacaatcacagctcattgcagcctcgaacttgtgggctcaagcgatcctcttgccctggcctcctgagtagctaggactacaggcatgtgtcaccataacaggctgatttttgactaatttttaagttgttggtgcttttgtgtattttcatgatacatctgaatatatatctcgtgatatatctgaatatatctgaaggtaactgagtattgagggatggctgagtattaccccaatagcttcttataatagtggtctacttactaatgccagatactctttctggttttcaactatagctttaaaattgggaaagggttaggagatatacagtaatggaagaacaccaaattgaaggcaggagttaggagtctttaagtagactcactgatttgctgaatgtctttgaggaagatcacttaacgtttgcctttctaagggtccttctggctccaaagttgcatgaatatatgatttgtctttttgaatatgctgacagacaaaatgtagatatttagtaaattccatagactttctattttaaacaaagggctacttaattggaaacctatgtgacaagagtctcaaatccacaaggacagtgtggtctgtagatagataactgatgagccctgtttggttgcttttctgaaggagaaagactgcttgtcttcaaggggctggtgctacttgggaccggaaacctagtgttgttcacacttgcagtttatcaaaataaaccagaaaaactgagtatttatgggaaatcttgtcatttcttaatgtcaactaatgcaactaaaaaacagtactttgcatgccaaagaaaacacatctttggaccaaattcagtctgccagctgatagtttgtgacctttgctagttaaggaagaagtttttggcctcttctcataaatatagaaggttttactactgagcatgaaatttgttttaaagctacgtattctgtatttcagggtaggtgtattttttatgtcttgatgctgttttgtagaaaccaatatgttatgcctttttaaagaaaacccataatcagcctatttttatttttaaaattattggtcagtctgtttttttcttcctcaaacagaaattgcatgaaaaatacactatagaaaatccttgtatcaattaacacattttgaaatatatagagtaattaacattggacaatcaaggaaagattagtttcctaggaaaatacttcattgaagaccagtctgcagatctgtatgcatatgagacacatttttataatgctgttacttggacactcattactaatgagcagcaagatggtatggaatctttgtagcaagcttgctatgaaagatctagtatatgctggctttgtaaggtcactgaaggcaatttctgtgtagttttgaccactggttaattttataaccttgagtataataggactcattaagttctagaaacccaacatatgagtttcccccactttttgttaagttttgttttgttttgttttgaaatgggtctcacttgggtctcactctgttacccaggctggagtgcagtggctattcacaggcaccagcattgcatactacagccttgaactcctgggctcaagtgatcctcatgcctcatccttttgagtagctgggactacaggttcatgacattgcacctggctcccaccttttttgttttgatttttccttttaacatttttatttaaaaaaaatttttttttaaacagggtctggctctgttacccaggctggagtacagtggcacaatcttggctcactgcaacctctgcctcctgggcttaaactgtcctcccacttcagcctcccaagtagttggtactacaggtacacaccaccacacctggctaatttttgtattttttgtagagatggggtttcaccatattgcctaagctgctcttgaactcctgagctcaagtgatctgcctgcctcagcctcccaaagtgctggcattacaggcgtgagctactgtgccctgcctctaaaagttttattttaatttaattatttattgagacagagtctggtctgtcgcccaggctggagtgcggtagcatgatcatggcttattacagcctctacttcctgggctcaagcaatcctcccacctcagcctcctgagttgttgggattacaggtgtgtgccaccatgcccagctaattttttatttttactttttgtagaggtggagtctccctatgttgcccaggttggtcttaaactcctggactcaagcaatcctcctgcctcagcctcccaaagtgctgggattacagatgtgagccactgtgcctggccaaaatttttattagtgatgtttcaaacatgtataacacagagaataatgtaaattctatgaattcatcacctacttttaatcattaccaaaataattatttcgtttatacctccatctcttctccatcctctggattattttgaagcaaactctagatgatgtatttcatttgtaagtgtctcactgtgtatctctaaaagataatgcttaacaacaaccaaaaaaacctcctagaaacattgatttcttaatatcatcaagcatttgtattatattggtatttccatttcccggattatcttgtaaattaaaaaactttttttttttactttgtttaaattggaatccaaataaggatgtatattgtgattcattgttatatctcttaggtcttttaagattgagattccctgtgcttgcctcagcagcacatataataaaattggaatgatacagagattagcatggccccttaaaaaaaagaagaatcctcttcatagcttcattaaaaattatttttctgcagctatggaatgtttcttctgtcatttcctacagtctgcatttatgtggtggtagtgaacatgttcctttgtttgttgtgttttctgtaaattagtgaatagttctagagcagtggttctcaataggggtgattttgctcaccagggtatatttggcaatgtctggagacatttttgctggtcacaacttggggatgctattggcatctagtgggtagaggccagggatgctgctaaacatgctacaaagcacaggaaacccccacaacaaagaattatccaacttaaaatgtcaccagtactgaggttgagaaactgatccagagacttgatcagattcaggtttaattatattttgcctggttctctctcttcatgatgttaggagctattgattattgcccagtttcattgattttctaggggcttacaaaagggtgatattctaattctcctttccttccttatctgaagtacctctataaaaacaaactaccctttatcaattatttggttaccctgagctacagtttatatagtaaaggcagattaaatgcctgatgctttccctttcttcaccagccaatgacgttttatattttattccaggttgatctcctatcaagagtttttggcatttgaatctgttttatgtgctccagattccatgttcatagtggctttccagttgtttgacaagagtggaaatggagaggtgacatttggtaagggaaaaagaagattataagtgataagttaatgatgctggtccagtcttcaattgctgaatctagtaactaatatagattactgcttatttgggatctgacccataattgaatttcctaaaaggatttatgcagataatgatggctttattttttcaaagcattaaactgttgccaaagatgaagaagtgtagtaatgctgttgctttagctcattgagtcactgacactttacattcctaaaataaatggtgtaagattttcttgttctgggccagcctgggcaaaattccttacaaggtcgattttgaacaacatgaaacaattttctcattctttaagtgatttttagatagggagttcagagcttctcttgtagcatccttggaaaattgctactatgtcattgtaacaccaagaatggaaccgaaggaggatatcaaggcaaaattagtgttctctgaacctgaattttagatttcagttttaggaaagaggctagaatattaaaattgccatctgacatgaatgtagaaatttatttaaatcctctagtagacacaaaatctaacacactgttgatgtttcacaggtgtatacactaggatttttatttgtaaccatatattaaagatacttttttacagaaattagtatatgtttagtaaaagtattggctaatttttcttgcaacaattttttcaataaaagccatgtagtagttcaaggaccttgagcactgcccccacctttttaaagattgccactgtttttgttgtggcaaaaaacacaagataaaattactactatcttaatgattttaaatgtacagtttagtagtattaagtatatccacaacgttgtgaaagacatctccagaaatttctcatcttgcaaaattaaacttaagcccccttttatagtgtgaattggcatggatatttgtagaaacacccttgaaaatcaggctttccctgagctatggcattaaacacttattcactattgtgtttgagttataaaatagatgtcctttagttaaacttgaaggaaaaattatcactgcaatggtcaaagtggtgagaaagtacaggtcagtcaatcagaaggatcagtagtgccttggctgtaattttggtggacacattttctagcgtgacattgattgttttcttcttccttctgcccattgactcaactatcttctgtatgagaagactttccaaaaaaatgctatgcagagttttttgttttgtttttttttgagacggagtcttgctctgtcgcccagactggattgtaatggcgtgatcttggctcacggcaacccctgcctcccgggttcaagtgattctcctgcctcagcctcccgaatagctgggattacaggcatgcgccaccatgcccagctaatttttgtattcttagtggagatggggttttaccatgttggccaggctggtctcgaacagttgacctcatgatccgtctgtctcggcctcccaaagtgctgggattacaggcctgagccaccgcgcctggcctgctatgcagagttatttagatttttgcatataaatcttggcatcctcctcctttggagcaagcttcgaccatcttgcctcctgaagaatgttgactttcctcagaaacacctagattctgtagtttaaggcacaaaccctccatcatctcattcagcattaaccatgcactactagtaatgctgcattttctattttcagtaggtatcacacatgctcacatatctcacaaatgtgatgcagaaatgcttggaaaataactggattcagatgtctgagttagtgacagtgccctgtgcttatatcctgtgtgcattaagaattagatctcacaatcaaattctaatttttgtccctctaccttgatatcatggttctttgtgtctcctccatttaattacttttcccagtttcgattattataaaattagtaactcaagccacttcatccaacagactgtcaagaccaacttaacaataagacacatgccattgttgataaatagattaaaatgagtgtaggaagtagctaagtttatatatgccttatttaatgtaaatgaaagcttgtagtcattagatctcaactttagttttttttttttggaggtggagcctcactctgtcacccaggctggagtgcagtggcgtgatcttggctcactgcaacctctgcctcctgggttcaagcgattcttctgcttcagcttcccgagtacctgggattacaggcacctgtcaccacgcctcgctaatttttgtatttttagtagagacggggcttcgcccatgttggtcaggctggccagtctcaaactcctgacctcaggtaatctgcccacctcggcctcccaaagtgctgagattacaggcgtgagccactgcacccagccaactttagctttttataggtcttctgtttttctttcaaactatgatttatgaattagaatttttagaaatatagttaggattaaacacaaaccagttttagtttttacggtaccaggtataaactgaagaacatatgagccctcaagaatcttgctttcattcttttcctccataatctagagacaggaatattattatggaataagaaaaagatgaagccaggtgcagtggcgcatacctgtagtctcaactcccaaaggagtgatttcagctcctcgggaggctgaaatgggaggatctcttgagcccagagtttgaggccagcttgcacaacatagtgatacccagtctctaaaaaatttaaaacattttttaaaagctgtaccctgtttctgttctggattccctggctagctggttggctcttttgatggtgctcacctatttcctaaggactttgaccatttcaccttctgtccctgccttcctagttttaaggatccactttgagacaaattttcttaagtagaatgagagaaatgataaaagaaagtttcctttcatatttttaagagggaaaatattgaaactgttgtagcaaatgccatttaacaagatttctaggcactgcttatttcaagccatattcaagactacagaatttatgcataaggaagtaattaacttcgagtttatttttataggattttggatctggggtaaaggtcagttttcatgtttgtaaccacttaataaaatgaattgtgcttatgtatttataggcacatgtttaggtaaaaggaaattttagatccattctaaatagagttaaatccttttcaccaaatggccttctgttttctagtttggagctatttatagttttctcttgtgcacatgagagaaagttggaagacaatattagctgcaatgtgtaaggaagtggagaaaacctgttatgctatcagcatctcttgtagactatgatgataatgttatctgtgtacttgtatatattctcatttatgctttttttagatatgattttatacacatcaaattatatacttaaactgtgtgcatctttgcaagtatttatataagtagtaatattgaacatttacttgagtgtttatataaggttttttgttgttaaagatacctctgctctggggagaggacttagattgaggccttggaaatccatttcagaacgtgaaaactcaggaaagggttctggagtttttttaagagtgaataaaatattagttaattgtttcctctttgatgtttctttaataaaacttctaatgcatgccgtggataattacttaatggtttgtatatctgttactgtcaggtggcatgagccttgtagaggctattgcatgactggtgtgtgctagctacagtgtaagtttgccttggtctcaccattgtccacaagtgtactggagatcctgttcagtactattagattcaggtaacctagataagcagttatactacattgtgttgtcagtagctgccatgcatttaaaatccaaattgaaaaaaaggccgggagcagtgactcatgtctgtaatcccagcagtttgggaggctgaggtgggcagactgcttgagcccaggagttcaagaccagcacgggtgacatggtgaaaccccatctctactaaaaacacaaaaattagccgggtgtggtggcacatgcctgtagtcccagctactcgggaggctgaggtaggaggattacttgagcctgggaggtggaggttgcaatgagttgagattgtgccattacactctagcctgggtaaccggagtgaaaccctgtctcaaatgaaaaaaaggcctattgccttactaaagatttaatccttttttttttttttttttaaggggccaggcgcagtggctcacgcctgtaatcccagcactttgggaggccaaggcaggaggatcacaaggtcaggagtttgagaccagcctggccaacagggtgaaaccctgtctctactaaaaatacaaaaattagccgggcgtggtgggcacctgtaatcccagttacttgggaggctgaggcaggagaatagtttgaaaccagaaggtggaggttgcagtgagctgagattgcgccactgcactccagcctgggtgaaagagtgcaactccgtctccaaaaaaaaaaacaaacaagaaaaaaccacaacaaactgttgtctgttaactaacaaaatgagtatgaaacatgttatatgttctgagttctctattaacatcaacattgtgttccaaatttggtgtttgcctaggaatggacactcttcaaagtaaacttttccaaggacacatcctcaccctctgactgaagaaacctcaaaaagcagagattcctttaaatgtagtactatgtttgaccattaatacatatagcaaataaaaatgtgttccatttgtgcctctgaaataggctgtttttccctgaaggagagaataaattgggatgggttaggcacaaccactgttattattttaaagagccaggagatggaagtgtagttatgaaaaatgtaccctttctcactggaaacaaagctatagacatgcaataatatgaagttctatggtggccaggtgcagtggctcacgcctgtaatcccagcactttgggaggccgaggcgggaggatcacctgaggtcaggagttcaagaccagcctggctgggccgggtgcagtggctcatgcctgtaatcccagcactttgggaggccgaggcgggtggatcacaagatcaggagtttgagaccagcctggccaatatggaccagcctggccaatatggtgaaaccccatctctactaaaaatacaaacaaattagccgggcatggtggtgcatgcctgtaatcccagctacttgggaggctgaggcagaagaattgcttgaacccaggaggtggaggttgcagtgagccaagatcaggccactgcactgcagcctgggcgacagagcaagactccatctcaaaaaaaaaaaaaaaaaaaaaaaaaacaaagaccagcctggccaacatggtgaaaccctgtctctagcaaaaatacaaaaattagccgggcgtggtggcatgtgcctgtaatctcagctacttgggaggctgaggcaggagaattgcttgaatctgggaggcagaggctatagtgagccaagatcatgccactgcattccagcctgggtgacacagtaagactccatacccccacccccaaaaaaagggaattctatggcggccaggcatggtggctcttgcctataatcccagtactttgggaggccgaggcaggaggatcacttgaggccaagagttcaagaccagcctgggcaacatggtgaaaccctgtctttactaaaaatacaaaaaaattagccagttatggtggtatgcacctgtaatcccagctacttgggaggctgaggtgggataatctcttgaacctgggaggcagaggttgcagtgagccaagatcacgccactgggccgggcacggtggctcacgcctgtaatctcagcactttgggaggccgaggcgggtggatcacgaggtcaggagatcgagaccatcctggctaatacggtgaaaccctgtctctactaaaaatacaaaaaaattagctgggcatggtggcggatgcctgtagtcccagctacttgggaggctcacgaatggcgtgaacccgggaggctgaggtcagtgagctgagattgtgccactgcaccactccagcctgggcaacagagcaaaactccgtctcaaaaaaaaaaaaaaaaaaaagatcacaccactgacttcagcctgcgtgacagacaaagactttcataaaaagaaatgaaaattctatgataataaatatatagcttaatttggtaagaagtagagcttcacctgagtattcaaattaaatcaggaagattttttgatttttttttttcttggtgttgctttcggatattgcagagaagttttttgttttttgcttttttttttagtactcaaggctattagagtagcttaagagttcaaggtgaaagaaaaggtggagtgttattagtttttatgctgtttgatgatagactgttgaagtgtctagcttcaataataatagtatgtatgtatgtatgtatgtatttatttattaattttgagacacggtcttgctgtgtcgcccagggtggagtgcagtggtgtgatctcggctcactgcaacctccacctcctgggttctagtgatccttctgcctcagcttccctagtagctggactacaggcatgtgccaccacgcccaactaattttttctatttttagtagagacagggttttaccatgttggccaggctggtctcaaacttctaacctcaggtgatccacctgccttggcctcccaaagtgctgggattataggcgtgagccaccacgcccaaccgatagtctttaaatatgaactcatctttcctgagaaatggacctttacatatatttgacagcaggactactctattgactgtgcagtagtcccttctagaggtaggtaaagggctaatagaaatactttctctcagagaaacaggaggtcattcaggaaactaatgaccatctgagaggagaacccagaagtctgggactgagtctacatgccatgttggttgggacttcctctacaagttcctgttgttggtctttttgttgttgttgtttgttttcctttgttttcttttttggcttcccagttgttcctcctctttcctcccaatttttccttcactgaaaaactcttcacttctacaagtctcaccattgtttttgttcagctatgtacaaggatattcaccattcatggtgggagtcctaaaaacctctctgacttcactttaagaactgtgcaggtgaaattcagctactgaggaacttttccccctgacaataagaatgtttggtctcaagcctataagttggttgtagtggctcctgctgggctggaatccttggaataaggatgtcgttgggctgatggtaggtgggctgtgtcacagggctgatggcttgtatacctacaggaggagttctctggccacaccgttggtacagcagctccttccaggctcattcatggaacaggcatggtggcagtcttggagaagagtgccagccccggtcagaggtaattttgtactgcagaaaggtgaacaagaccagtaggaagtgcccataagaaccaggggagggatgagggtggatgagatggggagacacagtatgggtttctggggaaattaaaacctctgttaagacatatttacataatatatatgatttaatgtgtatttcatctagtccaatcatcataagtgactgatacagctaaactgactaatgttacacatctgtgaacatttttacttaatcacagttgtcaccgttacctgctctcctgacaaatcattgtgctcctctcctttgagcaaagagaacataatgacaggctacttttgtatttagccccagttcccttttcaatggaagtataaaccatccctttcataagcccatgctctgcaggaagtgaaaaagttgtcttttgttttctatatgtcagaaaactaatggattcctggttctcttagctatgccaacctagtataaaatactatatcgtgattttgctgccaataagatgtgactgtcatttccctttcttccaggccagaactatgctacagaaatagcattcttaaacatggcaaaaaaaagatccttgtttgccactggaaagatgggattctctctgggggtgggtggaacttgctatacagtttcagttagatgtatttggtatatttgagactattggtgttccctttcatgtcacgcaggacctgataaagctgggtaacataaaaacaccagctgtttgagttattacctcatacaagcataagctctccagttctggagcttttatataattttatttatcacattctgataaaagtaaagtggcaatttatgaattggacttgaaaacaatagttctactaattatttctgtgtatctgaatcagtctcaggcacttggtagtagaaacaatgataacagaagagaagtagaatacatctccagaagtgccaaagtaggtttgtaatcttattagttctagtaattatagtagtccatgatgtgtcttaaaaaaaccctaaaagtgtcagagtaaataaaccacagcatataataatgatcataacaaaaccatatataaagctgtcaagtgaccactttgggagaagtagaaaatgtccaaatactcatggaaaatgacacttctgtatttggggagatcactatgactaatttagaccatcattttaattgtttcagagacattctaagatcttatttagagatggctaagaagtttatgaaataggatatctaaagtttttattacagagatattttccagatgtaaattatacattataaatttagttcataaatatcctttttgtgataatagaaacttttttttcgagacagagccttgctctgtcacccaggctggagtgcagtggcgcaatcttggctcactgcaacctccgcctcccgagttcaagcaattctcctgcctcagcctcctgagtagatgggattacaggcatgtgccaccatgcctggcttatttttgtatttttagtagagacggagtttcactatggggaccaggttggtctctgactcctgacctcgtgatctgcctgccttggcctcccaaagtgctaggattacaggtgtgagccactgtgcccagccaaaaaaatttttatagataattgaattttcttagcttgaacgcttttgcattttggactttattttacatagtttcatatttgagattctgatattttcttattatataaaagggattcaatttcattctaccattatataagaattatctaggtagtaatatatacatttattatcaaataattatattttaactcttgaaataacctttaaaaggttaccatgaaataactattccctttaataattgtaatgttacttaattaaatatagtaatttgttctaatttgctttccatttttaattttttttaacttgaagatgaaacacttctttttgttagaccttaaaagtaagaaattaattaatttgggactagaaacagctaattaattaagttagatcctaaaaatctttaataatctgctacaatatttgtagccctaaatattttctgctatctttattattttaattgttttgtaaactttaacatattttacaacttcgaagtttcacatagatttaaggatcatcttttgtgttggttagaaaccaggatcccacaaattgctattgggttaattctttgctttttaaatttgtatttatgtaaggtgaaaacgcttgacctattgaaaactttgaagtatttgtccctacttagggaagaaatgaatcctgcattccatttcaaagaaaagatgagaatcccatctccccagtgacatccaatgccttcttccaactttgctgattgctgcaatctattcagagctattatattgactctagactggtagaacgtccagttcagaattcttacattcccctatcccagtagtaatgcttttattaagaaaaagtgtatgtatataaaactaaagggaatccattaaaccatttacaatatgagatcagtatcttatttaaagaatttgcagaaattagagaaaacagcatagttggagattataaaactttaaatgtgtatttactaattctctagtataactgatagctatcgatggcaaaactctttcactaataaaattggctgaaatttgaaaataattttgttcttaagacatcagttaaacaggcttcctgctttcttaactttgttcatgattttttttttttggcatgagcttctaaattagtttatccagtctatgcttgttaaagtaccagtcatttgtgaattgacttttatagtaagtatagaactctgtaagaatgtaaataacgttgttagtgcatgaagacaagctgccagagggttttggttgtatgttacacagtgtgactagttcctatctaaaaattagtgtactgtatttagctctttatttaaaagtgaaacactaatttaacttatcttaaaatattttaatagttcagactaataatcatggattttatggggattttgaagctttgtgtcaagaccatatttttaacaatatcagaagcttttaataaggtgcttgctgctgagctaatgatatgcttttgatagtttttcttatacctatcttcaatagacatattcaggctagtgtgaatgtaataatcaagcctcaatcaaaccatacttagtatgacaaatattgcattatactgtaatttaggtattcatgcttctgataaagggtttaattcgactccttgagaaactgggaaaacactattgattttatacgggatgtaaaatagcagccatttatgatgtaagatagaaatcactttctaattaaaattaaataaagagaaattaagaatctcatggccttatatgcaatggtacatattcttaagtgtaaaattatattttttgtatcagttgtgttcctgcgcatggtttctgggcacacaaaaaaattgcagttattttaatagaagcagatgatattgacttttaaaacttctcttaatttttttctgtaggaacattgcagtggtttaaactacttattccagatataattgatttatttttgttttcccttttaagaaaatgtcaaagaaatttttggacagactattattcatcatcatatcccttttaactgggattgtgaatttatccgactgcattttgggcataaccggaagaagcatcttaactacacagaattcacgcagtttctccaggtgagcttagttttcataacaggtatcaatatatactattcttctgtgtccttcgctttgtatttattaagtttattacaaaaatagaagttctccatggtatttcactcctattttttaaatttccccctcgccagagacaacttctttaaactcttaatagctgtttctttcagtgtttacttccatttatttaaatagtaaagcacttctactttttttctacttttaaatactttttaattgtatcctaactatagaagattagaagctagttctttcacgactgggcgcagtggctcacgcctgtaatcccagcactttgggaggccgaggcgggcagatcacgaggtcaggagatccagaccatcctggctaacatggtgaaaccccatctctactaaaattagccgggtgtggtggcgggcgcctgtagtcctagctacttgggaggctgaggcaggagaatggtgtgaacctgggaggcggagcttgcagtgagctgggatcacaccactgcactccagccttggcgacagagtgagactccatctcaaaaaaaaaaaaaaaaaagctagttctttcacctctctcctctccctctttatcacagacttggacttctgtcccctttcccccaatataattatgtcatgattctgcttagatcagtaatcctatgagttattataattttgtaaatactattggtggctgaagttattatatatttttttgagacagagtctggctctgttgctcaggctggagtgcagtggtgtgatcctggctcactgtaacctccacctcttggttcaagcaattctcatgtctcagccactcaactagctgggattacaggagtgtgccaccacacctggctaatttttgtattcttagtagaggtggggttttgccatgttggccaggctggtctgaactcctggcctcaagtgatctgcctgccttgaccacccaaagtgctgggattacaggagtgaaccactgcacctggcctaaagttattgttcttagagtttctagttttcatttgtttagttttctgtgtactaatactaagtcattctcaaaccttggcccaattattaagatctctttttaatgcgtttaaaacacattaggtattctattaatttcatcttcttggagctctccaggagctttcttttttaaaaaaatttgaggtaaaatttacataaaattaatcatttaaaagtgcacaatttaggccaggtgtggtagctcacgcctgtaatcccagcactttgggaggctgaggtgggcagatcacttgagatcaggactttaagaccagcctggccaacatggcgaaaccttgtctccactaaaaatacaaaaattagccaggcgaggtggtgagtgccataatcccagctactggagaggctgaggcaggagaatcacttgaacccaggaggtggaggttgcagtgagctgagattgcatcgctgcactccagcctgggtgacagagcgagactccatctaaaaaattaaaaataaataaaagtgcacaattgagtggcatttagtacgttcacagtgtcttatatctagttccaaaacatttttatcatcccaaaaagaaaccgtgttccattaagcagtcactttctatttctgctttcccctgagctctggcaacttccagcctactttctgtctctatggatttacctattatggatatttaatataaatggaattgtacaatatgaacttttcttttttttgagacagaatttcgctcttgttatccaggctggtgtgcaatggcgtgatctcagctcactgcaacctccacctcctggattcaagcgattctcctgcctcagcctcctgagtagctgggattacaggtgtgcgccactatgcctggctaattttttgtatttttagtagagacagggtttcaccatgttggccaggctagtctcgaactcctgacctcaggtgatccacccacctcagcatcccaaagtgctggcattataggtgtgagccaccacgcctggccaaacaatatgaacttttgcatctgtttttttttttttccacttagcataatgtttttaagaattatccatgtcatagcatgtatcagtgctttattccttttttgtggctgaatactattccattgtataatatagtataaatatgttatattttgtctatccattcatcagctgatggacctttgagttgttcccaccttatggttattgtgaatagtgctgctatgaacatatgtatacaaatatttgtttgaatacctgttttcagttcttttggctatatacataggagtgtaatttctgggtcatatggtaattctgtttaactttttgagaaaccacctgactgttttccacagcagctgcaccattttcctgttgtttcctcacctgcttcagggccagaagccagactgtgtaagctcactgcataggagtcattctgtgatcacccttcacttttaccttggagaatccatttgctgttctgttacgttgaacctcctgtttgctgcattttatctcttcttttattgcggtttacctatttttggtagaatacttcctgcaatggcttcttgaggaaagtggaataaaatttttttgagacttttcatatgtaaaaacctcttgttccggctgagggcagtggctcacacctgtaatcctagcactttgggaggccaaggtggggagatcacttgagtccaggagttcgagaccagcctgggcaacatggcaaaatgccatctttacaaaaaatacaaaaactagccaggtgtggtggcacacgactatagtcccagctactcaggaggtgaggtgggagaatcacttgagcccagggaggtagaagctgcagtaaaccatgatcccaccactgcactccagcgtgggtgaccgagtgagccctgtctcaaaaaacaaacagtctgggtgttttggctcacgcctgtaatcccagcactttggggggccaaggcgggctgatcacttgaggtcaggagttcaagatcagcctggccaacatggtgaaaccctgtctctactaaaagtgcaaaaattagccaggtgtggtggcaggcacctgtaatcccagctacttgggaggctgaggcaggagaatctcttgagcctgggaggcagaagttgcagtaagccaaggacaggccactgcactccagcctgggcgacagagcgagactccatctcaaaacaaactaacaaacaaacaaacaaatccctcttgttccaccattatgctaagatagtttggctggttattgaattctagtaggagtttattttccttataattttgaaagcattgctcttttgttttctagtttccagtgttgccacagtgccattctcattcttaatttaatcttgaaactttttccactctgactcgggagtgttttaatattttttcttttctttggtgtttatgaaatttcacgatggtattccttggtgtgagtttatttttattcattggtctgggctcttcattcattgggcttttctaatctggaaacttacgtccttcaattcttgaaaattttattacttttcttattctattttcttagtttctaggactattaaatgttacatttatgaccttttagtcttcttttctctcctattttccttctgagccttctattttctatttctgctgtatttctaattttcaggaactctttttggttttctgaatattccttttaaaaaatagcatactgttcttgtttcatggatgcactcttttctttcacttcttcaaagatattgaagacaggtttctttgttgtttttttaaagttttcttcttgcatagtgtctgctttctccacatttatttatttatttttactctttgtttgggtctctgtttttctttttctcttttttttttgagtcagggtcttaccttgtcccccaggctggagtgcagtgacaggatcatggctcactgtagccttgacttccccaggttccagggatcctttcacctcggcctcctgaatagctggtactacaggcgtgtgccaccatgcctgcctaattttttgtattttttgtagagatggggttttgccatgttgcctaggctaggtcttttatttcggattagggaatcagggaaaaattgtctagtctccaatctggaatattagatctggcttttgatgttttggttgctgagtaataagtagttggaggtctcagtgttcaattttgcagaaggactttcagtttactaccttttttcactgtagtattctccctctcaactgtgtgtggtctatgctggttcagagatcctctgttaaactcctcagacagtagacctctagtcttctgccaaggttgggaaagggtggaggccttatttggagtaaggcaggggtaactaactgcttcttaaacagatatccagctaagccccttgttttcagctccaccttcaccatcacttccagaggtaccaatgcagctaacaattgaatcttttgggggtcctgtcatgtacattggcttcctttttggctttttctgcttagtttttttgagtccattaagtcagttgtcatttgcttttctgctttctgatcttaaaaatatagttgccatcttctccttttctgttgtctttgtccttgcgtttctgttttgttttgttttgttcttttattgttattttagtggagagtggcattttggaagacggtggagttaaatgtacaagttcactctcatccagtcacactgtttctgaagctctgctaattttcatctcataattagatgaaatgcattttcaagggcataggatctttcccttcagcataactgcctttctttatctttcctttagttctcctatccacctacctacctacctacctttttaacccaagatttatttattttaccttttataagcccacagtattgtttttcttcattaggatgagcacagatttgaaactatgggctttaggtgtgggtatttggaggtgccagtgtttgttctaactcttttccctgttagtgcttatctaactcaccttataaaattctcaaacttgaaaagttgaaaatatatgcatttgagagctgacttttttaaaaaaggaaatgtctgcctgattagtgtttaagattcttccaaagattactttctctctttctctcactgttttccttgcatttacagagtctattttacaatatctattgtaccctgatgttttaattatactgtataaactgagagccgcatatatgtaacttctttttttctgtgtttaacttctcatttttaagtcattaattttattttttaaaatcttttttattttggaagacttcaaatatactcaaaagtagagagaatagtgtaatgaacctcctggacctataaccagcttcaataattaccacttcttggccaatcttttttatctataccctccaccctgcctcctgcaggatcatttggaagccagatgcacatactctatgattttttcatctgtgatccttcaaatacgtatctttaaaagacaaataagagtcctttaactgttgaccttatagaaaacagacaatctattctactaacactactccttcagtgagcattctgcttcatcttgaaggtaaaggtccacatcttctttagtactgagtgttattaataaggctaaattgtacccatggctaccatttgatatttctgggtgattaagacatatagggaagacaaagacataagaaagagatagaaaagaggtagaaggaaagaaaaagatataagacagggagtgaacctgtgtctacttttgatgctatttaggaatatctttgccatggggaccaatttcaaatccatgtaatgatgtagatggattgaaaattcccacttcatttgaagggtgaagtggttggagctgaggtcatgggaaaatggagtgagttatcacaagtccataggaaaatataattaaataaaaatgatgagacttctataaaaactacttttaatgtcatgaaaagttaaagcaacattaatttgtagtctttgataagtaaatgtgaatgaaaattatgtaatctttaaataatatgtatatacttagatatgactattatttacagagttgcaaagagtgtgacggtggcatccaatagcagcaccattgttatgtttgctaacaggttttttgcatttagtcatggatccccacaacagaaatgctctgattttgacttttgtatagtacacaggggattgctggaacattttgttgtttttgtggatatcacttattacaaagtttggttgcccaatagttcaaaagttcagagatattctggactgtcttacagtttatgagtaacggtgcccagagccagtgatagctgaacactacttttgcagtttgttattcctgactttcattttagaatgactgaatattgcacttaccagttggtagagtttctcactgagtttatttgaaaaatttgtttgaaaaaatggtctctaattcatttatagaatgacagagagagagactttgattgcaacatttaaaattgaaaaactgaaaatgaatctaaactcttaattcatgaagtactctttgatgacaggtaagccttcaagcaggagagataaattactgtatattttaaaggctgaaatgaagcaccaaaaacattattctctgttttcagtaatgaaaacttgtcaagtaaaatctaagggttattttttcctacctttcctttattgatgtgctctcattcattctttttcctgaggagtaatatgtagtacatttttaagaaagctcatgctttttgaaagaaattaaaagttttgttgcaaattcagatctgtgcattgtttgttttgtagtaagtacatgtgtgggaaggatatctgtccttccttcctttccaaaccatgtacttggaatgtgtttaaccagcttaatgccctatttctaatttcctcacaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagtaagtaaaaagcaagttctttaactttctatttcctcaaaccttttgatccattgagtcctggattgcctccagggactcatatgactctcaactattcaaatttcatgcttggttggtagaaagtaaacaggtttgtgtgtgtgtgtgtgtgtgtgtgcatgtgtgtgtgtgtacgtgaatgtatgtatgtgtgtgtgtaatggaggtagaggtgatggtgagttatcttttcccggatcatagttttattcagagccaccatcttgctgtcatctatttccaaattgtttatttccatttacagagtccagttcaagggaaacaagagtttatagacaagggtgagcaattactttttccagtgggcagtaactctcccagacactactgccttcatcttggcctctttccacaccaccgggctcccaaggtcttgctataaagatggctccttcctttgttgccttcagggtgctgtctgccggagggatcatcactggcttctgcagtgttttaataaccatgcccatggcagaaggtatggaggaaatatgtggccatcagcctctgtggctcactcctctctctgccccttcacctgtacattcagtctgtatgcaccagacatagttttttgttctgtcaaactgctaatctctataaagtaatcatctggaccaatagcaaactcatgtcatccacttcctcacatagagtggtgaaactttcctcacttacccgttttcttgtctatgcgttgtacttatgtataagtttttgattactgcttgttttgaatggagggaagccaatgagtgcctttgttgtttcagctgaagatcattatccctgatttagactggggtagaaagatcaacttctgttctttttcttcagtgaatctgaacatggaccatgtcactttctcctacacgtttcacctccttgacaccatcccccactcccctgccctcacctcataccccaaccaaaaaaatgaaagaaggaaggaaagaaagggataaagggagagagaaagagagaaagggagggaaggagagagaagggaagagaaccctagagggaggggctcagtaccttagtgggaagggactcatttaatcttttccaactaggttagatagacctactataatagcctcaattttttgaggctcaattttttatagtttaccaaaagtcaattctaatcctcagaggagtatatgaaaatttgagtccagctttttgggttgctggtatccaaattcaggctaacacaaatataaactgtatttaggttaaggcatgtgtgtgaggggtggtggggtgggatatatttgctcatcattacctacactatttgtaatagacctttatgattaaaattgttacattgatatttacataagcatttctttgcatttttaaaggagaatgttttcaatcatatgggttcctctgacttctggcttggaaatgaggcttttgcaaactatgcaaaatattctcttttgagtttatgtccaagtggtgagcagagaacaaattacgtcttcatcctgcagaggtaatgaaggccacgttgcccgccatctcaggcatgagggagcctcttttgcactattccattgaagacataactcaatagtgaataaattctctccagattttctacattttttggagtttttgataattgtacccttcatgatccgaatttagagtttagcacagactgttaagtattttaattataacagtggccttaaaaattaggaaaagttgatgtaataaaattgtcttaaaatttaaagtcatcagttggtttttgtgtatgtgtgtgaaggaaaaaaacaaggttaaaaagtgttccatagattgtacagtgattttgtttatccaggactagcaagagtttcacagttgagggtcttgaagatcctgtttaaataactattgttttgatctgtgataattatatttgttgtttttgaccttataggtagatgaaccatgaagtccaacttccagatgttactttcttccttaaaacctaaattacatagacttccctgagggcatgcagtgcactgtttcagtgtgatactttccttgtatttatgtactggttgttaacatcattttaacagtgaagactcctttggatcctctttgagaaaagtacagtgtccataaacgtgtttttgtttttgtttgttttttaaactttttgtgttgtcattttctaggcagctggaggaagtatctcacaccaggttagcttctcctacttcaatgcatttaactcgttactgaataacatggagcttgttcgtaagatatatagcactctagctggcacaaggaaagatgttgaagtcacaaagggtaagattttaaaatatacataaataagaatctcagcattttcacttttcttcactgaggcatgatgttgatctaagcttaccactctaaagccagatctagaaagtatgttaccatgtgtatgtatgctttacttgggctccaaaaatccaggtggatttaatgtgatactgaggtcaggaatggaaaagtggctttgacagttttgaaaagaaccttgacccaatctgtcaaacaggtcagtggcagtgtggcagcagcttgtttgtactaggaaggagttgccacagaaagatgagcaagcctactccttttggtgagtggtattaggatgttttgaatgactggagaacacccactttttttgtattataactctggagaacaaagtgaataagcaagataagaggagattctaaagagattgttttattcttgaagttaattcatctgttttgctgttttatcatcttaacattttatcttttaccagccttcagaaatgcatattcttgtatagttgaacttaaatatttaaattcaattttagattttaaaaatgatactaaaatgcctatagctttcaggttatattatagttggtgaaggtagaactttgttatatattaagaatcattcaagattttaactttttttttctctgttccagaggaatttgcccagagtgccatacgctatggacaagtcacaccactagaaattgatattctatatcagcttgcagacttatataatgcttcagggtaagtatttcaataattcttcatgatatttattatagagtagttctaaaatgtgaagcagtggtgtccttttagttcattctaacatgagttttttccatgtatttgaatagtttatattcagaatataaattccaagaaagacaagcagatgtaacaaaggagaggaaagaaacacaggaagacagacagagggagaagaagatggagggaggggaaaggagagaacaagggagagaagaaagaaagggaaggaaaggggagggaagagaaggcgggagtgaggtgagataggaataaggggttgagatgcatgagagagtgaaatgggagaagaaagcaatctgacagagaagagaagggttgtgatagggttcataaagtgggaaagaggctgggcccagtggctcacgcctgtaatcccagcactttgggaggccaaggtgggtagatcatctgaggtcaaaagtttgagaccagcctggcctgtgaccagtcggagactgaagtgaaggctccctgtgtccagaccctgtgtttctttcttctcctctgttacatctgcttgtctttttctcttggaatttatattctaaactattcaaatagactgttcttctgcctcatttccccctgagagacgtgatcttcataaatctttatgggaggcagagggaccaatagtctttcttctgtaactacttcatgctgattggggcacagtccctacctattggggaccatggaactctagcactgctctgtctagtggagatagggtgacttcttgatggccagggcaggcatcatcatctggaactggaagccctgctgcatgatcatttgaagcttaatcgtctctaggtgagaagaaataatctggtaaaaagatgaacaaacatggtccaaaaagtcaatgcaagtataattattaacaatgggctggccaagggaaggagccatgaagcccagcttggtgcccttgaccaggagccctatgatgtggacagctgttgttatattttagaagtcctgtcagctaattttcgagtggcatccctactaatcctgattggttgatataaaaacaacattcttataggaaaagacataagccatctttttgagcagttaggagatccagtctccttctattttgtacagtgactgctgccaaggagtctgtttgattttgtaaggtgacaatactttgggcagtgtcttccaagctgtctggaagatccttggatgagcattggtaataggatagggaagttggaagcctgctaactcctattgctattcctgcagttattcctagccctaccaaaaggggtatgagttggatggctcatttgtgcttggtagttgcagttagaggtataatgagagactggttattgggagctatgttgattttaagggggtaaatatacaagtgtacagcttccaatccagttggctgataaacataagtacaactagttccacacaggagaaaggatctttgttttttaagacaaaaattgttgtctatggtgaacatatgggttagtttgttgttttcattttcccaagtgattaaggtccctgctaaggtggccctggttaaaggctggaaaggaccttgggaagtatcctgagttgccccagcagcatttttccagtggaggtagttgcacttagtgtccaccagcaaccacctagaggtattttcatactggggaaccaaaagacaactagatgtctcaggattagtatggtttttcccaagggaaaatatgaacacagctactgggcctatcttggcagtacttagactgtgtatcctttaaagtgccttgaactaggaatggtttccttgaaaccatacaggtttaccaaatgatgcagtctgggcaactgcatagcttacatgatcatgtgaagggttaatctctagggtgtagctcttaagccaattaattagagctcctttatataacatcacacacacaacacttgtagacaggggaagatctagctgttgttacgtttttctttccctttaatttttttttttttgagacagagtcttgctctgttgcccaggctggagtacagtggcatgatctcagcccactgcaacctccgcctcctgggttcaagcgattcttgtgcctcagcctcccgagtagctgggactacaggtgcgtaccactatgcctgcctaatttttgtatttttagtagcgacagccatgttggccaggctggtctcaaacttttgacctcagatgatctacccaccttggcctcccaaagtgctgggattacaggcgtgagccactgggcccagcctctttcccactttatgaaccctatcacaacttccacagaccatctatgacgtgcttagattttctgacttgtcctgtatttccctgtttcctaagtaattaagcattctactttaggacaagaatttgccatacaagattctttctcatataaaatttcttttcttcataaccttccttatcataaatacatcttcatagctataactttctttatatctctctttcctactaaagtaatttctgatgcctccaaaagtcaaaaaggtcaggtaatgtgatgcaaaactgagcagagccttagattttgagagggacctgtctgcctacagttcttggggttccatgaggaaaacaggggtttctcctaaaatggggtctgtggcaccttctgtttttcccaaggagtcccaggctcccttaggtcctttcatgggcatcaagagtggcaagaagatagaccagggaaatagtccagtcaactgagaagaaaaacaaaactgttgtaaagatggataaactgaggcacaacgcagtttaaaaattcacgttcacatagagctaggctacgcagctcgctgctcagtcactgatgcacttgtgtggtagctcatggtgtacttcaccaacaggtttcctgccccctcagagcttacaacctgggtttcatttcctgctctacagctatataatttaacagttttcctctcaatgtgttggattctaaccctatatatctcacattttattaatattactgaatcttaaagggagccatgatgtctttaatcctcagaaatattaaacaacctggctgggtgtggtggctcacacctgtaatcccagcactttaggaggccaaggtgggcggatcatgaggtcaggagttcgaggccagtgtggccaacatagtgaaaccccgtctctactaaaaatacaaaaaattagccaggtgtggtggtgtgcatctgtaatcccagttactctggaggctgaggcaggagaatagcttgaacccgggaggtggaggttgcagtgagctgagattgtgccattgcattccagcctgggcaacattatgagattccatttcaagaaaaaaaaaatataaagcaacctgtaaacaaaggagtacatgaggttaaacagtattcaaatttctttatgctttaaaacattgagagagtatattgagaaacacacctaagaaactgcagtcaatctactgtgaacaaaaatttagagaatatctcttcaaaataagctatctagtggtatttatacatattcttacatatatcagcagtgttttacatgcttgtaacgttaaacataattgaaaagtgtcaagattatagggcttatacatttctgtgggcttgaaaatgatgcaatatagattatttgtttctataaagtagtcagtaaaatgtacaaacttctaaacggagtaataactaacaagagagttcatactgaaggtagtaatactaggaacaaaagagggctcaacactgccttcaggagagaaagggtccagattggtatattttctaaaggcttcctccagcctgccataaaacacggctagattttcctccttgccctgtgcaacctcccttactttatcataatttactgccttagttattccctttttcattcctccaaggagagccttaagaaatttggcccagttgttcattcccatgggggtgttatagtcccagttaggatcagtagcggagactgtgtctgggcctgggcaattaccctgagggttttgggcaaataaattgtctgcttctcggcaagtggcctcaaagattcattccttttccaacagggtgcaacaagttgctggaatgaattgaacgtctctctatgagagatgaaaggctaaggtcaaagcttggaacctatctgcaaattttctggggttctctgaatagcttcctagctttttctttacattgttgtatgttatttatggagaaggggacctacactcagaccagcccctcggctcctgctgcttccctaagggatagcagggctatagaggtagttgaatagagtgttcccctctgaatgtgaggggacttagcagggcccttggttttagctcttgggtttgagcctcagaaacacttggcaaggggttatatgggggtggttgccattgcccctgagagacaggtggcccttgcaaaaaggaggtcatccacaatatccggttctgccttagaacctgcccttttgggggcaggttctgggagttttgcagatggttgggttttgatatagggccatgaaggcctgcacatatgggatttctgaccatttacactgccttttgcaaaataggtctaattgcaggatggtgttgtaattaagacttccattgactccccattattcctggctgtctagctaattttggggccatacaatattatggttaaaaaaaatcagatgttttctccttagattgtcagggtcaaattgattccagtggttgagaatgcagccaagtggggaatcaggtggaatggatggagagttgcccatagaggtctggaagaaagaagagaacctagcttatttggtgactcaaattttacctggggcatccccctggaaaaactctgggccttgattggggtcctcaggggtgtccccctttagggccccatcttagtctgtcagatgtctctgaccttagatgggtgatggtaccactttgggaaggttctctccaccactgatgacccactgtgagctttccttttgtccctggatgaaggccttgtcttctagcatccatataatttgataaggccatggtttcctgttccactggagtgatagccatgaactttaataataggaactagaggttggatggatttcttttgtcatgtggattacaggtaatctcaaggggggaaaggtagattttgggcatgaaaaatgaaataatagtgttggctattccactcaggccctcgacaagagagggaatgtttaaaaatccaccaccatgacagtggaccctgtgtaagggcaggccattctataaaaataatctggtgatgacaaaagaaacaagatgtagaatgtattctaaagattgtgggccccaaaagtcctcagcaagttgaatagattgagtaggataagggaagtcaaaacatctaagagatatcctttgccattacaagctaactctttaggagaatttgacataagaaaagagggcttaagttgactgaaacatctgtgagtttgttctggaagagctgccactgccaatttcgtcacatgtagggattagggactttaactaggaaagatagaaaagagtacttccccattctgggcagggcagctatccccattcacttcttggccttcaggtaacaccagagagtggctctggctagttgccctcaattaccaaggatctactaggaaacagcctctgaaagactgaaaaaaagaaaaggactcaggtccctcacccaaaccaggcaatggtggtcaggtgcttccacatggatacctttcagtctcccgggagagtggacctggccagagacctgcagttgccttcatgcttagatgctgtctgtggagggtcccgtgttggaaaagggaaagagagcagaaagggttcccctctgtggagtgtagggagctctgcatggagatagctctagcctgtgcccgcaaatgaaggctcaatagagaggaaaagaaaaagagcaaaagcaaagcaaagaaaaataaatccccaaatttgggcttacctcctggctgacttgccaagatatgttaccagtggagggtcttgactacaagttgtccagtttcttggcatattgaacaaagaattggacaaaacgcacaaacaaagcaatagaagacaaaagcatagatgtattgaagcaaaagtatactccacagatcaggagcaggcttgagcaagcagctcaagagccctagttgcaaatcttccggggtttaagtacccattagaggtttcctatcggttacaccctatataaatgaagacttggcccacaaccaatcggaggctgaagtgaaggctcagcccgtgatcaattggaggctgaagtgaaggctcagcctacaaccaatcagaggctgaagttacatcctacgcaaatgaagacttggcccatgaccaatcagaggctgaagtgaaggctgcctgtctccagaccctattctcctgcctaaaaatgggtcaaaactcaaagggttggaaagaacatatcgttggaaaaaaaaaaaaagtctccctcatacccttgttcctttccttcgaggcaaccagtatttatcagatttatgtgtatccttcccagatactttgcgcctgtcctttagataggtatccttggggacacatttagtgggtagggacagtcaatctctatacttttgcttctggcaataattatttgattttaatatctatcactggagtcttaccaaattcatgcactccacattatttctctggagtcttttgctttttgttgatgaaaacagagttaaaaggtttttatttcactaaaatgatctgtgtaaatagggaagtaatgattttaaactatagttcactgttttttgtttttttttttgagaaaagatgattttggcgtgaggagtttgtcagtgtctaacaattctttcctatatttttcctgaaggcgcttgactttggcagatattgagagaatagccccattggctgagggggccttaccttacaacctggcagaacttcagagacaggtatgagtaatctcataaatatgatcaccttaaaaaaatgctgaactagtagactaaataggagctgacagcttctgaatgctgtaaaaattaaaaattactttccagagaaagactttacttagcttaaagattacctttatagaactactgttacccccacttttatagaatatatatatattttttgagatggagtctggctgtgttgcccaggctggagtgcaatggcgtgatctcggcttactgcaacctctgccttctgggttcaagagattctcctgcctcagcctccccgagtaattgggattacaggcgtgcaccaccacaactggctaatttttgtatttttagtagagacaaggttttgccatgttgggcaggctggtcttgaactcgtgacctcaggtgatccacctgcctcggcctcccaaagtgctgggattacaggcatgagccaccacacccagcctatagaatatttttatgagataactagatttatatttgtgttttgttttttgttttgttcagataaggaaaataagagttcaaacatacatgggtttgaccccgttccccttagaattagcattcttttcatttgcctcgtcacatttaaagattagtgttaggtttactttgtatcattaaactgatatttatagggtttctaaaattaaaaaacttccctcaaattaaataaatcattcactgggattgtgccttacagattacagccaggaaaaaaaaagtaattagtgaaaccagaaagaaaaccctgactgttaattacatttttgataaatattacttttggtttttataaatgttaagaatgattaaaacagtagcttctgagtcctataaaattaatacaatcccatttctgattttacaaatactatcttggtaagaaaaagaaaatccatgaaattaccttgaagagtggaatggaacagtttttaataaatctcgttttaagttgaaacttccacttctatagcacttaggaagtttcagtggtagcagatgatcacattgcttttgtgtgtgggtaagggttaggagggccagtcattgtcctcctggtactttcctgctctaatagacatggaacctgtgttcctcataattctctaggagagtgtgatgccatactaggcaaggcgacgtggggagggcatggataaagaagacaggatacagagagagagagagagagagacagttactaaatgtgcatgctatagaaagaggctatgtctgctctttcttcattgctgccacattggtgagtagccagggttggcttgctgttattgttcaccttcaccaaatgtgttaatgaaacatcaagatatgtttaagtgtagttcgctttgggaagacttggttaggaaacctttcttctacttgagctccatggaatgatgattctgcctgtgaaactaattagaatttacagttctactttacataaggaacaagaacattttgtagtcaggttgaagtaaattgaaaatggaaaagaaaccattatatctgcattttgtattaatactttaactgtttgcttgatgtgtaataaagcttcctacagattaaaatatgttgtaactcattgcaatttagcttcttttgtatcagaaaaactcttttatctgctgccatcaaagtttatttccaggctgggtacagtggcttatgcctgtaatgccagcaatttgggagcctgaggcaggcagattgcttgagcccagaagttccagaccagcctgggcaacatggcaaaaccccatctctacaaaaaaaaaatgcaaaaaattagccaggcgtgatggcgtgtgcctgtagtcctagctacttgggaggctgaggagggagaatcacctgagcccaggaagttgaggttgcagtgagcgtgactgtgctactacactccagcttgggcaacagagtgagactctgtcttaaaaaaaaaaagaaaaaagtttatttccattaggaggtctcagatcctttaaaaatagatggatttatttcaattcagtgattttaaaaaaataaaattttataaaattatgtttaataaaaggaaagaatgtgaaaaatttttaataaaattaagagacattgaaatatttaaagagctcttactgaatttaattttattttttgtagcctatacatctgtgaaaatttgctcttgaattttgaaaaattgcatttcaaaagaagatattttgcagtgttgcatgtgtctattgatatagctctccctggaggtttccttaatatttgtaattggggaatatttcatttagcttattaaaaacattgaatttaaaagtctcaactcatttctcctcctcagtttttctgctgcttacttttctattcacccacctctcttgcccctagcaattttcctagaggccatatctgaagcttgttttgcaatctttggcaccctgagtctgcatccttcacatttcttcatccttaggaaagtgatgtaattttgctactgctgtgaattctttttaagacagattcaagatgatttgcctgtcttcagtggcagcgctgatgcttttatgctgggatgggtggcctcaagggtcttttcagatatttaggaaatgggcagtgataaaaaccaccattttcttcttccctgggtctctgattggtatccagagtgatggggagtgctttctctgcctttccttaaccagtgagatagtacagggatctagaatttctggagagctggtagaagtcttaggtattcttacattgtccccaaaggaagaacctcagagtctcaggacaatttttttttttttttgtggagacagggtctcactctgtcagccaggcacaatcactgttcactgcagtcctgacctccccggctcaggtgatccttccacctcagcctcctgaatagctgggactgtaggcatacaccaccatgctcagctaatttgttttcagtagagacagggttaagccatgtttcccaggctggtctcaaactcctaagcttacattaatccactgatcttggcctcccaaagtgctgggattacagtgtgtgtgagccactgcactcagctaaaatgtttgatgtttcctctcacatagaagatagtctttctactgaggattaggtacagagaaataaaaattaaggtcttaagtgtatattttcctgtacattattataggaacaaaatctgagaaaatagaactcaacagaaataataaataattattagaattttatagaaacagatttgtgaaggttaaggattcagattaatgtccactaatggccattgtgaaatctgatctttactgtccttgagatttgatacaagtttatttgggactcagttttccctttaataaagtgagtatcttcatgtatttctgagaagccttcaagctcctgcattctgtagaatggtatgtatcaatggattttattttcagaattctaaatttatcctcctttttcctttgtaacatttaaaattttataaggaatacaggctggactcaagtagaataatatgaaaatatgcttaagttcttatagcaaccaaagtaatggaataaactttcttcaattttcagccttgaaaaaacattcctcagttaacatatttcaggtttatgaggcattgtaaggcagccatatagactacaatcctagtgactcagtttttaacattctttagttcacagaatttcagtaatgctaaccttaactattcccatgttacttccagaagatatcttgatttgattctcttgtaatttttcctatattgccaaattagaagtacataattacttacatttattatgcagagtattcccttatatgaatctattagaaacctaaatataaaataggaagaaggatatatgtcttgttatctcaccttatgaaagttgttatgaaaacacttgtttatgatggagaatctgtgagtccagaactagaagttatgagggagagagtagttaagagcctggccactgattatgtaacatcctctcattctgtttcctcatttattaaatagggacagtatgccaggcacagtggcttgtgcctgtaattccagcactttgagaggccaaggcgggcaggttgttttgagcccaggagtttgagaccagcctgggcaatatgatgaaaccctgtctctaaaaaaacatacaaaaaattagccaggcatggtagtatgcacctgtagtctcagctatttgggagacagaggtgggaggattgcttgagcccaggaatttgaggctgcagtcagctgtgatcacactactgcactccagcctgagtgacagagtgagaccctgtctcaaataaataaataaatagggatagcagtatgcatctttataggattgttatgggaattacatgagtaataatacacttacattaagcctgacacctgctaagcatgcaataaatgttaactgctattattgtgcttattactgttatcaaatatgagaagcccatataagcaaactccaagatgggctgaaacatatatgtgacacaactgcttaatctaccctcatctacttccattaggtagaaggggatgggaagtgaggaaaaagtattaatatatctttgtattttttaagtgcctgaaatgttttatattttaattttttgatgctggctgaaattttaccaggcctgtttttaaaaatttttaattaatgatggatattcaacaaggaaaaaaaatcactaccccataccatacacaaaagtcttttcctgttcctaaatgtgaaagattaaagaggataacacaagatattctatttatgatctggagataggcagagattttgtgaatagtacagaacaccagtcataaagaaaaagattaataagttaaacttcattagatttaagaacttttatcaaaatataccactaagagtgtgaaaagacaagttacacaataggcagagatatttgcaataatttaaataatagaggatctgtatccagaatatatagtataataaacttgtgcaaatttataagcaaaaggcaggcaatgcaatagaaaaattggctaaatacctgaacagaaacctcacaaaagaggatatccaaatggtaaggaaaaataatagaaaagtttaatatcattagtacaagaaaacacacattaaaactgcaatgggatgctattttatactatccagattgatcaaaattatactctgacaatggcaagtgttgttcaagaggtgaaggaatggaaattgctagcatcacaactttggcaactatttgtcagtaccactgcagttgaagaaacacataccccgtgacctgttggttcctctcctgggtgtagtccctaacaaaaatgtttacacatgtgtgttaagagatatgtacaagaaagtttaggccgggtgtggtggctcacacctgtaatcccagcactttgggaagctgaggtgggtggatcacttgaggtcaggagtctaacatgatgaatccccatctctacaaaaaatacaaaaaatttagccaggcatagtggtgcacacctatagtcccagctgctcgggaggctgaggcacgagaattgcttgaacccaggaggtagaggttgcagtgagccaggaatgcgccactgcactttagcctgggcaacagagggagacgctgtctcaaaaaaaaaaaaaaaaaaaaaaaaaaaaaagaatgtttatagctgcgttatttgcagttgcaaaaatattggaatctaaatactcaccaacagtagaacggataaatatgttgtgctattaagatgacctacagtgagagaaatggaaattttgatttgagggaagtgagataaaagaggaggtgggttgcagaaagaagaggatgtatatttttgaagcatgtaacagtttggatattaaaaccaggttatagaccaattttggtcctatgtgaaaatgggaaaacaaaccttctctttttctttttttttttttttttgagacggagtctcgctctgtcgcccaggctggagtgcagtggcgggatctcggctcactgcaagctccgcctcccgggttcacgccattctcctgcctcagcctcccaagcagctgggactacaggcgcccgccactgcgcccggctaattttttgtatttttagtagagacggggtttcaccgttttagccggcatggtctcgatctcctgacctcgtgatccgcccgcctcggcctcccaaagtgttgggattacaggcgtgagccaccgcgcccggcctctttttctttactgtatattacataattacttttttcaactgtatgggataaatgatctgtgatagacctgcttgggtatatatgtactttctttaaaaaagttttgtttctatgggaaattatattaaagctataggccactcactaaaaaaactatggaatataagctggattgtgttctgtcaaaacatcattagaattattaagaattattattttaacttttaagtttgggggtacatgtgaaggtttgttacataggtaaacgtgtcatggggtttttttgtacatagtattccatcacccaggtattaagcccagtacccgatagttatcttttctgctcctctcctttctcctccagtcctccctcaagtagaccccagtgtccgttgtttccttctttgtgttcataataagctcttatcacttagctcccacttataagtgagaacatacggtatttggctttctgttcctgtgttagtttgctaaggatggtggcctccagctccatccatgtccctgcaaaagacaggatctcattcttttttatggctgcatattagaattacttttatctttattttgtgtatagcgttccttagacataggactttgttttctttgtgtaatttgcatttctgtggaccttctttgaattttggattcatgagcacatataggaagacattactgtccatttaggaattcctttttttggaacattttacctctttcacctgtgatattttaccacaaatggaagtctgttctcaaaaagaaagttaggtttatttattagtctattattagctattatttattagtcatttaactcatttaaatttaactcatttaaattattagatttgaagacttaactatagtctttaacacaacttaactccctttttgctgagagaaaaatatgtattgtttagcattcaggggaaaattatatatatattaatatatataatatataataagtattatatattatatattattatgtatataacataattatatacttatataattatataatatatattatatataatatattatatataatataaatacatatataataatatatataattatatattatgtattatatataattataattctatattatgtattatatattatgtaaatatataatgtatacattatatatattagtatatattatatacatatataatatgtattatatattatatattaatatataatacgtattatacatatataatacgtattatatatcatatattttatatttatatataatatgtattatatattatatatatattttatgtatatatatatttttccttcatctccttctcctatactgtcatggctttaggttttaatcttactttttaaggccaagaatattgaattcaaatcccagactattgaagtcatagatgtagtttgcagacagaaaaattttgttttgttttctctagccttattttgccattccagtcatacatttttgtttttatagaatctagccttttttcccccttccaatgcttgatataaaaactttagctatttctcccttttattctacccattaatagtgtgtcatttgaaagaggtagttctccctattgagttggcagtgtggtttgggcaggtttgacttgttaactgacataatcttgccttatctaatgcatcatcactgctcactgcagcctcaacctcccaggctcaagtgatccttccacttcagcctctcaagtagctgggaccacaggcatgtactaccatgcctggctaacttttgtatttgttgtagagatggagttttaccatgttgcccaggctggtcttgaactcttgggctcaagtgatcttgcctgcctcagcctcccaaagtgctgggattactgctatgagccacatcactagacctaattctcacttacaaaatgagatacgtataacaaaaaaatgaagagaacatctctttaaatgaggtctcaacttatttcctatcatacacatatgcttagggagtaggttaaaaatcatttaagattctcaactcttgttttgaaaaacacttaattaaccttgttaaatatcaaactttacgaccataatcataaccttaagggaaagagcgtcttttcctttggcccatttgctcacggcaggcaatcttcttagtgctgagtgttttccttcagcctaaatgctaaaaattcaggacacagtcattaatagggatgacagcggtagcatttcatttatgaatattcatgaagtgaaatccatagcattaattacattaatttacatacctgaatacaagtgagccataagtgataactaagccttaaaaaaatgttgctaaccatatattgtatgttttcttttaaatgttatttaataagggtgaaggtgacatttctgtcaaaaggcatttgggtatttatagttagaaatgtttttagcaaagaattaaagcacagtataatccttcagttttcataggattttgtagggcttataaacattctttaaaggaagaaagtatacagaaaaatatatgcagttgaatacaggagaaaccttttatatgaataagggtattagtggttacttgatgcttatttaggatcataggctttttattctgtgagttttaattcaacatattcttttgaaaggatacatgattgaaaataattcataatctatgagaatgaaatttattttcatccagttttgtgattgagaaactctaagtgggggaaataacattctacatacatttttttttttttttttttttttgaggcagagtcttgctctgtcactcaggctggagtgcagtgatgtgatctcagctcacagcaacctccacctccaggtccaagtgatgctcccacttcagcctcccaagtagctgggattataggcacctgccactatacctgactaatttttgtatttttagtagagagagggtttcaccatgttggccaagctggtcttgaactcctgaactcaagtgatccgcccaccttggcctcccaaaatgctcagattacaggtatgagccactgtgctggcccagtgcatttttaaagaagttaaaaacgtatgccaatgtgtttagtaggtagcataatagctatattgattttaaaatgtgagctaaaatgcctgtctttgtttggactcctattacaaattaccataggtggtttagatagcaaacatttatttctcatagttctagaggctagaaagtacaagatcaaggtgctggccgattcagttactggtgagggccctattcctagtctgtagacagcaggctgcttgttatatccttgttataagagggagagatagagggaggtcgtctttcttgtgtcttttcttataatggcactaatcctatcatgagggctccattttcatgacctaattaccacccaaagttgccaccttcacatcacatacaatcacattgggcagtagggtctcaacacatgaattttggggagtcacaagcagtgaatctgtagcaatgccataacttgaattccttcaaagtatatgagattaaatatcatcattgccttgaaaggacagattgtgtatatgttttcaactgttgtctttgaaacaaagtatcagaattaactggttaatcaacattttagaaactcattgaagcatattcagttaattatactgaagcatattcaatatagtgggccctccatctgcttgagtttcatgtccttggattcagccaactgtggatggaaaatatttgggaaaaaacaaacaataaaaaataacactacaacaataaaaaaatacaaaatttaaaaatacagtataacaactatttacatcttatttaccttatattaggtattagaagtaatgtagagatgatttaaagaatacaagaggatgtgcataggttatgtgaaaatactacactattttagataagggacatgagcatccatggattttggtatttgaaagtagtatcaggaatatttttgtgccaggtgaggtggcttatgcctgtaatcccagcactttgggaggttgaggtgggagaatagcttgagctcaagagtttgagaccagcctgggcaacataaacagaccccatctctacaaaaaatttaaaaattagctgggcatggtggcatgcacctgtagtcctagctacttcggaggctgagtcgttgggatggcctgaacctgggaatttgaggctgcggtgagccatgtttgtgccactgcattccagcctaggcatcagagtgaaaccctgtctccaaaaaaaaaaaaaaaaaaaaggaatatttttgcattaattaataagtgaaatataaaattacttagaaatatttatctcattctataatttctatttttgtatatactttaaaatacatcttatgtgtaattttataatgtatattaagtttatgtatatataattaagacgttggcaaatatgtgaactttttatttagtttattctgtcatttcatactgtttacatagtatagaaggtcttttcatagtgaaaatattaaagaacaagactgacacactagtatagacaagttatcttagatcctttctttatgctgtgggatacctgtgaaataacatctggtggaatttttctcttttttattattatagatttttatgttagaactgtggcagtagtcattagagatggtagattatgatcaatattctctgatttaagaatcaagttaatttttatacactttagaaagctttttaaattttaagttagttaaagaaggaaaaaaattttataactgaaatgcttgtttacctgaaagattcacttctgtaaactgatagtgtattcccccaacagtagcagataaatgaggcattaataggcttgtaaaaattggggtaagtgggaagctactgtgtatttggcctaacatggtttttaaatgctgacaatagagttatctatttttaaatacattgctttcatttttggctgcatgaatatcctattttcttcttttagaaaagatattactgcattaacaatatcacttttaggttttgttttttcttgtcttaaaatagtcaaattgtagctttttcacttgctgtgtgcgctttcaagatttttttttacccgttttcttctctgcagcagtctcctgggttaggcaggcctatctggctccagattgccgagtctgcttacagattcactctgggctcagttgctggaggtgagtgacatgtctgtgtgctgtttgaggcttgtgttaatgtaatattatctcaccagactgaggcagatcagcaaaggtgcagttcattgttcccatgggtcacgacttcagggctttctgaagtgttctttatttttacctatgatcaggagacttgtcgtagcaatggctatgaccatctggctccagtctgtcttcaggacagaacctctgtaatgatgtgaaagtctgggatgcagtgctgcactcaccttaattatactggctaaggccagtatgaaaaaatggaaaatgagactgtgtttatgggacaggttaagaaattgagattcgctattatccttagcaaactaacgcaggaacagaaaaccaaataccacatgttctcatttataagtgggaactaaataggagcttattatgaacacaaagaaggaaacaacagacactggggtctacttgtgggggagggtggcaggaaggaggggagcagaaaaaatgactgttggatgctgggattaatacctgggcgatgaaatatgtacaacaaacgcccgtgacacgtgtttacctatgtgacaaaccttcatatataccccacacctaaaataaaactaaaaaaaaaaagaaagaaattgagatttgggatatgaatcccagaacctcgtgaaataaaagagcctctcaaagtgacccagttttgcttttctgcttgtatgttttcctttcccttatcgcttgcttaacaatatctggacttgatgtttatttgcaaaaatgaacctcccttccctccctgttcacagccaaaatttgagagactgtttttgcttaaatactctacttagaaaatgtgtacaatctgaagttgctttgttgagaagaagctagcaggtgtgattaaaatgcttacgattttttaagataagcctgaactcaaaagacttttttttttcttttcactctcagttttagaagttgcaaaccaggttttggctttcagcagtcaaaatgtgtaatactctcgttcatgtaaataaattttcattccctgagaaattctaaagcatagccatattttcttttaaaccaaattctatacatagggataggataatgttgaagtgtgtttctaatattatggttgtaactatgattaatttaccaagatgctttattaaactaaattttaaaatcgtagccacctagtgtacggatatagtcattttaagaagtaactggcataatatttaagcatttaatggaaaatataaataaatgttatacataatagtttaatgttgttactatagaaaactgagtgttgattatctaatttgggaagtgactcgataatccactctgtagtttatgaacctacgatatcaaagagcattcttgacagttgttttctgaagcagctgtatttatggatttcagtgcttgctatagcctgctatccctaaggtgtttgtgagggaaagaaaaataataaactctcttttgtgagaatacatgttgtgttttattttctcatcctttaagataagatttgtcatccttatggactctccatttaattgtgttcttttttaagcctaaaaattgttctgtttgtagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtgagtaagcaaatcccagctgctgaagttagtgatttgatctcaccagcagcagattttaactcactaattatggaagccaatatgtagtatgcctagccagactaggtctgtttctctctttttattttctctttgctcatttccctttttgcattctttctggtgattagcaatattaatctgcaaataaggtcttcatttcttcttcttgtggtttatatttcttggtgtccaaattatgtgtttgtcccaacatgggtctatgtcaccatgctcctacaaaccaaggcacatatctgcaggtggaatacaaggatgatagttaagaaatatagagctgcttttctcaaagaattaaagaggagaaatacatctctttcctgtgaaaaagaatccaggttaccactcaaagatgagtttaccctccatatatttatttcaactgaaataaatatcaaatgtttttgtctctttcagggaccatttataaattttttccaatgagccatctgaaggtttaaaaaaaaaaaaaaaaaggaaaaccctttggttccaagtctaattcttgcttctttcccccacttagctcagaggtgtacagtcaaaacagagagattttctttcgcagggaatgttagcagccactctagactgagcacagtgcagttggcatcagaggcagcactgcgccccatgcagaattttccccaccccccgttgtctttgtaggaacttgtctctttggagagagaatgactttcatgtatgtgttttcacattagaatatagggtttcctttgggagggagattaattttttaatctctttgggcgccacttgggattctatgaaaatactctctacatgctcaagtccatgccatttatgtaatttactgtacttgtttgtttgcacatacaagctcattaatccctagcctattctgagctctgttgaactatttggcttagaaatcttcctaagaaagactgggcccgaacagagctttatgctcatggacaggaggaaaaaaacaccgctggttagcattatatacaggtattcaagcaaaaaatataactccgataaactcataattgaagtagagggtcacaaggatgttcatttttagcattatatatagaataataggagagagttattccgaaatcaaactaggctcaagtaccctgctcttgagaatgaatgtgatgagttttcctcaaatattcagaactgtagtctctttgaattccacctgtacagcatgtaccctgtggaaaggcgtacaatatccagaatgcagacctttccatgtgaatgcttgttttaactgattaaaccctgcatatccagattttatttaatggggaatcaaggttgagtggcattaaggttgtttttttccttgatatctccaatatttctttgttgaataatgacctttctcctctttggtatacttttaaattgcaaagaaaatgtcccctattaaaaggaacctagatatttactgcatagtttagccttctcaatggatagatgcttacagaagatttcatttgagagagatgtcatgtttattaaatggatgcaatatagcaagtaggggaggggattgttggttttattcaggatgtaagctcataaaagcagttctttaaatgagagacttttgtattagggagaagattgtaggagtcctgtatgtgagcactatgattattgagattgtcatatattgcttgcaactggtccattattctgtcagatgattgacaaaattgttgacagattagctaaatttcttcgcaggcaacaatgataaaatgacacaaatcagtactttattaaattccatgagccttattgaggcgagttgtaaaacaaatatgcatgctgacatggttgtatgggagttagattaaaagtaatagagcctgataatcacgagggttagaaagttaatactgccatctgctgatttgttcttttaaatcagtctgctacgcatgaaaggtgtgtgaggctttgtgtgtatcattgataattcagcctgactgacagtagcctatatgtatgattacttgtggctctcaacttatggaactcagcagtatcctcaaagcaggcttaagatcagcagtcagcaagcaggcaaacacatatataactcccctttggctggatgatttaaaggatataaaatgtttattgttagcatctttaaaaaatgtatgcaaaaaagtatgctaacaatttggataagctgtgtgctttagaaagctgagcccaacagatgttgaattgtttatttttttcttttccagtttacaaccagcctggggaatttaactttctaaggattatgatttcctttgttttgaggggattcttttaaaatgtcttaagcttgacatatattagtcaataagaatacaacaggcatatgtttttgcttataggagatactcgttaaacaatacttaaaactgcatttttctttgcagttttggcttccttttaaataaatgaatattgaatgctgtgtttctctgaagagaagattatgggagttagtattctataataacgaagccactgtatgccattatgtaggtagcaaaatctgggtatgcttaacagcatgcttttcagagcttttccaagtgtacagtatctgtgtatgtttatatgttgttggttgtaataagggagggaatttggttacattgttattggcagtgttcccagaatagagaagacgcatggctccgtttcttcttcatggactttttgggaagtgttggataactaggctttaaagtaagcatgcttaagaagaggatttatagcctcaagaaaacgtgacattatactgcatttgtaaataattattacatatgtatacagagttttaaggataatctttttcccattttaatgaaaactctgcaatgtttgatgggtaaataatatgggggaaactctttgttgctgggcttgtgtattcatgtctggtacagctatattgctgatgattctgtccctttacctaggtctgataccacaacttataggggttgctccagaaaaggccattaaactgactgtaagtttatctctaactgaatttatgtcatttgtttagattaccattaagccaaaaagctaaaatcaaggctaggcgtggtagctcatgcctataatctcagcattttgggtggtgggaggatcacttgagaccagttctaaaccagcataagcatagtaagaactcagctctaccaaaacaacaacaacaacaacaaaattaaaaattagccaagtgtggtgatttatgccaggaggctgatgtgggaggattgcttgagtccaggaatttgaggctgtagtgagctatgatcatgccactgcactccagcctgagcaacagagtgagaccctgtctcaaaaacaaaactaaaattgatgctgctgacactggcacactgtcgcagaatttgtacaactttaattttacatgtaagcatttgataattttaaattttatcataagacaaatattttgctgacttggaaaagcaacagtatgccagaagagaaatggttgggaattttggttaactgatgttgtctttctaattaggttaatgattttgttcgggacaaatttaccagaagagatggctctgttccacttccagcagaagttcttgctggaggctgtgtaagtattactgttaggcgcttcttgtgacaaatacattccgttgacctttttgcacagatataatagatatcttagtggcatttctcttgaactcaagggattctaagcaggttttctcaataatcatatggaataagttttaaattttattgtaaaagctaacgggttttgagtgtagaaaagaggtagcattttccgccagttagaatggtgatcattaaaaagtcaggaaacaacagatgctggagaggatgtggagaaataggaaccattttacactgttggtgggagtgtgaattagttcaaccattgtggaagacagtgtggcaattcctcaaggatctagaactagaaataccatttgacccagcaatcccattactgagtatatacccaaaggattataaatcattctactataaagacacatgcacacatatgtttattgtggcactattcacaatagcaaagacttggaaccaacccaaatgcccatcagtgacagactggattaagaaaatttggcacatatacaccatggaataatatgcagccataaaaaaggatgagttcctgtcctttgcagggacatggatgaagctgcaaaccatcattctcagcaaactgtcacaaggacagaaaaccaaacaccacatgttctcactcataggtgggaattgaacaatgagaacacctggacacagggcagggagcatcacacactggggcctgtcatggggttgggggttgggggttgggggagagatagcagtaggagaaatacctaatgtaaatgatgagttgatgggtgcagcaaaccaacatggcacatgtatacctatgtatcaaacctgcacattgtgcacatgtaccctaaaacttaaagtataataacaaaaaaagaggtggcattttcatcagctctatctctttgatgctcctaaagcattaccttccagacttttttaaaagttctaattcctatgccttttaagaaatagagtacagaaaatatagtagtggatagagttaccattcatatatgttaactggaactttaaaacaagtgtgagatggctgattaattgggcccttatatcttaggtataggactgagtaagccattgtttaataataatttttcttctttagaggccagagggtatggcaaacaataataacggtaactacatttcagctattgacagaaattctgaaccaagagactcagatatttacttagcgcacaaaggtttctgtctttaaagtgtaagcatgacatgattattggcaaacaataataacggtaactacatttcagctattgacagaaattctgaaccaagagactcagatatttacttagcgcacaaaggtttctgtctttaaagtgtaagcatgaccaattcttaaatctatttgcagctcaactaatttcatttgtggtatttgtttcatatttgataacacatggttcgtttcagacttgtttagtccattttgttcttggaaacattaataacttccagttgaattggctgacagtcttggctaaaacttcctcagttgcttgtgaaacctgaagtgatgaggtcagtgaccttggcaacatttaattcagagacactgcctcgggggtcagagagagagagaggttgctccagattctctttgatatgtgtcagtgtggcacatacctgagtcctctgcagagttgctttggaagaggtggactgctgtgtgggtgtgtgtgtgcctgtatgcatgccccagcacattctcaggaaggaaatctctttggctacatttcttttttaatgaagagttaacagtggacatagaataaaacttttgcttaggtggatcaccaaaaatgaagtttctcttcttcctttattccaattagattctgtaattggttcttatctagagagcgaacctttgccaatcataaatattctttttcttggtcattttaagtttctgtttggttaagaagctttctaactcatttttatcacagcacatgcatacctttgccagaaatataagtcatgctctttctgttccatgtagctaattatttgtttccgtttgcaatatccaggtttttggtcatgaagctgacctgtttccatgtctgacatgtgacctaagtggttaaaccaaaataagatgtttagttcctttgttcttcctagctaccgaccctgtttataggtttgaactttaggaatttctattgaagtctgggttgccttgagggttgtgctgacactctaaatctcttccttaatcatgactcatttctggaggctttgatggattgtctagtgggaaattgacagcatgaaaaatagtcaggttggactctaggcagaatgataaggttgtctgcagttcttcaccacaaacgttttctgcttcccccttgctctaaatctcttctttcagggaagaagaaaaaagtgcaattattgagtttctactgacaaattcagttatgctatgctataaatgattgttaaaacataattcactgtttctccccaaagtctataaatttcaacagagaataaagtcttaaaaagaatgagtctctctttatagaatatcaggctgtatgggacataggatactccatttcctaaatgatacctggcaaacagccaccagattaacactgtgaagagtggctgtctgtgagcctgaccctgagtcttcatcatcctgagtagtggtggtgatacgatgtacggtgtccttatggcttttggctgagtgctgtcagtgccactagtgagaagaatgctgctgttcttccaaaaattacccaattttaaagatgcacctaatacattaacctattgcaggttaattaggaagaaatggctcaaattgagttctaggctttttttcccagaggaaggattagctaggacctaggccttgagttccctatagatgagagggaaattttattgccatggaaatgacaatattcccttttaggaaaaatggtgtgtgttgactagatcatgaagtgacctagaagtgaaaatctctagtccttgggcattatatattttgttgttgttgtatgttttgttttattatctggtttgtttttgttttcgtttttgttttgagatggagttttgctcttgttatccaggctggaatgcaatggcacgatctcggcccaccgcagcctccacctcccaggttaatgcgattctcctgcctcagcctccctagtagctgagattacaggcatgtgccactgcacccggctaattttgtatttttagtagagctggggtttctccatgttaggctggtctcaaactcccgacctcaggtgatccaccggcctcggcctcccaaagtgctgggattacgggcgtgagccaccacacccggtctttatgatctgtttttaaaggcatgtgatttttgtttttttgtttgtttgtttttcttcttttttgagacaggatctcagtctgttgcccaggctggagtggcgtggtgcgatctcagctcactgcagccttgacaactcctgggctcaagggctcctcccatctctcagcctccccagtagctgggactacaggtgcatgccaccatcctctgctaatttttgtattttttgtagagatggggtttcatcatgttgcccaggctggtctcgaattcctgggctcaagcaacccacctgccttggcctcctagttttgggattacaggtgtgagtcaccaggctggccaaggcctgtgatttttgatacatgcaaaagaatacaaacaatataattacagaataataaaatgagcatccatgcttctagcacccaacttaactaaaacgttactactattgttgatgatgattattgcttttgatgtagcttgaatcagctaatgaggaatagatacctttcttactgggctgaacattttatagggattatctcattattgttcccaactagagttgaaaaaactaaaaccttagtgaaatccaaattttgacttagtaaatatcaaaattgtggttcaaaccacttctatctccaaatccatattctttcacacttgatataggttttcatttgttctttcatatattcacttactcattgaatacctgatatctttcatgcaaattttaaaaataccacctttaggccgggggcggtggctcacgcctgtaatcccagtactttgggaggccgaagcaagtggatcacctgaggtcaggagttcgagaccagcctggccaacatagtgaaaccccgtctctactgaaaatacaaaaaaattagccaggtgaagtggcgcgttcctacagtcccagctacttgggaggctgaggtaggagaatcgcttgaacccaggaggtggaggttgcagtgagctgtgatcgtgccactgcactccagcttgggcaacagagtgagactctgtctcaaaaaaaaaaaacaaaaaacaaaacaaaacaaaaaaacagaaaaaataacagctttattgagatatacttaacgtaccatacaactcccccatttaatgtgtataattcagtgttttgttgtgaaaccatcaccacaatcaattttagaacatttttatcaacacagaaagaaatgcagtaccttttagctatcacttctcaatcttcccatcccatccgtaagatctaggcaactgtattgcccaggcaggagtgcagtggtgcgatcaaggctcacagcaaccttgaactgccggctcaggcaatcctcccacctcagcttcatgagtagctaggactgcaggtgtgtgccaccaccctcagctaatttttaagtttttcatagagacagggtcttacttggccaggctggccttgagctcctggcctcaagcaatccttctgcctcctcctcccaaagtactagagttacagatacgagccactgcacttggcctctaggcaactattaatatactttctgtttttacaaattcaccaattctgaatattttatataaatggaggctgggcgtggtggctcatgcttataattccagcactttgggaggctgaggtgtgtggatcacttgaggtcaggagtttgagaccagcctggccaacatggtgtgaaaccccatctttataaaaaatgcaaaaattagccaggcgtggtggcaggtgcttttaatcctggctacttgggaggctgaggcaggagaatcacttgagcctgggaggcggaggttgcaatgagcagagattgtgcccactgcactccagcctgggcaacagagagagactctgtctcaaaataaataaataaataaataaggaatcatgatatgtggccttttgtaagcatgacattgtgcctaacttttttcacttagcgtgttttcaaggttcatctgtgttgtagcatgtatcagtacttaattcatttttattgctgaatatatggatatactacagtttgttcattcattagttgataaacatttgagttgtttctaccttttgacttatgaataatgctgctatgaatattggtatataaggttttgcatggacatgttttcatttctcttgggtatatacgtatgagtggaattggtgtgtcatatgacaactgtaattagcattttcaggactgccagactgtttttcaaagtggctacatccttttgcatccctactagtagtgtgaagcttctgatttctctacatctttgctagtatgtgtgtgcgcgcgtgtgtgtgtgtgtgtgtgtgtatttttttaaataatggtagcgtctcactatgttgcccaagctgagagtgcagtgactgttcacaggtgtgaacatcacatgctacagcctcgaactcctggcctcaagtgatcttcctgccccatcctcctgagtagctgggactacaggcatgtgccatcatgcacagctactttccacatctttgataacacttcttattgtctttttactatagccatcttactgagtgaaaagtgataccttattgtggcctaatgactgacaatgttgagcatctttttgtgtgcatattgaccacttgtatatcttctttgaaaaaatgtctattcagaatttttgcctatttttaaattggattgttttttggttacagagttctttgtatattctagatatgagtcccttttcagatattttttattttcttgatgatgtcttttgaagaattgggctttaatgaagttcgtttaatctattttttcttttgttgtttgtgcttttggtgttatatctaagaagtcattaatccaagatcatgaaagatgtatgccttttttttctggtatatagaaattgactttatatgtatgcctccttttttcttttcagagttttatagttttagcttttacatctaggtcttttccgatttttaagcctaagttttttaggttttttttttttgccttgaacagagagagatattactaaatgtcagttttgttttagttttgattgctaatgttttggtgtatttccttctaatgttttcatatacatgtgtacatgctcttatgcatagacatatgtgtgcacatgtgtacacacacacacacacacactttttaaaaccagatggaagttttgttgactctgacttcctgattggaaatgcaagcaactctcacttactacaggaaagagggagtcacagtggaatgtcttattttagaagtagtatataacctttgggaatagtagtataaacagattgtgcattttcagatttttatttttatttttattttttcgagacagagtctcgcactgtcgcccaggctggagtgcagtagcgtgatcttggctcactgcaagctccgcttcccgggttcacgccattctcctgcctcagcctcccgagtagttgggactacaggcacccgccaccaggcctggctaattttttgtatttttagtagagacggggtttcaccgtgttagccaggatggtctcgatcttctgacctcgtgatccacccacttcagcctcccaaagtgctgggattacaggtgtgagccacagtgcctggcccattttcagatttttaaatctcattgtgaacattaaccaaacttgtgttttgtatctatatcaaaatcttctcaaacaaacttactcattcagaatttatgataacttggatgtgctatcccaacatgttttttgtttatttgtttgtagtatctataaattgaactctaggttaaattgcctgaccttggctaggtgtggtggctcatgactgtaacctccacactttggaaggctgaggtgggaagatggcttgagcctaggagttcaaggccagcttgtgcaacatagtgggaccccccatctctacaaataataataattttttaaaattgcttgacccttttttaggtggagatggggtaagattgtatgtgtgtgtatacagttgctcagtaaatatctcttatgaatgttgagtgttgtatgagtattaaatatgtaacagtaggttttaaataatttttcctgttattctcataggtaaaccattcttatcagaccatatgtttatttttctattagaaaatttctgtctttctgtacacacacacacacacacacacacacacacacacacacacacagatccagatattcctcgacttccaatgaggttacattgtaataaacctatcatgagttggaaatttttaggtcaacagtgcacttaatacacctaaccttctgaatgtcatagcttagcctatcctacctaaaacatgctcagaacacttatgttagcctataattgggcaaaatcataaaacacaaagcctgttttataatacagtattggatatctcatgtaatttattgaatactgtactgaaagtgaaaaacaggctgtatgagtacttgaagtattgtttctactgaatgcatattgcttttgcaccattgtaaagtcaaaaaaccataagttgtatcattgttaagttggggaccacctgtatatatgtgtttatatataatatttatatgtacaaatgtatgtttattcgaagacacaaatataattgaatgtttgattatgatatctattgtgggcaaaaatagtaccttaatgtcaacctagaattttcaaagtacattattatgcattattgtcaccctctataaaataggtagatgagaaacagaagtccaaaaaggctaactctcttaccccaatttacacagctaatatatgctggaggtttcatgtgaacccaagtattctgatttttttagaccaagtccttttattctatgatgtccttttgggggaatcaaatcattgattgtgtcaaaataaatctagatgacactattcaactttatagtgactttcttgcctctttccttccttcctttaataagtgtatgaatatgacatatttacatatttggttttttaggtataattaacatttttaaaaggaacagattttagatattcagctcaatgagttttgacagttgtatacacccatgtaatcaccacctaagataatgaacatttcaccccagaaaagtcgttcatgcgtctttccattcagtcccttctcccttaccccatgcaaccacacttctgatttctgtctgaagttttgttgttcttggatttcatgtaaatggagtgcacgagatgcattctttcatggctggcttcttttgtttaacatgttttcagagagtcatccttgtgtgggtatcaggtttgtgtttgttttaaattttgctgagtagtatttcatcgtacgaatttaccacaatttgtttatccatttttctcttgatggatgtttgggtttttgtctgttacaaataaggttgctgtaaacattcttgtacaaatctttttgtcaaccaatattttcatttttcttgggtatctaagaatagaatagagtcgatgtatattcaatttaaaataaactgccagttagttcttagaagtggatggatcattttatagtctcctaagcagtgtacaagtattccagttgttccacatcttcactaatgtttgatatctgtagtgtttttgatagtaatcattgtaggtatgtgaaatagtatcttattgtggtttaaatttgcattcttctgattcctaaagatgttgattatcttttcatgtgtttattggctattcgtatatgtgtgtgtgtgtgtgtgtgtgtgtgaagtatctgttcaagtcttttgcgtacattttattaggtttcatattttttactaattgtaaaagttgtttatacatcatggatacagccctttgtcaaacagatgtgttgtggatatttttttgccagtttgtgacttgtttattacttttattaatgatgtttatagtagtttttaaagaaaaagtaattatgtagttttttggatagatccagaaacttaagggagaataaatttaaatatcttttcaaattaacaaagcagaatattaaaaaatctaaatggactaacctttaggtactttctaatggtctctttggtaagtacctgttcttttttaattgttaaactcgaatcagagattagtgataaacttacctagctgactgcattacctctttcagagagtatatactcctgagtggatggaagtcatgaaactcaaaacttattactcagcaaagtgctaatgttgcaggtgaattttcacaaccctatgcgaacacactttctggagaacacgttctttccctttgtgtcttgctttcagtctgcatagtgctctcaaatgagttagtagtgcacaagacctcggtgaggcagagagcatggttgtgggaatggaatggttatgccgaatgcaaaatctatgacgatctaggtcagtagtcttccaaacctagaatctttcaactctcccatgctttttctcagcttaagcatgtgtctacacacaccacatacacacaccctcccttcatatcggtaaagcaaaaagcccacatgttaggcggagcatttactaatcctgggggccaagatctgtaactagccagctccttatgatgaagaattctatgtcttcctcagcaagccaagcttgtatatctctaaagagtagtttggaaacagctcttccacctctcatccccaggaattagtgtagtccaactttatgcctacatacttatgtgaacacatatagatatgcatacaagttgaaaatccttatatatttatgtcaaaagtggcttatgataggtacacagggattttcattcttgctgtcttagttcattttggctgctattaaaaaataccttcgatggagtaatttataaacaacagaaatttattgctcacaattctggaggctggaagttcaagatcaaggtaccagcagattcagtgtctggtgagggagggcttgctctctgcttccaagatggcaccttgctgctgtgtgcttgcatgtaccttgctgctgtgtgcttgcatgtaccttgctgctgtgtgcttgcatggtaggagagacaaggcagctcccttcaacctcatttataagggcactaatcccattcactagggcagaaccatcatgacttaatcacctcccaaaaggccctacttcttaatactataatgttggatattagttccaacatatgcattgtggggaaacaccaatattcggatcatagcacttcccttaccctagttaggagtatatgtagtgttaatttgtaacaccctcgcatatatcatcactcagcaatgagcacattgcatttatttcttttaaactatcactatcctattttagaaagaaccatagcatttcctattgctttacaaaaatatgaacggttggtggtgtgcaaggctgagtcactgtctgttcctgttcctcttgagtcagtcctagtgacagctagttctgtgacttttactgtttatctggttattttatacgcacatactgtgttcatctggagttgatgtgaccttaaataaattgaagttagattttcatcagtctcgataagggaagactttataatgagttgcttagattggatattttgtggttggagggaaatcatttcaatctataggagacaacagatcaaagaaggaaataaacaaaggacttggcacaagcagggcccagcctccaacctctttgtgaaccttgccccaggggtaggattgagagggcagaaggttgaataggcctaatcctgtatacagcccctcggcctttggcactgtggaggcatggtgacatctcaaaattacatccttttccccgctaacttttgctgtcagctttagttgattttctcattaaaaaattcatatgatataagattaaatggaagttttttattctttccatttctgttatatatgggtaaccctcattcaaaatgagatttgttctcttttatgtatcttttaaactcagttctagaacaaagaaatgacaacagaatactgaaaaatagaaagcatctaagtctgttttagtattaatgtttgtatctcttttaaaaaataggcgggaaatttaagcaattagagaattagaagctaattttggtgatttcatgagtgaaaaaaattcagcaaaggtatgatatagagtggtatgttatctaatgtaagcattagtaacagaagcagcaagatgccaaatttagcaatgtccatttacatttatatagctgtgtatcattgtgatttaatttaaaattttatatatcttagtgtcgattatttcaggtcactagctatatttgattaggttttttgatgttcatatataataagctttttaaaaaaccttgggtccacagtaactaacgccaaccagtttaaaaaatatatttgccaaattaccaaatttaccatgaagaagaatatgcgagagaagacttagtctataaagaagccattgtttctaagaccaggtctgtttcttgttgttgttgcgtagttaatacattcatatgttttgaaatttaaaaggtacaatagagtatgctatgaaaattatttctcccagctattcagtttctctttccaggaggcaatcaatgttttaatctttaagccacttgggttttgagaaacttaggtaaattttgacatatttatgatcaaatgtgtgcctaatattttatgttctgtttttgtcatttggcgtgattttattatcaaatcatattgcccaattaatagcatagaattgtatctacttagctgttttattgggaatttgaatttcttcctgttcaattttgctgctattaaaaatagcaaacattagcatatttgtagaaatacaggtactattttttattgaaaagttactgtatttatgaaattctctatattaaagattatatttactgcaagcagtgcttttcccctttggaaagctgttattaatgatatcatttataatcaatagagtcttagaagaaatatggtatttctctgtatttgtttcgcagagaggaaacacccagttcaagagtttgataacatcatagtccctcattctgagttgcttgatttattaccagtataattgaactaatctcagattttactcccccttccctatccccagtttaatatgtaggatagagagagtggtcaacctcagaatccgaaaaagaacagtgcatatttgccatgtgtgtttccctttaagcattataaacatccagagttttagacaaattattacgttggtacaaaagtaactgcggtttttgcagtctttatctttgctaaaattattcagcgtttctggaaagtatttgccttatgttcctaggcctatcatgaggttttaaaaatgtatactaattactaaaaaaaaaaaaattttaagagataggggtcttgctccattgcccaggctggccttgaactcctgggctcaagtaatcctcctgcctcagtcttgtgagcagctgggactacaggcatgtgtcattgcacttggcttgtatgttaatttttaaaacatatacaaatcattaattgtcagaagttttcctccttcaaacataggcatgaaacaaacttacagatgtgtgccttgctatagtgtcattgattatttgcactcttacttgctagattatatgtgtttataaatgcacatcaattgagttttgtggttatgtcctgtgcgttgttgggatttggtatgtgtgctaggtaactaatcttcaaagcatacaacaattaaggtgtatgtatttttaaaatgtagtcccagctgggtgcagtggctcacgcctgtaatcttagcattttggaaggccaaggcgagtggatcgcttgagcctagcagttcgagatcagcctgggcaacatggtaagacccccatctctacaaaaaatacaaaaattagctgggcgtggtggtgcacgcttgtagtcccagctactcgggaagctgaggtgggaggatcacctgaacctggggaggttgaggttgcagtgagctgttcctgccactgcactccagcctgggtgacagagtgaggccctgtctcaaacaaacaaacacaaacaaaatgtagtcagttatttctttttattgtaccatttttgtaaagtttcagtagaaagcctattacttgtatacttcaaaaaatttgaagcattgttaaaggagtataaatctcaatcaattatttctaaaagagagaaggaagaggaggaggcagctgtggggtgggggtgggggacacggattggagtactcctgcccagcaggatgttataatttactaatgattacaaacatgaaagaccttagtatttatttaaacataatgtccacatttaacacttggcacccagggactgacactgtctggtagtggcaaatttgggggaattagaataaaaatttgtggttctattcatttttaaatctgctttagttaaaacataaagcagatatgcaaccattatttaagatagtctttgcaaccattatttaaacaagagatttcagggaagtagtaaactttttcaattgatttggtctttaatactagctacaggagcaattacttggattatcattttaacataatttttcatgcagcaatccttttgaaagtattgtttgcttagattgaaacattaaagtgcttccttctgcctgcagtacaacagattcaaagagagagaaaggcaggcaaatcaacatgtaaaattgggtcagtacatcgttgggggacctgtgtgccagtggtctggattgtgtcgagttgaggagttagaggaaaccatgagagagagatagcaaattgctgcacctccctgctcgaaggacaaagaggggattaaggccctggggaatccaggacaataagctgtccatgaagagggaaggaatttagtatcagtgctggcaattttgaatattgaaaggagttaaggagtcaggattggaataggggtagttgggggatttatagtcccaaggcaattaggaaaatgggctgagccatgttcctgccccttggaagcgggtctgggagggctttgggttttagataagtgagcaggaatgtgggcaaaggttgagcactgaagtgccattgaaagctgcatgtgaatttttaggtgttctatacctgtggaattacagtgccccagatttcatatttcacatgtgattatatacaatgattataatgatatgaatatcattatgaatattatatgagtatggttatgattacataatataaacagctacagttgaagatgtacaaatgggatttttcatttcatgaaaggagatatatattttatttatttttatatatccatagtcacacacatttttttctttcttacagaaaccaaaaaaaagaagttggtagaagttttgttaaacgttttttttttttctctactagttaacagatttcagatgcaaatatactctcattatccaaattcaaatctctgtcactcaccacaggaatatagaatgtggctttgatcttgagggtgttgtactcatggtaactagatgttccatttctcagctttgccttgaagagtttttctggttttgtcttgaaatgatactgaaatttatctttctaaattcttcccttttgtgtgggtgtagccatgtacctgtatcagagttttgcttaggataatacattttagaattggaactggaggagacttttccccttctgacttaaggcaccaaagtagttttaattgctctacaatccaaggaagcagaagcaagtgggtctgctgccaagaacgcttaccacaaagaggaaaaaaataattgtagctctgaattttagctctggcttgtaaaatatgacagtcttttactatctctttttctttcattgagtaccttgctgccacatctggctccgcttttttttccaaatgggtttattttgttattttgaatatggctggggtgatcctggaaagactggtctgagaaacaatcttgacatttcagctagaaacaaacccagaggtagattgatctgagacagagtttgggaccatccctctgaacctctccagggttggcctaagtgtcaaactgtcattcccccctgaggaaggaagtttcacctccttcttttcaagatagcaagatgtggaggctttgctggattttccttttttacgctgccagtcgggctctgatgtggaatctgcctgtctcttctcccttgcctacaggctggaggctctcaggtcatttttaccaacccattggagatagtgaagattcgtctgcaagtagctggagagatcaccacgggacccagagtcagcgccctgaatgtgctccgggacttgggaatttttggtctgtataaggtgggtaggtttaggttataatgtactcaataaaatatgaaagaatgtggaaaccagacttcttccctccaagttgaaaagcaatcttgtccagcagggtagtctgtggagcagaaaatcaaacaaaaagaaaagaatcaggacacttgtatgagaggcagtgggatacacatgcagcctctcctgttgtcatcaggcttttatgaaactgccagcaaggaggccagcaccgcagacctgctggcctcaggctcacagcctttcatttgctggggggcttgggaaaactttccctggtgctctctttgggttggtttagggcttcaaaatagtcttatgtttattttcggtctgattatctctattgttatcttcccagtgggagcttttgtcttaataatttgaccacagtaaaacagtagtagagtttggtaggattcaggtctttaagaagttaagtggtaggatttgtcaataatgaattccattaaaaaaaaaaaaaacaaaccaacaacagagtgtactgtactttaacaaaatgccagtcaaaagattccttccctgcgggtatacttactcccatcattacagatcagatgtaatggagcagaagctattatttttcttaaacaaggaagaatatttctttccattcctttgcctggtataaggggaatacgtaaatttagccaccatagccaagtgtgtttccacagcatctgatatagatccatcactgcagaaatgtgtaaatttgtttcggtaactgcaaattagaaattagaaattctctagattggaatcacacagctacagggttctctggagaccagcaaacaatgatgcctgtctcaagagagtttcgtacacatttttgcttcctcctccccactcccaatttccatcctttttgaattccctttgagagatgaatttattaatattgcttctctctgtattatcctttagcgagtccttggattttttttttttcaatgtttgagtttgtctttttttaaaaaagccagggctgggagcactggctcacacttgtactctcagcactttgggaggccaaggcagggggattgcttgagcccaggagttcaagaccagccagggcaaaatagcaagaccttgtgtctaccttaaaaaaaaaaaagaaagaaaaaattagccggcacagtggtgcacacctatcatcccagctactcaggaggctgaggtgggaggatcacttgagctcagacggtcaaggctacagcaagctgtgatcctgccactatgctccagcctgggcaacatagtgagaccctgtctcagaaaaaaaaaaaaattaaaaagaataaaacagagtcattaaaaaaacaagcgccaaggtggagtgtttgcctagctaggtagtggaatggtgtgggcttctgacaaagctgagggaggtgttctttgagacctcagtcattgggacaagctgcccctgggtaatgattttctactcctgtggaaacctgccactaaaatattttgtctgctatttaggacatggggaatgaggagagaagatttgggtttcttttccccctgctctagagtagttacttttccttcaccactgcctatagctttttacctggcactgcggggactctcagctgatgtaaaaacttaagagggtagatcttgtgtgtttttaccatagtaagagattaattaattttaaaaactctgaatctatataagaaatgccagaaagttcttagttttcagaatactatcattacccagttattaactctaggactgcaggattcaccatgctttcacaagctttgagatatgcagatttccctattccccacttatctcccgcctcccccatttcccttgcacatcagttctaatgctgtttaagggacacctcaggcttgtcactgagggacacctcaagcttgtcactgacaaatgtcacatggatcccatttgggcattcacactcagtttcacactgttttgcactatttcctcactgtgtgacagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtaactacaaatttttttttaactgaaagaattctcccattatttaaaaagtacagaatctctatgtactttccccctttatttctggaagtattattgtttgtacctgacttagtttaaatatcactttttctcctttgtgggatgtgctgtaattctgatgagagttaattacatttgcataatgtggataaacagcttaatgcagcttagcaactcagagccaaattagatctgcccatctaaattgggctttcatcattaacatgtttcttagtttcctgtgcccctgaaaccttgagtacagccaagctaagcattaaggtgggaaagtttttcctcaaatcagttgcttagctgtatctcatgctcatgcacagatctagcatgctcttactttctctcttctgtatattggaatctacatgatttggccgaaaattgagcttttgtcgtgaagctgtccctcttcttcctaccattgccctcattagaccaaagtaagcagtacccctcagcaaaccaccttgaactcaatttttgtattttttctaatcgttaacactttgtcattagccaggtgtagtggtgcgtgcctgtagtcccagccagctacccgggaggctgaggtgggaggatcacctgagcctgggaggtcaaggctgcggtgagccgagatgacaccactgtactccagcctgggtgacagagtgagagcttgtctcaaaaaaaaaaaaatttgtcttttattaatagttatttgcataattgttatcctctgtactaggctaatagcttcttgagggcaagagtttcattctcttcatccttgcctttcctacgtggccagtgtaatagtaataggtgctcaataaatgtcaataacatgaatgaaaaccttcatgtcgtctaagataccaaattaggcacagaagagatttcatttgaaagaggagccttgtaagagcagggaggtactaagatgcttccttctgacctcataggtacagcctgactcttgagttaggaaggagctgacttggaatagaaggagagaaccaggtgtccttggctgcaccaacactctgaaaagacaaaggaaggaaggggtgcatgtttgctctctatacaaccagtaatgaaccattacagagctcagtgtggctctgaccagccaggcttatgttcactgtgttgctcttccttgctgggctcattctcctctggaggctctggctaaacatcagggcaacctgagcagctcccggagtgtgctgtgcttgttgtgtggtaggagcccttgggcctgagagtgttgcgatggaccacgttgttcttgctcgtgaagacagggatgactttgatcattaagaaacggccccagggaacttaccgcccttatttggggcccagcaagtcctttctcctctagcaatggtaattttagtcagttttgtgtttaaaagccagtaaagttacctgctcagtcttggcagtgagctgtttgtagcagcccctttctggtacttaccagtctcccacttttttttttttggtgagacagaatcttgctctgtcacccaggctggagtgcagtggtacaatctctgctcactgcaacctctgcctcccgggttcaagcgattctcctgtgtcagcctcccaagtagttgggactacaggcgtgtaccaccatgcctggccaatttttgtatttttagtaaagacagggtttcaccatgttggccagcacagctggtcagagccacactgagctctgtaatggttcattactggttgtatagagagcaaacatgcaccccttccttcctttgtcttttcggagtgttggtgcagccaaggacacctggttctctcctccttttccaaatcagctccttcctaactcaagagtcaggctgaggccgagcttggtggctcattcctgtaatcccagcactttgggaggccaaggcgggcagatcacgaggtcaggagatcgagaccatcctggctaacacggtgaaaccccgtctctactaaaaatacaaaaaattagccgggcgtggtggcgggcttctgtagtcccagctactggggaggctgaggcaggagaatggcatgaacctgggaggcggagcttgcagtgagccgagattgtgccactgcactccagcctgggcgacagagtgagactgtctcaaaaaaaaaagagagtcaggctgtaaatgtgaggtctcaaactcctgacctcaggtgatcctcccatcttggccttccaaagtgctgggattacaagcgtgaaccaccacacttggcccagtctcctacttttaaatgggggcagcatttgccttccaggcttttccttgtgctttccaatcaacaatgaaaaacagccagagaagaagagtctaattgtggacaggtgtttgcaagtggttgaaccaagtaaatatttccatggaactgtcagcaccgacttcttccccatagacatttgatgtcagttttcagaatgagattattttttctaatttttaccagtcaagctttgctagcaggaactgagaacattcagaagtctgcctccaaaggcaggaagtttacctagtttcatctgaatagggtgcaaggccatgccaaggggaagtatttgcattattccctagcagaacctcgtacaaggctgccaactccatccgcctagtgaggatacagtgatattcaggccaaattgaatttcttcccccggggaagattattttgctcctttgctctctgttttgttttataagtaaaaggtgtggttgtgaaatccatcttttgtgtcctgctgctgatcaatctcaacatgaccccagggagctcgggcacaggggcctttccctgaccagctcccctgttgtttcttaactggctgcctggccacctcttgctccagttgtaatgacttttgtcatgtaagcatgtctgaaaggagtcacagtcaactctcaaggtagcccttcaaacaagcgagtgattataagtattgatattcacttcccacactacgacaagaatcagcaaaaacagtagtttggtgtcagatacatttagtgactcactaagatgacattatcatttttttatacataaaaatacttgtatcttatttaagaaaaaaaggaggtaaaataattgaaactgaaagggaacgcttgggaattgtcttattaatattgctactttttttttctctctcacagttatttgggatcatgcaatgtagagtgattttttttttaattcaggaaaaaataataataattttcccctgatcacactgcaacagctaataggcttctatgcccttttcccattaatggccagacatctatgtaaagagttttgagttccgctcaagtggttgaagttgcaggctctatagtagatgttagcagtattcctatcttttataaggtactctagataaattaaatgtggttttctcctgaaaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcaggtaggcaggggctggagccatacagaatggctggctggctctagcgtcctcccctgtgactcagtggctatctttaccacatttgtcctggtttcaagtctcccctgcccctgcttctctttttcagctcgagtgtttcgatcctctccccagtttggtgttaccttggtcacttatgaacttctccagcggtggttttacattgattttggaggcctgtaagtcagctgctcaactcctttacaaagaaatcactaagtccaaaacaaatgtttgttctgtctacaaaagcattgttgcaactcttagaaaactgataagacagaacctttaagaccaatgcatttaaaacagtgagcttaagaagcatttgtgttaagcaagtaaaacttgacagagtgacatcgtacataatattaagcagctatttgggggattttagggaagcagcaaatttttttaaaaaagacaggatatcctctgttgcccaggctggagtgcagtggcatgttcttggctcaccgtagcctcaacctcccgggctcaagcgatcctcccacctcagcctcctgagtagctgggaccacagaggcatgccaccacacccagctaatttttgtacttttttatagagatgggatctcactgtgttgcccaggctggtctcgaactccaccagccttggcctcccaaagtgctgggattacagacatgagctaccgtgcctagccaggaggcagcagattaaaatgctgtgtaaataattgtcttttttcacataagcaaatactgaacttcatggcgttctcattatgtggattttattatatggccctttcacagaagtaatgtaaatgtataccagtaacacttttgtgcattttctttcaaagtcccaagcccttttgcatctctgatatttcattattcaccacaatttattattagttaggtgcagatgttcttgaagctaatttactggaaaaaccaataggtttgaagagagattttgcccatggatataatcactagtgagctgtaggccagaaattgggcttctaaaagcttaccacttgaagcttgcactgagaagaagaattacaagttgaattttctgggtggggaagttgtacccaaagcaagcaattattagcttttcagcagaagaccaagtaccattcctgagtcctcacatcagaaacctgtgaactcctctgtgcccaaaggccatatagggaatcagctgctgaaccaagtggagggacctatgcaaaaaaagtgagaacagcagtcttacagttgcattgtagaaatgtgaggcttcaggcttttccatgcttctttcatcttctgtaaaagaactaaagctatttctctctctctcttttttttttttttttttttttagacggagtcttgctctgtcgcccaggctggagtgcagtggtacgatctcggctcactgcaacctccacctcccaggttcaagtgattctcctgcctcagcctcctgagaagctgggactaagggcgcccaccaccgcgcctggctaattttttttttttttaatatttttagtagagacggggtctcaccgtgttagccaggatagccttgatctcctgacctcatgatccgcctgcctcggcctcccaaagttctgggattacaggcgtgagccaccatgcccggcctatctctctttaaataatttaattgataatctttatgagtctactacataaaaagttaacttctaaagttatgtcaaaagaaaaatatatactttaaaaattactttcatatgtgctaagtgcagaaaatttggaaaaccataaagcataaaagaaaaaaaccagcctgggtgtggtggctcacacctcccagtgctctgggaggccaaggcagaaggattccttagaccagaagttcgaaaccagctttggcaacatagcaagaccccatctttacaagaagaaaaaagaaaaaaatcatccataatcttactacccagagagtcttcatatttgagtgtcttttcttctgacttttttcctatggatttgtttatatatgtatgcaagcattggaaataaggccatttctcttgtaaatcaaatatgtagataagttgctgtcaaagcagctataaatcatgactgtggtttctagtcatgcagcacagatgccatggaaatggttgagagaaacattcttctttgtggcacatgggtcagaccgaaaatgtccagctgtaagctgcgctcatccaccttgagcatgctaaccattggctttttttctgtcaacagcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgt

SEQ ID NO: 36392 - DNA, 4695 bp, Homo sapiens
tgggggagcagagggcagcacttcctccagctccaaaagagtgcacccaccccaacgttaccaatacactcgtgcaggtagtggaaggctgtcacaccgcccgtctctctcgtgtcgccgctacgatacctgggcccacacgactctcttcccaaaacaccgaatgagaccttctctcaacgaggccttcactccccgagcctgaaagtaactggactacgctcaggaggcaatgaacaaatggcagaaactcgattggccaatgagagtgcgtccttggcgtgacatgcggtatagcgacccaatcgctgcccggtaataggcggaaagctccgacgccggtgtgcgtctacgctgggggcgtggcctgactgcgcggccagacgccagcgccatggaggagtacgctcgggagccctggtacggcaatgggcacaggcatccggaatattgctgcgacgccaaggccagccgtgggggtcgggcgggggaggcatcggccgcacagagccatgtaccagactcgggggactcttaacgtatctcccgctacccccactcggttcctgtcattcgggctccgttatgaggggccacaaccagagaaggtgcggcgaaggccgaaccacgccatgtttctcctgacttcgtaatctcctagccctgttaacgaaaaaagacacgctggacgatccatcccggctaggggtggtacggtgttgaccggaaatccccagagttgccgccagtggtttttcccaggtcgcctttgtcagtggggggcggggcacggatgaacctgttgagggccggcggggacggtggatgcttcccgcggtcgctcttggtttttcccagttgtgccggattgaaaaggggcggggcatggttggacgggctcaccgtcggagaaggggtgcgacgcggtcctgctttgctgacagtctgtcttggctagttaacacgcctatgtcgcttattgaaacgtcaactctgcgtgtgccaattcatttaatctttgatcacagtaaaaccgttggctgattccttggttggtagacagggcgaagactaatatttctccccctttgccccatttctcgctttaatgggggggtgtgtggaaaaagcgtgacagaactagctcattattatctgaagtgtttgttcctacttaggaacttcccattctggtgacttggtttctcccagttagaaaagagttcgtgtgacaggacctgggggagggctcacattaaccccgtccttcccttcctgcttgcagcccatggcgaattgtggatgattgcggtggagccttcactatgggtgtcatcggtggcggagtcttccaggccatcaagggtttccgcaatgcccctgttgtgagtccaggccttccctgggttggtgtggggttagctatcttgcccacaagggaggctgctctgaaaactgcttggagctgccagtcacgtgcacttattcattctggtgcccactcacctactatgtgccgagcctggctcctgtatctgggattttgtagggattgcaaacatggcctctgtcttccaccctccaccccacccaactggagctcctctgtggaaatgctgtgtcgttcaaagagtcatcaccaaattttaaatgtatgtgcaaagccagacagttttttttttttttgagacagtcttgctctgttgcccaggctagagtgcagtggcacgctcttggctcactgcaacctctgcctcctgggttcaggcaattctcctgtctcagcctcccaagtagctgggactacaggcatgtgccaccagacctgacgaatttttgtaattttagtagaaatggggtttcactatgttggccaggctggccttgaactctggacctcaggtgatccacctacctcggcctcccaaagtgctgggattacaggcgtgtgccactgtgcctggccatgtttttttttttttttttttttttgagacagcatcttgccctgttgcccaggctggcgtgcagtggcctgatcatgggtcactacagcctccgcctcccaggctcaagtgatcctcccacctcagcctcccaagtagctgggaccacaggactgcgccaccatgcccggctaattatttatgtatgtatttatttatttgtagagacggggtttcaacgtgttgcttaggctggtctctaattcctgaactcaagtgatccacccacctcagcctcccaaagtgctgggattacaggtgttagccactgcgcattttacctagaggcagattctggctcagaaacccggatagaggaaaatgacaggaatttaattggcagacggaagacagccttgaagttgagagaattcttttaacataattctttttctctgaccacctcccctcccagaagatcgcaaatgccatgactttaaatgccatctattagccaaggtctctgcaatttatatatgtagccccgtccctcccctagactcctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatatagtaggtacttgttaatcattcactgaatgaatgaatgaacaaatgtatgaatgaattagcacttctcaacctagctctgagaacacccatgttggggcgctctccaggccactagttcttggccacttctccacatctctacagctcatacctctaacaggtctcccatcttcttccctctcttaaaagttggaaacgtgtctgccagtggcttcagccctgccctaacgcccttccttcctttccccagggaattcggcaccggttgagaggtagtgccaatgctgtgaggatccgagccccccagattggaggtgagggacttggggagatagatataggagatgtcttggcaaaggtgggagtggttgatcctttgggtctaggctgcaagttaggggttcagattctagcccctgccagagactttctaggggggtgatgtttcccaacaattgaatatggaggggaagaaagtgggttctggagtttaaatctaggtcctgactgttccctgccatgtgaccttgggctagtggcttaacctctctgaacctcacttgtaccgtgggggtggtgataacagtaaccatttcatcggtagttttatagtttatgtaatttacatactactaagtgctggttgctatgctaaacactttaataacattaactaatttaaaattgcagaagtcaaataacagagcacctcgaacaggtcctggcacacagtaagccctcagtaaacattttaactatcatattaactgggtttcctaacctatttccttctcactgaaacccaaatcagaattccaactctgtgtggtgattatgaagctcaaagttgctctgttaaaagccatatgaagataaatctgcttgtaaacatttgtcaactccccataaagatgaagggaatgttgatggtgattatagacggcttgaagtgggagctaccacaggatggggacagataggaaatactctgtgtgggtttgctatctgcctttgtgtctgggtttttctccctgttcttggccaaagcattcaggccttggaagtcccctgagatgtgaattctcaggatttcccaggaactaattaggcctcggttccactacaggtagcttcgcagtgtgggggggcctgttctccaccattgactgtggcctggtgcggcttcggggcaaggaggatccctggaactctatcaccagtggagcattgaccggggctgtgctggctgcccgcagtgagtgacccctggccctggccccagccccttccaccctgttctgcctgctctcacctctgtttctctgcctccaactcccccaggtggcccactggccatggtgggctcagcaatgatggggggcatcctgttggccctcattgagggcgttggcatcctcctcactcgctacacagcccagcagttccgaaatggtgagtaactggtggtcgggggagtgggaaatactccacctggcctcttccactcatccttacccaagtctcccttctccagcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgcc

SEQ ID NO: 36393 - DNA, 87405 bp, Homo sapiens
gtggctgctcctgggtgtagtgagatgtctccagccagggccaagcagcagcagtagcagcagcagcagtagcagcagcagcagcaacagcagcagcagcagcaacagcagcagcaaagggtctgtgttgctaagaggcttttggtttctttctctcctcctctcacggccaaagaggaggagggtggagggagggaggcgagttggaggggtgagggggtaggagtcgtggatgggggttttcgaagaagaagaaactccttctcctctctcaggctcaatccccctctcagggctcagggctggagggtgggggaaggaactcagccgccttccccccacccccctgaattcaaggttgaagtggggtagaattagtgtcctgtccctttaaaaatagaaataaaaggtgccccccctctgccactgcctctctcttcatcatcagctgctgctgctgctggggtctctctgcttgggggggagggggggttcgggtagaagagacgggaggcactcactgcgcatgtccctctctgacgggtggctggttggttgaaggcaggaggagggggaggggaggaaatgagctattttcccagaaggcgtcgaggcgctagcgacccggaagacattgtagcgggaggtacaggagcgggggcggggaggaggaggaagtcgctacgcttttaacacccccagctccctcctccttcctaagggaaagtggaggaacggaagtgggcgtggacggagacgaaaggaggtcacgtgtttgggcgggagaggggcggggtgggagaggtagtgcgtgcgcggggcatgccgggagtggttgtgtacggtccgcagcggcaggtgaagtctagcagaggacgcggccaggcgattcggtgaagcgattcctgcaggcgttggttcccctctttgacctggtaaatgcaggcttttatgcgagaggtaatggtgggggtaaacttgctgcaaacgaaggccaggggcgtcggtggcgcaaggtgaatcgaaagtgggaggatggaaggctgtggagattgggaattgggaagggggcaggcttgtataggccgggaaggccaggaccaggcgagctccgtcttgtggccactcccgccccgtgagcttgccgaggaatccttgacaagtgcagggatcctgagtctacctctgcatcggggtagtaggtgaggagcgtgacggtccgagtgtaagagagaagggaactgtgaagcctcagcaattgaccctcatgactgcaggacggaggacttctatctagggacagagacaagtcctctgtatgcattttgaccagatgcatcacacgcgttgctcatattggatattgcgcccttcatgccttacctctcaaccctccctggtattctggagtggctttggggaaggagcaggcagggaagtcttgagtggagcttccctccatgtcttgcgttgttgctacaacacaaagcctttgctttttctcggagagggatgtgggattgtgtagtccttaatgttgagttctacgattgatgaaggagaagggacgtgatcaaagtttccccttatagtgtagatgagagttttaaaaggactgttttgtcaagtttctttggttactattcttagtttttgagcctttggtttcccaaatgccagctgtttttgctgaaaataatgaatttctatcataaaattagaattaactcaaaatatttaagaaaggatttataaatttacattagtaaagcttttatagtgaaacagtgctggttctttttcattgttttcatacaatcaatataaagcatcacagtctcaatatgttttgtaaagatattttgaaggaatatcatctttgtatgttttttaaaaaccaagaatctaaaattcttcgtatttattatgttggtacttaattctgttgggtgggttctttttgtttgttttttgttttgagacggagtctcgctctgtctcccagacgagtgcagtggcgcgatctcggctcactgcaacctctgtctcctgggttcaagcagttctcctgcctcaccctcccgagtagctgaaactacaggcatgtgccaccacgcctggctaatttttttgtgttttcagtagggacggggtttcaccatgttggtcaggctggtctcgatctcttgacctcaaatgatcctcccgcctcggcctcccaaagtgctgggattacaggcgtgagccaccgcgcccggccggtgtaggttctttaggtgtacactatcagttaaagttactaattttccacgttttgctttctgtaagtttgggcagtggaccccgtttatgcatcattgcttagcccttagtatcttctgtattgtgtacggtaatcatgtccgatggaatcaaaactagactcctgtgctttaaaattttctttgtagtgtaaccaattgtctgtctttatagtgtaaccaattgtctgccactttgtaatgaaaaaaaaaaataccagcaaggcagttaatgtgccttagctacaattttaaatattttgtgtctttttccatacatttagtatttaagcatacaaacatcgatacatagtataatgaaaaactataaagtgtgaactctatgtaagcgctgccacagtcaagaactagaacgtctgtggcacctgagaagctcccctctccattctattcctgatcatccctttcctcaattcttttcagtggttaacactatactgatttttatggcaatcatttactgctttctttcttagtatttcttaaccacctatgtcagcattcctaagcaatttaggttcgttttgcctgtttcttaattgtatgtaagtggattatatattacatatcattatgtatctttttctctcatgcagctgggatataactctattagtacatttagctctagttcttatattggattgtagtaatctatagtataataagtatagtataaaaagtcttaatggaaatgagccacagtttagtctaatattaataaacatttggattgtgttccgtttttagtagttatgaacaatgctattatgaatgttcttgtacatgtattcttaatgtacattaccatgggtttttgtagagtacgtatgtttatcttcaacttcactagttatgccttttccaaagtagatacaccaatgtataccccgacagcagtatatggtagatccctttacttttactgtctcaccaagagttatttttcctttttcccaacttgatgaatgtggctttatcttattgttgttttaatttattctgcccaggacactaaagagtttgagcactttttcaaaaacttaccggctatttgaatttcctctttctagaattgtctttttaattcttaaatcttttgtgcattgtctttttaaatctttttgggaggtttttttgtttgtttgttttttgttttaattgggttgtctgttttactcagggatttctagcagtatggccaatatcttctctgtgcttggagcattactctcttctgggatggcaacttttatcttcatgtaggtcttataggctgtcattgttctttgaattgtatacgtagtttaaactccagataacaagttctatgcttgtgctattcattgcagtagctactagctgcgtgtggcttttgagcacttgaaatgtggctagtatgactgaggaactgaatttttagttttatttagtgttcaattaagtttaaaaactgacacttgattcagttactgtaaaacctgtatgtttggaacaactcggatacataaacctttcttaaccgcaaattattaaattattattttttaatttttggagattttttcccccctggagatggagtctcgctctgttgcccaggctggagtccagtggcatgatcttggctcactgcaacctccgcctcccaagttcaagtgattctcctgcctcagcctccctagtagctgggattacaagcatgtgccaccacacctggctaatgtttttatttctagtagaggcaaagtttcaccattttggctaggctggtctcaaactcctgacctcaagtgatccacccaccttgggcttccaaagtgatgggatcacagacgtgagccactgcacccggcattagctgcaaattatataaaaatatagatcaagtattttatatggcagttttaatttagcatctgcattgtaatgttgtataaacaccatatttcaaagacagtatgaaaacaatgtaaaatacctcagcttttcattatgattacatgttgaaattataattgatttcaccttgttttcttttagtgtgaacaatagaaaattttaaattacttatgtcacttttactgtattgctgctggacagtactttgagctagatgttcctatgtgtttaccatgtcttaatttcttcctgcgtctctgacttttcttttggaatcttttaacttttactttagcacactcagtagaagtttcataatgcagacattctgatggtcagttctcttaatttttttgctttgtcttaattttttgttttgccttcaatcttgaagaatgttttgggggatattacagatttgtggttgttttacttgtaccttgaagataacatttcactgtttttggttttcattattgattttgagaaatcagctgtcaatgcattaggttggtacaaaagaaattgtggtttgggacagcgaattttaaatcattataacgaggctctaacatatctttattaattaaaataggtcattacaatcaacacatttttgccgacaagaaataagtttgttttttcctgtaatgtaaaaatccatgcttcaggattccacaaactcttggaaagctttttcctgcatcctgctggttgtggaagcattttccctgaaaaaagttgtagagatgcttgaaggagtggtagtcagttgagaggtcaggtgaatatggcagatgaggcaaaactttgtagcccagttcgttcaacttttgaagtgttggttgtgcagtgtgcggttgggtgttactgtggagaattgggccctttctgttgacccatgctggctgcaggcatcacagttttaagtgcatctcattgatttgctgagcatacttctcagatgtaatggtttctccaggattcagaaagctgtagtggatcagaccggcagcagaccagcaaacagttaccatggccttttttggtgcaagtttggctttgggaagtgctttggagcttcttcgcggtccagccactgagctggtcattgcttgtcatataaaatctagtttttgttgcacctcacagtccgattgagaaatggttcgttgttgtggagaataagagaagacaacacttcaaaacggtgtttttttaaatttttgctcagctggtgaggcacccacttatcgagctttttcaccttttcaatttgcttcaaatactgaacaactgtggaatggttgacgttgagttcttacgttgagttcttcagcaacttctcatgtaattgtaagaggatcaatctgcttcaatgattgctctcaattggttgttgtcaacttccagtggcctgccactacactcctcatcctcaaggctctggtatcttttgcaaaacttcttgaaccaccactgcactgtacgttcattagcagttcctgggccaaatgcattgttgatattgcaagttgtctctgctgttttacgacccactttgaacttaaataagaaaatcactcaactttgctttttgtctagcatcatttccatagtccaaaataaatataaacagcaagtaataagtcattagccaaaaaaaaaaagcaagaaatgcccattaaaatgacatataacataaccacatttatttaagaatgtattccaggccgggtgtggtggctcacacctgtaatcccagcactttgggaggctgaggtgggcggatcacgaggtcaggagatcgataccatcctggctaacatggtgagaccctgtctctactaaaaatacaaaaaattagccaggcgtggtggcgggtgcctgtagtcccagctactcagaaggctgaggcaggagaatggtgtgaaccctggaggcagagcttgcagtgagccgagatcgcgccactgcagcccagcctgggcaacagagagagactccatctcaaaaaaaaaaaaaaaaaaaaaaaaattccaatatcaaatggcaaattccaacaatgcaaaaaccacaattaattttgtaccaacctaataattcatgctgctttgaaggaaatctctcttttagaatttttttttgtttgtttctttttttggttgtaatttttctgctgtttcactctaatctttttgtgtggaattcttttcttcttttttttttttctcctagtcaagtgtggttgtgggggtagaggaaatgttcaatcatcgtgtggcattctttatcttgccctgtattcatcgagattattagatcaatgcatcagtatctttttaaagatattggtgatattcttactgtttctggttacctgctgaaaattacaatcttgcttttattggcctagtatagttgctccttagtatctgctggaaattggtttcagaaccccgtgcagataccacaatccacaggcagctcaaattccttatataacatgccatcatgtttgcatacggcctacacacatcctcccacgtattttaaataatctctagattgcttatggtacctaatacaatgtagatgctatgtaaatattgttatactgtcatggctttttaaaaatttctattattttttatagtcgtgtttttaaaaatatacatgtatttttaatccttggttgagtgaatctgtggctatgaagggccgactatattcatagttcatttgttgtttgttgaagataattccagtttctaaattttctaagtctgtgtctgctagcttatgatatttttttcttgtgtgccttgagtaccagttgtatttaaaaaattataggaatatatgagtcctagaataatagtatcttttttaagaaggtacatttttctaggaaaggtctctaggagtgctttcagtcccaagtcactattcatgttcaagagttgggattccttctgttatacacatgacattaaggaagactttaagatcatgaattctattttccttcaatttcctcttatcctaatgatgttgtccttaaactctgaacataaattgggtagtttatctgagtccccagctttgttaggcaatgtgcttttatttttatttttgattttgattttttgtgtttatttttattttaaatgaggtctcgctgtattgcacacaatcatcctgaattcctgggctcaagctatcctcctgccttggcctgtcaaaggataggattacaggcatgagccaccacacctggccttgtgctttgatttttttaccatagaccggcacatcttccattagctcagccttttttctcagccttttcttctagacaggaaaatgtcctcagaacaaaagttacttggtgtatggtttgtttctggtttaccttcacatggaatttggtaagtaatttcacattactttatttcattcattatttagtttttttgttggcgtcagcagaaaggttggtcctgtctgccactaccataaataaaaccctaattgtctttcttttttacttctgagatttgattttaatatatttatgctttgagccaaaatttttttaacttaactcatatatttaaaaattttaatttttaattactatggatacataaaatggggagtatgtgatatttgatataagcatacaatgtgtaatgatcaaatcaggtaattgggatatccattacctcaagtatttgtcatttctttgtgttagggacatttcatttccactcatttaattgttctaaaacatacactaaattattgttagctgtaattactatattgtgctactgaacactatattttattccttctatctaactatatttttctacccattaaccatctcctcttgattctcctctcaacactacccttcccagcctctgctaacatctttttactcactatctctatgacttcaatttttttgaagcttccacatatgggtgagaacatgtgatacttgtctttctatgcctggcttatttcccttataatgtcagtcacatccatattgttgaaaatgacaggatttcattttttttttatggctgaataacattccattgtgtatatgtaccacatttctttatccatccattgattgacagttaggttgattccatatcctggctattgtgtatagtgctgcagttaacatgggagtacagataccttttatatactgatttcctttctcttgggtatatacacagtagtgggattgctggattatagttctatttgttgtgtttttaggaagctccatactgttctctgttgtgactgtgccagtttacatttccaccaacagtgtacaagggttcccctttctccacattctcaccagcatctgatattgactgccttttcgataaaagccattttaactggagtgagttgatacctcattatagttttgatttgtatttctctgattattaataatgtggaacatttttttcatatgcctgtttgccatttgtatgtctttttgagaaatgtctcctcagatcttttgcccattttaaaatcagatttttttttcctattgagtcgtttgagattcttatatattctggttattaatcctttgtcagatattagtttgaaatattttctcccattctacatgttatatcttcattttattgttttcattgctgtgcagaagctttttggcttggagagatctcatttgttgttattttattttattttcttgctttagttgcttgtgtttttgaggtcttatttaagaagtctttgcctagaccaatgtcctggagtttttgcctaatggtttccttgattagtttcatagatgtaagtctttaatgcatttttctttgatttttgtatatggcaagagttggggtctacttttgttgttctgaatgtgggcatccagttttcccaacaccatttattgaagagactgtcctttcccaatgagtgtttttggcaccttagtaaaaaactaattggctttaaatacacagattaatttctggactctctgttctgttgttctacatgtctgtttttatgccactatcgtgctattttggttactatagcgttgtagtatattttgaggtttggtagtgtggtaagtctaccagttaccagctctgttctttttggtcaggattgttttggctatttggggtcttttgtgcttccatacaattttaggattttttttttctatttctgtgaagaatgtcattgctcttgatagggatggctttgaatctgtagattgctgtgggaagtattgtcattttaacaatacaatttttttcaacccatgagcatgggatgtcttttcatttgtttgtgtcctcttcaattaatttcatcaatgtttgatagtttgcattgtagttggttaagtttatttctagatatttaatattatttgtagctattgtaaatgggatcaccttcttgatttctttttcagataggttgtcactgttggcatagagaaattctatggatttttgtgtgttgattttgtattctgcaatgttactgaatttattagttctaatagtcgtttgttggagtctttaggttagtataagatcacatgagctgcaaacaatgataattttacttactcctttccaatttaaatgccctttatttcattctcttgtctgtttactctggctaggacttctgttactaacttgagtaatagtggtgaaagtgcccatccttcttctagatcctagaataaaggctttcagtttttcccccattcagtctgatactaactgtgggtttgttgtgtatggctttatcatgttgagggatgatccttctgtccccagtttgctgagagtttttatgaagggatattgaattttatcaaaaaagatttttttggcatctattgaaatgacaatacactttgtgtccttcattctgttgataccatgtatcacactgattgatttacatatgttgaaccatccttacatccctgggatgaatcccacttgattatgatgatctttttaatgtgctgttgaatttggtttgctgtgttttgttgaagatttttatatctattttcatcagagatactggcctgtagtttcttttttgttgttgttgtatcgttgtctggttttggtatcagaataaatctggggccaggcatggtagctcacgccagtaatcccagaactttgggaggctgaggcaggcagatctcttgaagccaggagtttgagaccagcctggccgacatggtgaaaccccatctctacaaaaaatacaaaaattagctgggcatggtggcttatgcctgtaatcccagctaatctggaggctgaggcaggagaatcgcttgaacccagtaggtggaggttgcagatcacctgggcaacagagtgagactctgtctcaaaaaaaaaaaaaaaaaaaaaaagaataaatctggcctcataaaatgaatttggagatcctccttgattttggagaatgatttgagtaggattgatgttagttcttctttaaatgtttggtagaactcagtgaagccatgaagtcctggccttttctgtgatgggggactttttattattgtttctatcttgaaacttattatgggtctatttcgattttggttttcttaatgtttcattcttcttaggctgtatgtgcctaggaatttattcgtttcttctaggttttacaatttattggcatgcagttgttcaaatggtctccaatgatcctttgaatttttgtgatatcaattgtaatgtctccttttttgtctctgattttatttggatcttcttttttttcttttcttagtctgggtaaaggttcattgattttgtctgtctttccaaacaacccttttcatttcattgatcttttctatttttttgtctcaattttatttctgttttttattatttattttcttgttttctttattatttctcttcttaatttggggcttggcatgctcttgcttttctagttctttaagatgcattactaggttgtttatttcttggttttctactttttgatttgcacatttattgctataaacattccctttagtgttagctttaactgtatctcataagttttagtaggttgtgtttccattttcatttgtttcaagacattttttaatttccttaattacttcattggttgttcaggcacgtattgtttaattcttatatgtttgtatagtttccaaagttccacttgttatttatttctacttttattccattgtggttagaaaatatactttttatcagacttgttttgcggcctaacatgatggtgctctttttggatttctgtttgcatgcaatgtctctttccatcttttggtctatctatgtttttataaatgaagtgggtttcttatatgtagcaggtagtagggccttgttttgtttagcccttcagctcttctgtgtcttttgattggagaatttaggatccatccttgagaaatgttccatgtgctaaggagaagaatgtattctgcggctgttggatgacagcttctgtaaatgtctattaggtccatttaatctatagtgcagattaaattcattgtttctttctgtctagatgatctgtccaatggtgaaagtgggctgttgaagtcccaagtcattactgtattgggttctgtctccttaactctaatacacttgactctatatatctagatgcttctgtgttggatagatatgtatttataatttttatgtcctcttgctgaattaaaaccttttgtattatatgataacctttttttctttcttcatagtttttatgttgaaatctattttatctaaaaatagatacaaagctacttgggctctttttgggtttctgtttggtgcagtatctttttccgtctttttgttgttagtctatgtttttatagtgaagaatttagtccattcacattcagtattattattgataggtaaggacttactactgcctttttattgttgttctggttattttctagggcttttcccccatttttttccttgttttcctttgtgataattattttttggtagtatgttttaatttcttgctttttatttttttgtgcacctattagaggtttttgttttgtggttactatgaggttagcaaataacaatttatagccaattatttgcaactgatgacaactctgattgcaaagaaaagaaaaaatacacgcacagaaaaaactaaaaacctgtacacttctactccatcccttcactttttgactttttgtctctatatatttttatattttaagttttggagtagtttttttttgatagtgttatatagaaagtttcgatgctgcaaaagaaatagcactcgaatacaaaattttctttttaatattcagcaaggcaagctacttctatatagaagggtgcacccttacagatggaacaatggtgagcgcacatttggacaagggatgggaaggggttctaatccctgacgtatgtggcccctgctgctctgtcgttcccctattggctggggttagaccgcacgggctaaactaattccaattggctaatttaaagagaatgacagggtgaatgctttggcgggagtcagggcagagcaggtagcaggtaattggaatgagttagggtggagcaggtgattggaatgttgggtggagcagatgatcagaatgagtcagggtggagtaggtaatcgaaaaaggttgctttacgaggaagttaagtttaaaactagaaggcaaagaattgaacatactgacacactaattctttgaaaagaaatttagaactcatatctaacaatccctccccttgtatttccttacagctttcttttcaaacttttcttaacatgtcttggcttagttgttttgcttgattttctaaaagaagaaggttctctagataaggtagagtttagaactcttctaacaatataggtttgtcttttaatcttcctgctaaagatatgagcggttagagtattctgtatttatctgtgcacttactttcaccagtgagttttataccttcagatgatttcttgttgcttgttaatgtccttttctttcagattgaagaacttccctttagcattttctgaaagatgagtctggtgttgatgaaatccctcagcttttattagtctaggagagtcttcatgtctccctgtttcaaggataatttcggtggatgtattagattggtgcaaaagttaacgtggtttttgccattaaaagtaattacaaaaaccgtggttacttgtgcaccaacctaatactattctactctcttctggcctgccagggtttctgctaaagtttgtcatcctactctcttctggcctgtagcgtttctgctgaagtttgctgccagatgtagtataactccttcatatgaagttacttcttttcttttgccgcttttaggatcctttctttgtcctttacttttgagactttaattattatatgccttaaggtaatcttatttgggttgaatctatttggtgttctttgaccttcttgtacctgtatattcatatctttctctcagtttgaaaagtactctgctattatttctttgaaaacactttctacctcaatctctttctgtaagccctctttaaggccagtaactcttagattatgacttttgggggctattttccagattttgtaggcatacttcattattgttttattattttttctcttctgactgtattttcataaacctgtcttcaagctcactaatttattcttctgctgttgagactgatgcattttcagcttgttgaattttcgagcttcagaatttctgcttgttcatcattttagtctctttgttaagtttctctgatataattctgaattttttatctcttttatcttgaattaaattgagctttctcaagaccgctattttgaatttcccatctaaaaggtcacgtatctttattgctccaggattagtctgtttggtgaggtcctgttttcctagatgttcttgataattgtggatattcattgatgtctaggcatcgaagagctagtcttcacagtttgggtttgttcattcctgtcactctccagggggctttccaggaaatcaaagcagattgagtgttgtgacctaagcctgtagtcactgcagccattttggcattaaggagcatccaaagcacaggaacgctgtgagtcttgcagactcctacatacacagtcctgatggacttgggaagataattgggagaattccctgggttaccaggcagagtctcttgctctctaccttccctttccttcaatcaggagtctttctctgtactggcctgcccagtgttggtggggggtgatacaggcattcctgtagccaccacagttggaactatgctgagttgcctctgaagcattgcagaccagcacagtattggggctcacccaaggtccacggccagtcctgcgtgactgccactggttattcaaggccaaaggccactttagttagcaggtggtgaattctgccaagactgagtccatcccatcatggcagccattcccttcctgcctagggtcaatctataaatgccatcccggagcaaaagcttgctatcaaaagcttcagaaatctgtcttttgctttattttactgtgactgaaccaatactccggttgcaaaacaaagttctgtctactcttccttttccttaccccaagctgaagtagttggggaggggtgcctcagggattcccttagctgccacgggtggtattgcactgggttttatcttaagtccattacctccaaggccagtgcagtaccaaggcttgccaaaggatgcagtccttgtggcctgtcactccaatttattccgggccctagactactttagtcagaatgtgatgaaaaccaattactctccttggggggaggatttctctctggcccaggactaagctaaatgctccttctgtgggcaccagcagaatgccctgtgttgtgttctgctgttacagagcagcactgagttccagcgcaaagtcccatacttactttcgctctctctcccaagcacacagattctatctcagtgctgtgctgcctggggttggaggagggttggtgtagtcagcgcaagactgtctttcctaccctcttcgatgcttctttccttgatattatgttaaaaccaggtgccgtgattactcacctgattttggattttttgtttgtttgttagtgtgtttatttgtttgttttgaggcagggtctcactctgtcacccaggctggagtgcatggcgtgatctcaactcattccagcctcaattgacctcctgggctgaagtgatcctcccacctcagcctcccgagtagctggcactacaggcacatgccaccatgcccagctaattttttcatattttgtaaagacagggtttcatcaggttgcccagactggtcttgaactgagatcaaatgatccactcgccttgaccttccaaagtgctgagattatgggcatgtaccactgtgccagctgattcttatgaaggttgttttttttttttttttttttttttgcatggatagttgttcagtttggtgttcctgctacgggatgattcctgggggattctcttcagcaatcttgttctgcctcctctgcaaggaaaaacaatgtctattttaaatttttcttttttattataatttaagttctgggatacatgtgcagaacatgtaggtttgttacataggtatacacgtgtcattaacctgtcatctacattaggtatttttcctaatgctatccctcccttagcccccccatcccccagcaggccccagtgtgtgatgttgccctccctgtgtccatgtgttctcattgttcagctcccacttatgggaacatgcgttgtttggttttctgttcctgtattagtttgctgagaataatggtttccagcttcatccgtgtccctgcaaaggacatgaactcatccttttttatggcttcatagtattccatggcgtatatgtgccacattttctttatctggtctatcattgaaggacatttggattggttccaagtctttgctattgtgaacagtgctgcaataaacatacgtatgcatgtgtctttatagtagaatgatttataatcctttgggtatatacccagtaatgggattgctgggtcaaatggtatttctggttctagatccttgaggaatcgccacattgtcttccacaatggtttaactaatttatgttcccaccaacagtgtaaaagcgttcctgtttttccacatcctctccagtatctgttgtttcctgactttttaatgatcaccattccagctggcatgagatggtatctcattgtggttttgatttccttttctgtcatgaccagtaatgataagctttttttcacatgtttgttggccacataaatgtcttctcttgagaagtgtctgttcgtatccttttgttgccattgcttttggtgttttagtcatgaaatttttgcccatgcctatgtcctgaatgatattgcctaggttttcttatagagtttttatggttttaggtcttatgttttagtctttaatccatttttgtataaggtgtaaggaagggggggccagtttcagttttctccatatggctagccagttttcccaacaccatttattaaatagggagggaatcctttcccaattgcttgttgtcatcaggtttttcaaagatcagatggttgttgttgatgtatggtgttatttctgaggactctgttctgttccattggtctgtatatctgttttggtaccagtactatgctgctttggttactgtagccttatagtatagtttgaagtcaggtagcgtgatgcctccagctttgttctctttgcttagcattgtcttggcttatgcgggctcttttttggttccatatgaaatttaaagtagttttttttctaattctgtgaagaaagtcagtggtagcttgatgggtttagcattgaatctataaattactttgggcggtgtggccattttcatgatattgatccttcctatccatgcgcatggaatgtttttccatttgtttgtgtcctctcttatttccttgagcagtggtttgtagttctccttgaagcggtccttcacatcccttataagttgtattcctatgtattttattctctttgtaggaattgcgaatgggagttcactcatgacttggctctctgtttgtctattattggtatataggaatgcttgttatttttgcacattgattttgtatcctgacactttgctgaaattgcttatcagctcaaggagattttgggctgagacaacagggttttctaaatatacaatcatgtcatctgcaaacagacaatttgacttcctctcttcctattcaaataccttttatttctttctcttgcctgattgccctggccagaacttccaatactatgttgaataggagtggtgagagagggcatccttttcttgtgccggttttcaaagggaatgcttcctgtttttgcccattcagtgtgatattggccgtgggtttgtcataaatagctcttattattttgagatacgttctatcgattcttagtttattgagagtttttagcatgaaggggtgttgaattttgtcgaaggcgttttctacatctattgagataatcgtggtttttctcattggttctgtttatgtgatggattacatttattgatttgcatatgttgaaccagccttgcatcccagggatgaagccaacttgatcatggtggataaactttttgatgtgctgctggattcagtttgccagcattttattgaggatttttgcattgatgttcatcagggatattggcctggaattttctttttttgttgtgtctctgccagattttggtatcaggatgatgctggactcataaaatgagttagagaggagtccctctttttcttttatttggaatagtttcagaaggaatggtaccagctccgctttgtacctctggtagaatttgtctgtgaatccatctggtcctgggcttttttttggttggtaggctattaattactgcctcaatttcagaacttgctattggtctatttagggattcgacttcttcctggtttagtcttgggatggtgtctgtgtccaggaattcatccatttcttctagattttctagtttatttgtgtagaagtgtttatagtattctctgatggtagtttgtatttctgtgggatcagtggtgatatcccctttatcattttttattgtgtctatttgattcttctctcttttctttattagtctggctagcggtctacctattttgttaaagttttcaaaaaagcagctcctggattcatttatttttttgagggggtttttgtgtctctatctccttcagttctgctctggtcttagttatttcttgtcttctgctggcttttgaatttgtttgctcttgcttctctagtttttttaattgtgatgtaagggtgttggttttagatcttttctgctttcttctgtgggcatttagtgctataaatttccctctacacactgctttagctgtgtctcagagattctggtacattgtgtctttgttctcattggttttaaagaatgtatttatttctgccttaattttgttatttacccagtattcattcaggagcaggttgttcagtttccacatagttgtgcagttttgagtgagtttcttaatcctgagttctaatttgattgcactatggtctgggagactgtttgttatgacttcattcttttgcctttgttgaggagtgttttacttccaattatgtggtcaattttagaataagtgcgatgtggtgctgagaagaatgtatattctgttgatttggggtggagagttctgtagatgtctattaggtccacttggtccatagctgagttcaagtcctgagtgtccttgttaattttctgtcttgttgatctgtctaatattgacagtggggtgttaaagtctcccactgctattgttgtgggggggtctaagtctctttgtaggtctctaagaacttgctttatgaatctgggtgctcccttattgggtgcatatatatttaggatagttagcacttctttttgcattgataactttgtcattatgtaatgtccttctttgtctttttttatctttgttggtttaaagtctgttttatcagagactaggattgcaacccctgctcttttttgctttccatttgcttggtaaatattcctccatccctttattttgaacctttgtgtgtctttgcaagtgaggtgggtctcttgaatatagcacaccgatgggtcttgactctttatccaatttgccagtctgtgtcttttaattgggccagttagcccatttacatttaaggttaatattgttatgtgtgaatttggtactatcattatgatgctagctggttattttgcccgttagttgatgtagtttcttcatagtgtcaatggtctttacaatttggtatgtttttccagtggctgttaccagtttttcctttacatatttagtgcttccttcaggagctcttgtaaggcaggcctggtggtgacaaaatctgtcagcatttgcttgtctataaaggattttatttatccttcacttatgaagcttagtttggctggatatgaaattctgtgttgaaaattcttttctttaagaatgttgactattggcccctactctcttctggcttatagggctcctgcagagagatccgttgttagtctgatgggctttaaatttctaaaataacattcggctctgcagtataagaagccaagttaatgaaattagaaaatatatttaagcagcctgtttcttctctttctctttttcttttaactgttgcaaaggtaaaagaacacatgcttaagtttttaactgcttctccatagcttatgattaaaaacagttcttacttctttgtcacaggttaggttctccagaatattttccttcagattgataccatggtgcaacgaaatgattgggcctttatcgccttatttgcttaatcccaggaaggctgtgatgttggacaaggtagctgtcactaccccagttttccccaaatagagggaaatacttctaaaactttttttggcttattcttttggtatatacttctgtatctctaaataacattttatattgctacctcctgttttttcagttttaggcattatctcttgacttactataggtgatgtagatttagcctttttccacaaacatcccatccattccccccatcttcccattgatagtttaatttttcatatacgaccattgagcatttgtatagttctaaatatttattagtcatttagacccaaactatctgctggttgtcaaaacagcctttccatatattcagaggtatcaagtatttttatcagtttatccatcatcaagaaatttctcccagagcattcttatgtgctgcagttttagcccattgcttgatatagttgctgctggtgcagtctctatcctatgctagttcctctgtttcctatatcctatgtaatcctttggcttgtgtattctcttggtttattccattttctagtagctttctgaaaggcaagtgttctgtggtattatatttatataagtgtctttattttaccccaactattagtttagctggctttcaaattataaaggtgaaattgttcttaagagctttgaaggaattcatagcatctgttgtaaaattagaagcccttcttacttccatcactcttcagatcacttttgtctcctctgtggaagattatacgatctcattttgaaacttatcaaatgtttctctttgttgtatctagagttctgaaatgtcacagccatgttacttattatgagtctatagtctttcattttgccatgcattttatgggtcctttcagtctgacaatttgtgtccatcaactctgggaaaattcctcatgttttttctttaattttcttgcctttgtttttggttctggaactctaattaaacattctacctcctggacctattttttttctgtcattttttatgttttttttttcttcatactttctggaaaatttacctttttcaaacttttgagactttgatttctgctatcatacttttaatttccaaggccttttttgatctctgtataattttcttattatatcctgttatgttttctttttatgaattaaaattattgtttggttttgaaatttattgcttcctgctttctctactttttccaaattattctttctgttaatatgttttcatctttttaatcgaggctttcctcagctatgtagcaatcattgattgcatgttcaaatttatgttagattcattagaaagctattttagagctctgtgaatatggctgggcattttgtgggtggaaacccctggtgtcattatctttaagtttggaaaccttttttctagggttaataagagtctaataagaagagttctccaagcttctgcctttaggtcagtgattctcaagtgggacaatttggccccctaagagaaatttagcagtgtctagagacttatttgattgccacagataggttgctcctgaaaactgatgcatagaatctgggggtcttgttacatcctacagtgcataggacagctccaacaacgaagaacaatcaagtttaaaatgttatcctgagaaaccctgctttagggtataagtctgattgccagtagtatgagaactatgtgaaagaagagagctagggggcctcaacgttcaatatataaacactctcttaatcctctcctccccctcaaaacctttttgtctgataccctcaccttctgctgtgtcttgtgtcctcagggtagatttcttctgtcttaccctgtgtagaaaataagcctcatggcctctgatgaagtgggttagaggcttctgtttaatttgagccatgttagcactgcaagtcttttagaaatggttttctcattgaattctagcccaaattaaaagaccagttatttagtgaacttgttgtatgtttatattatttagagtattagctgacgagactggatggctttgtatattttactaaatgcataagtagaaaaataagacatgagttgaagattataaaccaaaaggtagatgaaacctggaattgacagctgttcccatcctttcatttctgttttattctctcttttcattcctgatcttgctcaaagcactgatcttaaacatgctttggggttgctaccttttcctaatctctttttaacctttatcttatattctcccatatctctcctcacctccaataaaacataacaaattcttagtcctatactacttttttgattaataggggaattgagaatagtgtgaaattttgacctgccttagtctgttttgtattgctataaaagaatacctaagactgggtaatttataaagatatgaggttttatagctcacagttctgcagactgagaagttcaagagcatagacctggcttctggcaagatctttcatacttcacaacacggtggacaaggtcaaaggagaaaaagaaacattcaaagagaggaaaatctgaggagtgcatagtggccttataacaacccactcttgtgggaaggaactaagccattcgccagagaactaatccagtctcatgagagccagaacacactaactccagaatagcactgagccatttatgaggcatctacccgtagaacccagacacctccctctaggcctcacctttcaatattgccacgctggggttcaaatttccacattagctttggtggtgataaagaaaccaaatccaaattatagcatgaccaaagtgaggtcagactttttcaagaattaagttctgatctgttggcttttcacttgcacattttcactttctcctttgtttcttttttgtattgtttacaaaaatatctaatacagataacccagacatgtcagtcttaaatgcactcttaatatgaccacttgtatggtttgtttatgtctcagtcaacttactttataatgagtaaataccaaaactattttccctaaaaagctgggtttcagctaatatccattagactttggtgtttttttaattatgtccagcatgttataccaacactgctgcaatatctggtgagcatcatgtttttaaaattttatgttaaaacacattttatgtttgtaacatgtttaaaagttaaaatagaattttagcatcataatttacacttagaaatttatatattcaaattgtaaagtacaagatttgatttaaatgtgcaagaaaatttttaaagttacaaacataatatacattcagtataaaagtgattaaaaaatgaaaattacctataacctttgcacccagaaataattccaagatgctaatatgtgtaatattagtctttttaagctatgtttttatacatttaatggcagcatgagatcatagagctttgtcatgtactttgagaagaaataatcatagataacatgttttcattatattaaatacttacaaaataacaatatgtttgtttgctttatattgcaagagtctcttctcaaccattaggaattatgctcttgaatagtgtgatgattggtgttgacaaagaaagataagatataaaaaattttcttactttggtatataaatgttcttgaaatgtcttatttctttaaaaacgacaaacatatgaataaattcattctttgttttgtacattctatggattttgataaatatataatgatccattattacagtatcattcagaataatttaattgccctaaaaatctcatgttccatacttctcttttcttgacaaccactgatcttttagtgaaaagatcactaaaacatctatttctgtagttttgcctattccagaatatcatatagttggaaacatacagtaggtagtctcttcagattggcttctttcacttagcagtatacatctaagtttccttcatgtcttttcatggctttatttcttttacatgctgagtaagattccattgtatggatgtaccacagttggtttatccattcacatattgaaggacactcttgcttacttccaagttttggcaattataaataaaactgctgtaaacaggaaggtacaggtctttgtgtggacctgtcttcaactcatttgggtgtaaccagggtacatgattgctagattatgtaaaacaaatatgtttagttttataagaagctgccaaactgttttccaaagtgtctgtgccattttgcttttccatgagccatgaatgagagttcccattgctctaccttctcactagtatttggtattgtcattgttttggatttagccattgtaataggtgtgcaatggtatctcattgtttgattatgtaattccctattgacatatgatgttgagcatcttttcatatgcttatttgccacctctgtatcttatttggtgagatgtttatttggatgccaattttaaactgggttatttccttgttgagttctttgtatattttgtgtaacaaaataagtgtttttcacatattttatccccatgtgtattttgtgttttaattttcttagtagtgccatttggtagagcagaagtttttaattttaatgaagtctaaatcaattttttattttctttcatggattgtactttcggtgttgtatctaaaaacacatggccataaccaaggtcacctagattttcttttgtgttacatttttggaattttgtttgtttgtttgtttgttttttgagatggagtctcactctgtcaccaggcttgagtgcagtggcacaatcttggctcactacaacttccacctcccgggttcaagtggttctcctgcctcagcctcccaagtagctggaactacaggcacacaccaccatgcccagctaatttttgaatttttagtagagacggggtttcaccacattggccaggatggtctcggatctcttgacctcatggtccaccagcctctgcctcccaaagcactgggattacaggcgtaagccaccgcacctggcctgttttttgttttttttttttttgagatggagtcttgctctgtcgcccaggctggagtgcaatggcgtgatctcggctcactgcaacctctgcctcctgggttcaagcgattctcctgcttcagcttcccgatgtgtctggaatttattccttccattgggttcttcgtctcgctgacttcaagaatgaagccgcagaccctcgcagtgaatgttaaagctcttaaagatggtgtgtctggagtttgtttgttcagatgttcagatgtgtccggagtttcttccttccattgggttcgtggtctcgctaacttcgggagtgaagcagcggaccttcgcagtgagtgttacagctcttaaaggtggcgcgtctggagttgtttgttcctcccagtgggtttgtgtcttgctcacttgaggaatgaagccgcagaccctcctggtgagtgttacagctcataaaggcagtgcggacccaaagagtgagcagcagcaagatctattgtgaagagcgaaagaacaaagcttccacagcgtggaaggggaccccagcaggttgccactgctgactcgggtggccagcttttattcccttatttggccccacgcacatcctgctgattggtccatgccaacttttattcccttatttggccccacacacatcctgctgattggtccattttacagagcgctgagtggtgcgtttttacacagtgctgattggtgcatttacaatcctttagctagaccagagtgctgattggtgcatttacaatactttagacacagagtgctgattggtgcgtttttatagagtgctgattggtgcatttacaatcctttagctagacacagaatgctgagtggtgcatttttacagagtgctgattggtgcatttacagtcctttagacacagagcgctgattggtgcgtttttatagagtgctgattggtgcatttacaatcctttaatccacagagcgctgagtggtgcgtttttttattgagtgctgattggtgcatttacagtcctctagctagacagaaaagttgtccaagtccccactcgacccaggaagtccagctggcttcacctgtcaccaagtagctgggattacaggagcctgccacaatgcccagctaatttttgtatttttagtagagacagggtttcaccatgttggtcgggctggtttcgaactcctgacctcaggtgatccacctgccttggtgtcccagagtgctgggattagaggcgtgagccactgtgctcggccatttttggagttttatagttttgcattttatatttaggtctgtgatccatttttagattttttgtgtgtgaaacttgtaaggtctgtgtcaattcatgttttggcatgtgtatgtctagtttttccattaccatttgttgcaaagattgttcttttctccattgaattgcctttgcttattcgtaaaagaccagctgactatgtttatgtgggcctatttctgggctctgttttgttcccttgatttgtctgttctttcaccattatcacactgtattgattagtatagttttataatgtcttgaagttgggtaggttttgtcctccaactttgttctccttcggtatcgtgttggttctcctgggtctttctgtgtatactttaaaatcagtttgtcatatccacaaaataactatccagaattttgattgggattgcattgaatttatagatcaaggttggaagaactgacatttaacaatacgaatttttttctactcttgaatgatctcatttatttagactttctttgatttcttgaatcagagttttatagtgatcctcatagagatcttgtacatattttgttagatttatatctacatttttggtgaatgttttttgttgttgttgctaatgtatatggtattattttaatttctaatttcagttgttcattactgatacataggaaggaagttgacaatttgtatattaaccttgtatcctgcaacctttctacagtagtttattagttccagtgattttgttgttattttgggattttctacgtgcataatcatagcatactattgggacaaagaatgatgagaaaaggtatataaagaatgataaaaatataataaaacagtgtatttgagcctatttcttcatagttgatcatcaattattgtcccattgatagccttttaactttggggagtaaaagggattgcagaaaaggatgaaggtagggtaccaaagttctaagccatataatgctgtcttttttaagcccccaaccccctaatttttagctctccttttcccacccaaaaagcacaactgtctaaaaatcctatttcattgtaaatgtcaactgacatttccatttatccttgcaagattacctaagcatgctgatggggggatggacaacatattcattagcaaaacagaattggagaatatcgtttcgttgactctagaatttagtctcctgtgctttttgcataagctgaagggtctcattagaaacaatgtattattcctaaaagtttttagggaaaattttaagatttttctaggataatttctagggtaatttctagcaattcttaaataatttatctctaaagcaatgttattttcagttttttttccttccaaaaatagtttaatatttactaattaacttactggagttgtagcatattgtaggggccaagaaaaaacttccctttcagcctctgaaggttctttgaaaatcagctgaaaaaaggcagattaataggagaaagggcatatgattttatttgatcttggtgttacgtgacatgggagccttcagaataaagacctaaagatataggagaaaactgcccattggtatgcttaggttcagcaaagtctggacagccatatactgagtggggaaacccagcaaggcctgcctgtctgtatagattcttcttggcctctctgtgcagcattctttccttccgggtatggaacagcaccctttctggaatggggatcctatgacctacaatcaaacagaataggtcagatatgtctttatagttagtttttacacagaaagatgagggcagggaacattagagtaatatatttaggttctgtggctggctttggggaaagggagttctggtttctgtggactaccttggggacgagggatggtagtttcagtggctagcctcaggagaatgagaggccagagacaggaagttaggagatggtcagagagagctgctttggaggactttattttggagtatcatttccttagccctagcagtatcatacttacatttaagtaaactcaagtctgtaaacgtggcaaaggaaaaatttatttgaatagtggacagtattctattcattattcttctcaaatgaacatataccctgaagtaattgatattgcaagaaagtacagttctgtaatttatgtgtagtttggggcttttcaaggaaaatttgtctacatgtgccttctcacccaccaattttagtgccctagtcttaaatcttgtgtcccatataatgcaaccatccttcacaaaaatgatatttttgtcaggggcagtacctcacacttgtaatcccagctatttaggaggctgagtcaggaggattgcttgaggccaggagttcatgacttcagtgagctattatcgtgccactgccctagttgacagagggaagccccatctcttaaaccaaaaacaaaaaaaagttttcgttgattcaagtgtctgtcgcccttatactatttatccatccaattaaacacattagcttggattcacaagcttaaatcctgaaggtagcctacttccatgtgctcagagaacatagactactgttgatcactataatatttaagatgtagttatgtcagtgccagtaagatcatataatgcatttccaaagcttctaaaggatttctaaatacgttgcaaatttgtgttagttcttttgttagcctatataattcagaagtaaatgcattttaagacgtatactttaaagaagtcctccaactagtatttcttttttattcattcatcaacactactgcagaattgatactttgtatcatttacaaggtgtattccatggttaataatcaaaacaactgtagtaatgtctttttttcattttgtgagacggagtcttgctctgtcttgccctggttggagtgcagtggtgcaatctccgcttactgcagcctccgcctccccggttcaagcgattctcctgtctcagcttcccgagtatctgggattacaggtacgcaccacgacacctggctaattttgtatttttagtagagacggggtttcaccatgttgtctagtctggtctcaaactcctgaactcaggtgatccacccgcctcagcctcccaaagtgctgggattacaggtgtgagccaccatgcccggccaactgtagtaatttctaaatgtctttctttactgaacatatcatagtattaactctctgattatccttctgggggttgtttatttcataactatttacctcccatgttcttgaaaacaactttattggcttattcatgaatatcaaggctctaataggtactttataaagtaagtacacttattaaaagatatatatgtatggggtgcagtggctcacgcctgtaatcccagcagcactttgggaggctgaggtgggcggatcaccaggtcaggagttcgagaccagcctggccaatatggtgaaaccccatctctactaaaaatacaaaaattagccgagcgtggtggcgcatgcctgtaatcccagctactcaggaggctgaggcaggagaatcgcttgaaccctggaggtggaggttgcagtgagctgagatggtgccactgcactccagccaggcgacagagtgaaagtccagctcaaaaaaaaaaaaaaaagatatatatgtatatacgtttatattcatatgtgtgtatatatatgtatgtgtggttgtgtgtgtctgtgtatatatgattccagacatactgccatgtactagtgaagattactgaaattcagaggttagagagaacatggcttttctggagaattgcaagccttttcaattatttaatcagtttaagtaccaagacattataaaatatttttcttcattttaatatcaatgagaaaatatcatggcatcatattacttaactaaaggttatcaaaccttggaatcatttaatctgaatgtgtccttaagtaaattgtgtccttttaatattcactggcaacaaatgaggaggaaaaaaagattttacaaaactgtcagtaattaccatggtttattcacctgtggtccaaaagttgatttgtgtggaattattcttcagctctggagaactcaaggaaacatctcaccagaggctgtgccccaacttgatatagatagcatttttgagctgatctctttaggaagaactaacagagtttacttattttctaacttggaatatatatcagtattggcccttatttctccccacactcaaccattcttttaactctattttaatctttacctctgtacaaacaatccaactgggggagaaaaaagaatgaaaactaattctgatggactgaaaaacagcttaaatgtatttttcttgcctcagtttcatctcaaaggacagtaacaaaacatggaaaccaccttcaaatttctcctaaaatacctttcattttacgttatttgactgtttagctagcaaatcaagaacattttatcgaactgaagagaggcaaagttctgaaattttgtccatacttacctatctttgagaaatgtcagccgtgtgaagttaggtcctaggtaaacagtaatagaatttgtattttaacttttttctaataaagggagtggggtagtggtattgttttcggtgttttcttctgccaccatctggaaagaaagcagtattaaacatctttttaatttactaagagttcttttcacaaagtaatgcccccatctgctggagctgtaaggttttgcctcaaagtaagggtattagagaaaataatacatgatcatttgtgtatttttgaattatattttctagtctcatccactaattttaccaaggtttttgtaggagttgttagccaatttcatcttctcttgatgtgttagttcttattccaaactaagaaaaacttgatataaattagtgttcttggaaagtggtgcatggtttttgtttcttgttgttgttgttcctattgttgttgtttttgagatgagtctcgccctattgccctggtgggagtgcagtgttggcgatcttggctcactgcaacctccgcctcctgggttcaagcagttctcctgcctcaagtctcctgagtagctgggattacaggcacgtgccaccacacctggctaatttttgtatttttagtagagatggagtttcaccatgttggccaggctcgtctcaaactcctgacctcaagtgatctgcccacctcagtctcccaaagtgctggtataacaggtgtgagccactgcgcccagccgaaaagtggtatgtttttatatttttaacaaatgggtatgagaaaacaaaaaatgctcagaacagtctgagctctgaggtatgcaggcccagagagatgtgagtagtatgggacttcagttatgcccccatactccaccccaactccctaccccctgccactctgtagccaatggatagtttgttattttaatgtagattcttggtgaacaactcagagcgtgcctttttatttttctttttctctttaaaaatctacttgttactgctgctaatgagcatattcagggcaacttgaatttatgctccttggttgcaaccctcaagcttggctcaaatgaactctctatgtatgttattaattttgcctcaacttctttccttttaggtcaacacatataaaacttacattatttacagaaatatttgtgaatagaataaaaagttatgtttataaatgttttaagtgtatagatatgagaatttttataggtaacacctaatttttggctataaaatcagtgttggaaacattttcaaaatgccctataacacaaatttcttctaaaaagcagtttctttcctacttttattttaaaattccagatgaagtaaatcttttttttttttttgctttttgttttttatttactaagcagcatgctgttgacaggcagccatttttcattccaggaaaaagctgcagttggaacagctgagattatttcacttacattttaaaaataataacatctttaaattcagcaagtgaggctgggcgtggtgattcaggcctgtaatcccaactgaggccaaggtgggtggatcacttgaggtcaggagttcgagaccagcctggccaacatggtgaaacccccatctctactaaaaatgcaaaaattagccaggcatggtggcacatgcctgtaatcccagctcctatctcctgaggcaggagaatagcttgaacccaggaggcggaggttgcagtgagccaagattgcaaccttgcactcccaccagggcgacagagcgagattctgtctcaaaaaaaaaaaaaaattcagtaagtcagctggattcagtaatgtctccaaactggattcatatacctacattgtgtattaatgagctgacagtaaatgaatatgtgatggtgccactcggaaccccttcttgttattgatcttgaactcttccctttccttagggcgtctgggttgagtaacatgacttgacctgctgatacagagaccaagtaaaatttgtcaatgtatatattaaatattagttaagtttaatttagctcttattttttggatagatatttataggtaaacatattacaatactttcttttttttttttttttgagacagagtctcgctctgttgcccaggctggagtgcagtggctctatcttggctcactgcaagctccgcctcccgggttcacaccattctcctgcctaagcctcccaagtagctgggactataggcgccggccaccacacctggctaattttttgtatttttagtagagatggggtttcatcatgttagccaggatggtctcgatctcctcacctcatgatctgcccgcctcggcctcccaaagtgctgggattacaggtgggagccactgtgcccagcctacaatactttcttattccagagggttattttgcaccagccaccttactgaccatttatatgaaagataggaaaaattgtttgttgttacctctttgacctgtgcttggacaactttgaaactaaataaatcggacatgttcacacctgttttctccttaaatgcttttttttgggtacacagtgttacagctcctggcgtcgtaattactagtaagatgctcataatactagagtacttttgattatccagctgaggtacatggttctttttcttaaacaatttgatccactaattcttatttttgttttttaccttatggtagctgtagaaaaaataatttaaaatatgttactttttgtgtgtgtgtgtgtgtgtgtatatatatacacacacacacacacatatatatatctatatatggaaagttcttgttcttttaaatgacaaatattatgaaatagagcccattttggttgaaaaagtatgtgtgtgtgtaggcaggccacatttttaacctaataaaaattataggaattgctggactttagatatttattaaacccaagagatttttttttttttaaagatctcaatcttaggttaaaaaaagtttcaagctgctcaaggtgttgacccagctacttaggaggctgagacggaaggatctcttgagcccaggaattcaaatccagcttgtgcaatacagtgagaccctgggtctaaaaaaaaaatagttttaagttccttttttacacttcatgttttaagtttagacattttctttctactctgaagaatgaaattagcaaccgtatgcattcatgccacttttttttcatttttttgttgaatgattattttcactgtgtaacgacttatgtttccacctgctactataattatttacctttttttggttttagttttttattttagtggattcaaaggtcactagtgtgtgtgtgtgtgtgtgtgtgtatgtgtgtgtgtgtctgtataaaattgtgtttttaattatgctttagttggctggattttgtcattgagttccccatatcctcctgcaacacacacactccacacaaggctttattggctctgtgtactaaataagttcattcttatttgataaggctatacctgttacctttatatgtgagtgacatctttgctaggtatgagtcttggtctctctctcagaactttgtagatattatgacaccatattttagcatttttttctcccttgtaggtgtttttcaggctgagtcccagtgaattcttttttttaggcttgaaatttaataattgaattacagtttttatcagttttcttcttttcatatttgatacattgatgagagtttaggagattttattgatgcaagtatagcttttaagagtgaggttaaagttaggaactatggagaactcctgtagaattttctaggcttgtttattattaacttgtctctttgtttagttactgctaaagtatttctgtttaacagttttttgttttgttttattagaggagaaagattctctgattccattttttaccattttatctgcacaattcctaattaaaattccagagtttctgtacgaaacatgtattcctttttagcgatgggaagaaagtttatgatcttaaaaataaagatgtgtacagaaaaaaatacaaattgtacacatagacattcaaagagaagtgaattgttggtattgaacatctgttataataaccgtgttctttcagaatgtattcctctgctatgttttgtctcctaaagaaaagcccagtgatgattttgatgaactttctgatgtttgcagggttttttttcatgccagttgagactaaccaacctctgattgggagtcaatagacctaacagctactgctgctgttaagtaagctatgtcatcttgggcaggtcattgtataccattgctagtcagcaagcagagaggtatttggtaaattgaccaaacttcaaatttgacatgaaggactgtcaccaggagttcatccaggttgcttctcccacaaagtttaggattatgttagtctaaaaaacagtgattagaactaacctaagatgaggagcttaagttagttgtgcaaactaaatggagggcttttatgttctatttctaaggtaggaaaacatttgacatctgaatggctattgagctatatgtaggaataagttgttagtgtcagctattttctaattctgtctttagatgttaagagagtttactaaggctgggcacggtggctcacgcctgtaatcccagcaccttgggaggccgaggcaggcggatcacgaggtcaggaaatcgagactatcctggctaacatggtgaaaccccgtctctactaaaaatacaaaaaattagccgggcatggtggcaggcgcctgtagtcccagctactcaggaggctgagggaggagaatggtgtgaacccgggaggtggagcttgcagtgagccgagatagcgccactgcactccagcctgggcaacagagcgagactctgtctcaaaaaaacaaaaaaacaaaaaaaacagagagtttactgaatagttatcattattgttggccaaacagagttagtctaaaatacattatgcagaatcagtgtggtagacaaagaggctctgagtgagggtttggatctgaggaaggcatcatgagaaagaagagttataagtactcatgaaacctcaagagcagtaaaggatgtacttcataatttttagaatttatcaacaagcaacccttggaaagcataggaatggagaattacaataaataagccacctcagttgaaaaatgggagtatgaatatacatgtgattgagtcttgagattatttagtcatcctgctttagttagcatgtaactataaaatttcaaatacagatacagtaagtagtggtcagtgaatatatttcagaattcatcccttcctttgtaaaggtatagattgtaggggacttactgtcatggggaaatgcacataggcaatttagagagcagacagctttagatgacacatttttacaattcctataatttttgtcctttgtcaatacagaagtaaatttaaaatggtcagtagctctctgatgtatagtagtgctctggaactgcagtaatgagaatttcctccatacgcagttgactcttgaacaatgtaagggttaggggtcgaaacaccccctccctaccaaaagcagttgaaaatctgcatataacttttgcctccccaaaaacttaactgttaatagcctacttgactggaagccttgctggtaacatagtcaattaatatatattttatgtatgtattatatattgtattattataataaagtaaggtaaagaaaagatatttagaaaatatatctactatatatagaaaatatatttactattcattaagttgaagtggctcattgtaaaggtctgcatcctacttgtcttcctgttgagtaggctgaggaggaagaggaggggttgatcttgttgcctaggggtagaagaggtggaggaggtagaaggggagacaagacaggttaggcacactgggtgtaactaaacaggtaatttctgtctatctcttttggtttctaatttcttttaaaatgtttctatacagtatcaacccttcctcaaccatttgctttgattccagtacctgtatcatagaagggtccatgtcgtaaaagaagtcaagagtagtcttgtatattcagaaccgttctgccagattgtctaatgtcagtttgttttctggcactgttctgcatctttctcactgtctggcagtggttcagaagcatctatctccaccttgtcttctgttaattcctctggtgtggtatctgttagctcttgaatttctctaagacccatatgttgaaacacatcactccccaccctttttgccgtgtctacaatctctttcatgattttcttgattggctttgtagtaaatcctgtgaagtcatgcacaacatctggacatagatttcttcagcagaaatttgtttcagtcttgttggctttcatggctttttctatgacaacagggcatcttcaatgggataatcctcccagactttcatcatgttctgtctgtggaggtttttccatagtgttgacattcgtttccatagagttctgtgtgtaatgaaccttaaaggtccctatgaccccctgatctacaggctgaattagagagtttgtgtttggggaccagtggaccacttggacaaaagccttcggtgttgaactcatgggattctgggtagccaggggcattgtccaatatcagaagaacttcaaaaggcagtcccttactgtctgggtacttcctgacttcagtgacaaagcatcagtggaactaattcattaaccccattggctcattgagtgaatcggttccagtgttttgactattacgaataaatttatcatgaacatacgtgttacaggtttttgtgtgaacataagtttttctgtcaggtaagtacccaagagtgcaattgctatgtggcttggtaagagtatttgtagttttctaagaaactgctgtcaagaaacttttcagagtagccatgccattatacattcccaccagtggttaaatgaaagattcattttctttacatcctcaccatctttgtgttattttagctgccttaatcagtgtgtggtggtatcttactatggttttactttgcattttcctagcggataatgatattaaacatctttgcatatgcttatttgccacctgcatatctttggtgaaatgtctacttatgtattttgcctattttctaatgggattccttttttattattgagtgttgagggttctttagatacagatcttttgtcagatatgtggtttgcaggtattttctcccagtctgaagcttgtctcatctgtactattagaattgtctttgaaatattctttattatatagtagatatttgaccattacatgaagggggaagatgtcaaaataacctttggactaaaactttatttacagtcaaaatttatgtaggttataaggtagataccatagtggcatgtttgttgtttcttttatgaatgctggccccacatgaagaaaaaatgaattatcttaatagcttacctgatttatatatgatgcaaaggggcagattagatacctgccttggaactgtggacatttatttagcttttttgagtaattctttcttaattcatgaagtgggtaaaaaatatcttttaattctaacaatactgtaagatagctaatgtagttctacaaaataaaacatactgcaaaagccctttctcctttttacattttaattagtcttataatctaggagacaattattacatagttctttgtgattttagattttggctgatagtcaagagcatcataaaccagagttgaggatattttattagctaaaaaggtttttccctctcataacactgattaggaaaaataaaaaatagaataagataaaactttagatataaaagactgctagaaggtatcctaagacagctgagaagaccacttttcttctaagaaagaagatgcttaagggtcaagacaataattgagtactctgttatttaattttcaattaggaagcctggagccagaggacttttggtggctgaggccttagctacctggcttacacattaaggaggacacagatttgcttgctgtctgtctgtcaaggcctggctcagctaaggacctgttaacatttctagagaagaaaacagcattaccatggtttgctttctaattgtcactatatgaaattaataaatgtgaatgtaaaatatattggctgatcttccttcaggttattgaaatgtgtttgtacttcttttttcaaaaaagtttgctaaatacgtaacaatttcataagagtacaacttatttgggttcaaatcattcaaatcctggctctgcacttacttgctttttgatgtatattttatatgttttttttctaattgatgaataaaaatcttatccatttatggtatacagcataatgttttaatataggtatacattgtggaatgacaaaattaagcctattaatatatctgttacctcacataccatttttttgtagtaagaaaatttaaaatctgctttcattctatgagttcccctgttagaggttccacctattgtagtccctcccttatcctcagtttcactttccattgtttcagttacttttggtcagctgaagttccaaaatattaaatggaaaactccagaaataaataattcatgagttttaaattgcatgccactctgagtaatgtgatgaaatcttgcagtgtcctgctctgtcttgcctgggacatacataatttcttcgtccagcgtatccatgctgtgtattgcatgtgtcccataatcactcagtagccatctaggttatcagattaaaagaacatagtatatagagagagttgggtactatccatgatttcagacatgcgaggggcgccttggaattcatctcccatggataaggagagactactgtataaattagattatgtggtgtttgtctttctgtgcctggcttatttcagctaacagaatatctcccaaatgcatctatgttgctgcaaatgacaggatttcttttttgtttaaggctgagttagtgttctattgtgtatatataccacatcttctttatcttttcatccattgatggacacttaggttgattccgtattttggctgtgaataatgctggagtgtatatgggagtgaggatatatctttgacatattgatttcatttcctttgtatatattgatggatattcaggagtgggattaccggtcatgtaatttgacttctaattttttcaagaacctccatactgttttccataatgattatactaatttacatttttaccaacagtgtacaagagtttcctttcttcataatcctcaacaacactcatcatcttttgcctttttttgacaatagccttcctagcaggtgtgaaatgttatctcattgtggttttgtttgtacttccctgaaaatccctgacaattagtaacactgagaattttctcaaatacctatttgacatttttatgtcctgtgagaaatctttttgaccattttttaaattgggttgtttccttgctattaagttttttttgttgttgtttttgtttttgttttttttagttccttatacagtcatccctctgtatccacgggaaactggttccaggactcccctgagataccaaaatctgtagatgctcaagtcctttctataaattggcatggtattagcgtataacctacacatatcccatattctttaaatcatcactagattacttataatttctaatacaatgtaagtgctttgtaaatagctattataatgtattgtttttaaaatttatattaatttttattgttgcattttttttcccctctaaattttctctctcttaagttggttgaatctgctgatgaggagcgactacatattttggattttaacctgttagcagatgtaagatttgcaaatagtttcacttattctgaaggttgtctcttcactctgttgattgaagctttttagttttatgtctgttttcattattcttgcttctgcttttggagtcatatcccaaaaaaatctttgccgagtccagtgtcaaaaagctttccccctgtgttttcttcccctatgtttcaggtcttatgtttgtctttaatccatttttagttgatctttgtatatggtgtgcaataagggttcaatttcattcttctgcctgtggatatccagttttcctaacaccatttcttgaagagactgtccttactccgttgtgtgttcttggcacttttgttgaacataagtcaactgtaaaagtatggatttatttctcgactctgtattctggggtctgtatgtttgtttttatgccagaaccatgttgttttgaattatcttagttttgcactaggtattgaaatcaggtagtctgatacctccagcattgttctttagctcatgattgtcttagctattaaatgtctctgtgggtccatatgaattttaggatttttttctatttctatgaaaaatgtcattagaattttgatatggattactttgaaccttcacttccagtagtagggacattttaataacattgattctttcagtccatgaacatggagtatatttccatttatttgtgtcttcactttctttcatcaatattgtatagttttcagtgacagacctttcacctcttttgttacatttctttctaatttgtttttgatgctattgtaattaggactggtttttaattttatcaaatagttattagtgtggagaaatcttattgatttttttatgttgattttgtatcctgccactttactgtatgtattagtactaacagttttttggtagagtcttaaggattttctctatataaaattatgttatctgcaaacagaccatttaactttctcttttttgatttggatgccttttatttattttttcttacctaattcctctggctaggacttgcagtactatattgaatataaatggccaaagtgggcattcttgtcatgttcttgatcttagagggaaagcttccaactttttacctttggggtgtgatgttagctgtgagtttgttatatatggcctttattgtgttgaagtatattccttttatacctaatatattgacagtttttaaacctgaaggaatattgaattctgttagaagctttttctgtatctgttgagtcagtcatgtgatttttgtccttcattctgttaatgcattatatcacatttatagatttacatatgttgaaccgtctttgcattccaaagataaatcccacttgatcatggtaattgatctaatgtactgttgaattagatttgccagtatttgttgaggatttttgcacctatattcatcaaggatattggcctgctaccgaaactgttcaccaagaggcctgggaaaattcatgcacactggtacctcagaaaataagtccactgtcctcagtcccaactgcggaccctgataagacactttaacttggctatggtctgagatcagttcaaggacccacaagaagacaaaactgtctgaatccctgggtcaagctttctgaacttggtcctgcattaaatactgaaacagccctgaagctcagctcctgccactgttggttgcagcctgagagcaaccctgcctgcacaaggaactgctaggagactcacctgtctgtgccatcagtacagacttgccaatctctgtcccatagcatatgctgaaaaagctctgaatcggggattcagctccactcagccacagtcttacagaaatcctgcacagaaatcctcctgtagtcaggagatacatccttctgtgtcctcaggacaggcaggcagatttcagtcccacagcaggtcctgaaacaaccctgaatcttggcataagcccctctcagctgtggtcagagagcagttctgcctacccagcatcctggagggagatggggctgtccatagccctgcaaacaggccacctgacctaggtccctcatcagtccctgaaacacccctgaaaagtggctccagcccctctcaatacagcaggcccgctaacttaaggacctgaagggagacatgcaggtttgtgacaccttaggcctgaagacctaagtcttgactgtaggccctgaagcaaccctgtagcttagttccagccccactcagctgtggactagggcagtactgcctgttaaggaatctactcagtgatccagtaggagccctcccaggttcccagagaaagccaaaccatccacacacctggtaacaggtcttttctctgcatatcttcatccactgtacagaccgaggtcctagaaaaagtccagtccgccaagggaccagatagggttcatatcctgctacagcccctggtaacaaggtcctatcgggaggacagggccctttccaagtctgaagcctggaccacagttggggaatctgtcacgtgaatgaagatctgccctccaattgacttttccaggtcttgggccccactggggtttcacagacgcctgcctgaatctcaacgctaacacaaagaccattttgtccgtgggtggctgtgaaattattgttgctatttggggacacaagctgaagggcctcctatttcatcttgctgctgtcattctcgcattattataatgttaatcattggtgatttgatgataagtcagctttttttgagttttatgagttctggcagtaaaaaagttccaaaatgtctttcactgagctaaattcagggtgttagcaaagctgtgttccttctggagattagatgagaccagaatacacttttttaaaaaagtggttaacttggttggatccaaatcctggctcttccatttatatactgtttgattttggtcaacatacctagcctatctgtgtcttctaaccttaaaagaggattataatagtagttattccacatgatagttttgaggattaaatgagttgataaatgcaaagcatttgtaacaattcctgatacctaaacactgcttaagctgttactgtctatctgttaaaatttattcctataggaaatcagtgctaagaaaattaggtcttttagtcaaaggtcttttagtcatttgtctatgagtatggtacacttgaggagaattttacaaaaaatataattttttcattaatttttttttcattccagttattcattgccaactttgttttgggcattatgctacaatgcttagaatataaaaaatctcaatttggaaacagtagcaattaaacagacaattttgtttaaaataattcaataataaagcaaaatacaggcacttatgagtgtttaaggaagaggcatttaacctagtctgtaatgattatttgtgtattgttggtgagtggagcaagaaagggaaggttttctataagggatgatcctgtgggatggatgggtgggagaatcataaaggaagcatgtaagttaaaaaaagaaaaaggaagaaagggaaggtgaatagaagatttaatcgaaagggaggagtagctgtaagaaccacatacaggcctggaggtattgtaggttcagttccagaccattgcagtgaagcaaatatcacaataaagtgaatcacccaaaacttttctcagtgcatataaaatttatatttacagtatactagtctactaagtgtgcagtagtagcatgtctaaaaaatgtacataccttaatttgaaaataccttattgctaaaaaatgctgacagacacaaaatggggacatggtgtttgaaaaatggtgcctatcgacttgttggacacagagttgctacaaaccttcagtttactttaaaaaaaaaatgcaccatctgcaaagcacagtaaaacaaagtgtgcctaaagtgtggtatgagagtgttgaatcagcctgtacttagacaaaatgaagccatcgaagattttgaaggtcttagggtttgagcattttttacttttaaaaacttgtatttattttaattctagaacagtaaattcttaagtaatctctttaagtcactacgtttataatatttatgccaatttttttaaaggatttgaatttgttgaaatgagcagtcgtaaatcaaagagtaacagcttaattcacacagagtgcctttcacaggttagtatgtattttcattaatctcaagatattttaccctgtaaagctgttcagagaaatagttatcttcttaacctgaattttccctttagcatttaggaagaatcactctttctaaccttagggagatatcagtacgagaccttaacgagatgccagcacaaggtcgtaagaacaatcatctggaagcaaaattttccaaactctgtcaaaattaaatgtggaccaacagattttgttgttatgattgttctctgccctttttgtcagttcatatattttttttaatattagtgttttatactgtaatttaattttatccttattaagtctgggtagtcagaattctagcttttacttttttctttccaatctagatgcctttttttttttttcccttttcttgcctaattgccctggcttgaactttctttaaaatgttgaataggattgggaagaatggacattcttgtctatgttttcatcttagagaaacagcagcattcagtctgtcactgttatatatgatgttaactgtaggatttttttgtagatgccctttattaagttgaggaagttccgttacgtttcctcatctgttgagtgtttttataatgaatgttataagaagtgtatattgtattccaagtgctgagcatctatctgtatgtctcttccttaagaagcttatagattagtagggaaatgagcatggtatttctaccctggcatttgtatttatctagcttgacctgaactccatgtagtttttaaataaaaattaagtgttactggtattcttttatacgacttggctttctttttgaaggaagtagtttaactctctttctaaaaaaatttttaactgaaatatgctttacatacctttgtatgtaaagtgcacgaatcctccatgtacagctgacttaatatcaatacatgtgtatacctatttaacttctatgccagatcactttgagatttgtgaaccttctgactagtcactgtagctttatctagcttatattttataccccgttactgcctctaagatattttaatgaggttttctgggtttttttttttttttttttaaggaaaagattgagttttttcttttgatctcatctaggtagaggaatacacattatgattagttgaggcatatatatgttcttttatgtatttttacagatattagctattacctgtacaaagcctatttgtgttacaaataattgccttttttaaacctttttttttttttgagaccaagtcttgctctgttgccccagctggagtgcagtggtgcagtcttggctcactgcaacctctgcctcctgggttcaagcaattctcctgcctcagcctcccaagtagctggtattacaggcatccaccaccacgtctggctaatttttgaatttttattagagaagggatttcaaccatgttggccaggctggtcttgaactcctaacctcaagcgatctgcccatctcgacctcccaaagtgttgggattacagacgtgagccacagcggccagcccccttttttaatctttcaaacaggcctgccataagatgttattgtccctattttatagatacagaaattaaaatttagaacagacttaaccttttaaaattcatataatagactcttctggagccaatgtccttactctttaacttcctcgataatgaacaagtatgtattgttttgtccctaatgaatcattttctttgctttgcctctgtacatggaacaagaactcagatttacttctttggtacatgaaggattagttccatgctgtcagtctaggagaagcaaatattcttggagcctttttattccagttcatggggccaaatctgagatagcaccctcaggttgttgtccttgaaagacctctgtattagctgcagatccaaaaaaggaacgactttaatggtccatctttttaaagagtatggtagattatctgacataatttttcatgactaagtctaaggccttagttctaagatgacctcaaaatatagctgcttacaagaattcttttcttaactcgttcacatgcattacaatggcccttaagttgctaatatagctaaagtcagtgattctccctcttgttgaaaccttcacaactaaattctcattcttcctatgggacttgagataggtaagaaatccattaattttttaacatatgaaaatggtgccagaactctagaggataagaatttagggagggttgaattgattcattaatacctaattctgactattgtaaatgtgctttcttatttattttttatatcatgtgtaatatttttatttatatttattcactttattttcatcaggtacaaagaattttacgtgaaagattttgtcgtcagagtccacatagtaacctatttggagtgcaagtacaatacaagtaagtctagctgtcctcttgactgttatggacctacttacagatgccttccaggttttgcaaaaattattgtacaaatttgatattaaataaagctaacaaacacttttatagaaataaaaaattttgctttgtgaatagaaacaccacatagcatgaagcaggagcagatacaaatatttccataatgcaatagcactttaactttcaattttgttttgtttctgttatctgatactgtggagagaattctagccatcttgcccttaatacccagcagccagctatggagtaaaagtccagagtattagtaggaaaagagatttgaatccaagggtcccgagagttgccactattgtcccttgtcccctactatcgtataaatcaatatattccaatctgactacgttttcacctgaagatttcagagaatcaatactgccctactatttcttttgtatttttctatttaggaccattcagaagctaggccaagtacccagagggagagaagagaggaaatttctgtgcatattcaaatatgccttttaaaaactacaacataacaaagtattccagcttcatttttaaaattttgtcctatttatatcattttagacacttaagtgagctgctgaaaagaactgctctccatggagagagtaactctgtccttattatcggaccccgaggatcaggaaaaactatggtaaaagctgttgatttctggtgtttgttggcatgtgatgattcttattttatataagaataaataaattcatatataaatcttattttatgtaatactgaaaatacttttcattattttgtaatgttttacttttttgtttttttcttttttaatcacagaagacatgtaaaactttataaacttagggtggtatatttgagtgtagcagacctttttcccccttatttgtcctcctagtgaaaaattgtcaattgatgtttgttccaacatggtcttttgtccttaaagaagtagagatttccagtggaaaaagaaaatagcatgtattgagcatgtactatgtgtctttttattgtgttctctcatttattctttacatcaacactgcacggtagggtttttccctttgttataggttagggaactatcatatcatgcattctttttatttttcctacatcattactatttgtttaaccctaacttacacagtttttcagtgcatgctcacatcttatatcattcttgtctccttttgctctttatcatatttgcttagttacctcaaaaagatattcttacttatttccctttactcttttctttgatatcctttatgcaatataggagacaaattatgggtgttaacttttgaaagcaattaatttcaatgctaagtagtctgtgtaaaatctgttctcatgtattatatacaataaatttcaatttttgaccaatgtactttaaaaaaatggatgagaagcaaaattttttttaacatttaagcaatgtatattgaaattacattattaagatgagtacgttaggattttactgttatcacatctgaagtattgtttaatataaattgagaatttagatctaggtaatttctttcaatatttcacaaattgtcacatttatatataatcatatttgcagtaattttttagtttcaaatctatgtttaatttgttttagtcctcatactcagcttctataatcactatttcttcattcttgagttttttattatggtttttctttgcatttgaattcactgttattttgggtagttttcacaagagggctatgtgaaatgtttttaaatttcaaatttttaaatttttaaatttaagaaactttttattttaaccattctaataggtatatattggtgtctcattgtttgtacttgtaattctctaatgacatatgctgttgagcatcttttcatacacttctttttcatctatatatgtttggtgaggtgtcttatgcccatttttaatttgggttatttgttttcttattgataggttttaggagtcctttatatttctgattttcagttttgttttgcaagtattttcttacagtctgtggcttttcttttcatactattaatattatttcataatattaaaagaatattattcttttcatactattaataataacattgtctttggcagagcagaagatttcatttatttatttatttatttttgagatgggatgttgctatgtcttttcatactattaactgtatctttggtagagtagtttttatttatttattttacttacttacttacaagaatagggtcttgctctttcacccaggccggagtgcagtggcatgatcacagctcactgtagccttggcctcttgtgctcaagcagtcctcccacctcagcctcctgagtacatgggactgcaagcatgcaccatcacacctggctaattttttttttttaattttgtgtagagacgaggtctccccatgtttcccaggctggtcctgaaccctgagctcaagcaatcctgccttagctttccaaagtgctgggattacagacatgagccactgtgcccaactgaagtctttgatcttaataatctaatttgtcagttttttctatcatgtattatgattttggtattgtatctgaagcttcatcaccaaaccgaaagtcatgtagattttttcctatgtatcttctacaagctttatagttttgcattttatatataggtctgtgattcattttgagttaatttttgtgaaagatgtaaggtctgtgtttagattcgtttttttttcttttttttttttgcaaatgaatgcccaattggagaaagactatcttttatccattgaattgcctttgcttctttgtcaaagatcagttgactatgtttatgtggttctgtttttaggttctctttctattcccttgctttgtctgtcttttgccaatatcacattgttttgattactgtagatttttagtgagtctttaaggtaagtactgtcagtcttctgacctcgttcttctgcagtattgtgttggctgtctgcatactttgccttttcatattaactttagaatcactttgtacatatccagaaaattctgggaatctttgtgaattgctagattttgagttaaatttatacatcacaataggaagaatggacatcttaactatatttagtcttcccgttcttggagtatctatttatttaagacttttgtcagtttttgtagttttcttaataaagatcttacacatgtttcgttagatttatacctaatttttcatttttttggttctagtgcgaatagtactgtgttttttatttccttttctaagtcttcattgctagtagatagctaaacacttggcttttctatatttgcttgtattctgcaaccttgctataattgcttctcaattccattagtttttttgtcagttctttgagatttttttacttagacagttatgttatctgtcaacaaagacagttttaattattccttccctatctccatacttctattccttttcttcttttattgcattagttattcatagactatgtctaacagttaatcataaaattcactaatactctgcatactgatttagtataaatttagagggtattgttcactaaagaataatattcttttatttttgaatattctttcattttttcttatgattagaaaaaatgaatatccaatattagaatattcagttcttaaatctttgttttcatttttccatgtctaccatctttttcatgttttttccccctctctcagcattctgtcatatggccaatgtgattttctttactgccagtgctgtcatttgcttcttctaatctgatattgcatttcagttttctaagaatcttttcttcttgtctaagtctggcttaaatagctcaaaacatttatttcataaaatagtcattttaggtagtaattaacctttttatactttatttttaaattgactcataataattatacactttcatgggatatatagtgatgttttgatgcatatagtgtatagtgatcaaatcagaataattagcatatcaatcatctcaaacatttatcatttatttatgtggggaacatccagtatccttcttctagctattggaaaatattattgttaattatagtcatcctatagttacagaaaaatgatagtacaacactgttacttactcctcctatcttgctgtaattttgtgttcattattgaatctctcactatccctcctttcctcctacccttcctaccctatcctctcttctacttttgacttctgtaagacctacttttcttggcttccatagatgagtgaaaacgcatggtgtttaactttcttttcctggcttatttcatttaatataacttcttccagttccatctatgttgctgtgaatgacagaatttcatttctttttttaatggctgaacagtattccattgtgtgtatatacacatattctttatccattcatctgttgttggacaactaggttgatccatatcatggctattgtgaatagtacaacaataaatacgggctgcagatgtctctctgatgtaatgatttccgttcctttatataaattctcagtagtgtgattgctggaccatatggtagttctatttgtagtggtttttggggaacctttgtactgttttcaatattggctagtttacattcccaccaatggtgtataaaagttccttttttttgcatcttcaccagcatttattattttttgtttttctgaaaatagacatcctaactggagtgagatgatacctcactgtggtttctatttgcatttccctgatgattgatgatgttaagcatttcttcatgtattcgttggctatatgtatgtcctttcagaaatgtctgttcagataatttgcctgttttttaagcaaattggttttttgcttttgagatactggagttccttgtgtaatctggatatgaatccctatgagatgaatactttgcagatattttcatttattctgtagattgtcttttcatgctgttgattgtttcccttgctatgcagaagcttttgagtttgatgttagcagatttgtctatttttttatgttgtctgtgatttgcagtttttattcataagatattttcctagactagtgtcctgaagtattacccctatgttttcttctagtagttttatagtttcaggtcttaacattgaggtctttgatctattatgaaatgatttttgtacaggatgagagatgggaatctagtttaattcttctgcatatccagttttctcagcaccatttattgaagaaattgccctttccctgatgagtgagtgttcttggcctttgtaaaaatcagttggctgttgataagcagattaatttctgggttctctattctgttctattggtctacatgtctgtttttatgccagtaccatgctgttttggttactacagctttgtagtatatttgaagtaaggcagtatgttgactccagccttattccttgtgctcaagattgctttagcgatttggcatcttttgttgtttcatatgaattttaggattttttttctatctctgtgaagaatatcattagtgttatgataggaatatcattgaaactgtagattgcttctggtaatatagtaattttaacaatattcattctttctatcatgtgagtatgggtgtcttttcatttgtgtgtatcctcctcaatttctttcttcagtgctttgtagttttccttgtacaaaactgtacctttcacctccttaattgaatttattcctcagtaattacgtttttttggtagctcttataaatgggattgccttcttgatttttttttttcgggtagtttgttgttagtatatacaaacagtactggttattgtatattgattttgtagccttcaactttactgaaattctaagagttttttggtagagtctctaggtttttctatatataagattatgtcatctgcaaaaaggaatgaattgacttcttcctttcccattgctttggcttgaacatctagtactatattgaataagaatggggagagtgaacatccttgtattgttccagttcttacaggagaaacttttagtttttccccatttggtgtgatgttggttttgggtttgtcatatatggcctttactgtgttgtggtgttttttttctatacctttttgacagtttctatcatgaagggatgttgaattttatcacgtgtttttttctgcatccattgagatgatatagtttctggcctccattctattgatgtggtgtatgatgtttattgatttgcgtatattaaaccatccttgcatccctgggataaatcccacttgatcatggtgaatgatctttttgcattcagcttactaatactttattgaagacttttgcatctatattcatcagagatgttgacctgtagtttttgttgctgttttgtccttgtctagttttgatgtcagggttatgctggcctcatagaacgaattaggaagaattttctctgcttgaattttttggaatagttttagaagaattggcattaattccttaagggtttagtagaattcagcagcaaagccatccagtactggattttcctttgttggaagactttttattcctgattctacctcattatttgttattggtctctccaggttttctgtgtcttcttgcttcaatattgaaaggttgtatgtgtccaggaacttaaccatttcctttaggttttgtaatttattgatgtatagttcttcatagtagtccctaatgatcctttttatttctgtgatattcagtttgatgtctcctttttcttttctcatttatttattttggtctttcttagtctagctaagcaacttttgtttcagtgattttttgtagtattgttttagtctcaattttgtttattccttctctgatatttatttcctttgactaatttggggtttggtttgttcttttctagctctttggaatacattgttagattttttaatttaaaatttttctaattttttggattgcattgttagattctttatttgaaatttttctagttttttgatgtaggcatatattgatataaacttgcctcttaattctgcttttgctgtgtgttccttaagttttagtaagttgtgtttctattttcttttgtttctaggaatctgtaatattcttaatttcttttgcccattgttcatgggcatgttgtctaatttccatatttttgtatagtttttaatgttcctgtcattattattactttttaaaaaaaatatagaccaggtctccctattttgcccaggctggtctcaaactcctgggctcaagggatcctcccaccttggcgtctcaaagtgttggggttacaggtgtgagctaccacacctagccagttgtttttattatcgatatctagttttattccattgtggccagatcagatacttgataggattttgctttttttaaaaaaatgttttaagacttctgttgtgtcctaacatgaggtcagtcttggagaatcttctgtgtgctgatgagaagaatgtacattctgcagttgttgggtgaaatgttctatagatgtattttaggtccatttggtctatggtgaagttcaaattcaatgtctctttgttgattttctgtctaaattatctgtccaatgctgagaatagggtgttgaagttcctattattttattgcaatttatctctctttagatctaataatacttgctttatacatctgagtgtttcagtgttgggtacatttatatgtacaactgttatattctgttgttgaattgatccttttattattatataatgttctttgtttttacaactttcttatcacttttattttccattttcataggatatctttttcatacctttaagtctgtgtgtctatacaggtgaggtgagtttcttgtagcagcatataattgagtttttttttttatctgttctgtattttttaaatgggaaacttaattggtttatattcaagattattattgataagtgaggacttaccctgtcattttagtgattgttttctggttgtttcatatatcctttgtttcttacttcctctcatttatttttccagttgggtgcctctctgtagtgataaggcttgatcctttctctttctcctttatgtatccgcagtaccagtgagttttatagttttccctgttttcatgatggtggtcatcatctttgcatttgtggatgttagactcccttgaacatttcttataggtctggtctagtgatgacggattgctttagtttttgcttgtctgtgaaagattttatttctcctttatttctgaagctgctgggtattatattcttagctgacagttctttcattctgagctttgattgtatcatcccattcccctctgtcctgtcaggtttctcttaagaaatctgctgttgtatattctgacaatcagctaaaatgtaaacaagaaggatgaaagatgttttaaaatatcatttaaaaaaatgatagtttaaaatttttaattaaaaaaaagaaatctgctataaagaagaagaaatctactgttagtataatagggattcccttatagtgacttgacactttacttttgctgctttaattatttgtctgtgacttttaacaatttgactataatatgcctcagagaagaccttctgtttgtgttgagtctgtttggagttttgagcttcctttggatgtccattcctctctcaagaactgggaagttttcaactatggttttattaaatatgtttttctcaccttttccttcttttctcctcctgaaagtacaataatacaaatatttgttcacttattgaagtcttataaatcctgtagactttcttcattctattttttttcttgtctgcctgtgttatttcaaacaatttgtcttcaatttaagaaatgcttatgcttgatgtagtctgttattgaaggtctcagttgtattttctatttcattcattaacttcttcagctgtaggatttctgtttgtttttttatggtatctctgttaatttcttattcgaatcacaagttgtttttctgattttgttcaattttctatctgtattcttttgaatttcactgagtgttgtcaagattattattttaaattcttctggcattttctgtatttctttatgattcttgtctgttactagaggaattattgttttcctttggaagtgtcatgttttcttgcttttttatgtttaatgtgtccctatgttgattgatacgcctcaggtagaaaagtaaaattgtcttttccaatcttacagaattgatctcgtaaggaagtactgatttgtgtcaatgtgtctcgaggtgtcagtttgatgtggttcattggccttggttctagttggatacagtagtgtggtctttgtgtagttttttcagctgtaatccacactagtgtcatttacaagtgtctcagtggcctaggctgagagttgtttgtggtggcagttgtacagctttgcaaggggtgggtttgctgggctggttctcagtttgggggcatatgcatgcatatggtgggtcaatcaccttgggatctgacacactggcagatggggctattaatgtggccaggagcatagtcatgtggttgcttagccagtcttggtgaatgtttgccaggaacaactcactggtttgtttctcaggcccaggagatgcctgggatccaggtgcaaggctgcttgatcccaacagaggtgtagggatacagttcctcgactggcttagggccgtatctgctgaggggttccacaggattgtttctcaggtttaggatgcaggcacaaggctattcagctggcttatgggcatgcccactagaggcgtcctgtgaggctgtttctcaggcctgtgacactgctgcttggctggcctgggaacttttctgcagcagatggcccactggaccattttgtagacctgggaagtaggagcagggttgctcgactggcccaaaagagtgtctgccagaggcaaccctcagggctgatttgtaggcctaaggtgtaatgctgctcagccagctagggtaatgtgtctgttaggggcagttggcaagtgtacttctcaggttagcgacgtgggcacatgattgcttggctggtcctggggcatgtctgatggagttatagggaggctgtgctgtttgtcaggtttgggaggtgagcacaagactgcttggcaggctcaagaatggcctgaagggctacttctcaggcctagtatgtgttcacagggatgcttggccaccctgtgggaggtgtattcaccatgggtggcccatagggctgtttctcaggtacaggtcatggctcatggctgctcggctgggctgggggcatgcctgccaggggtaaccttctgggctatttttcaggctctgattgtgggcacaggaccactgggcaagctaggggtatgtctgcgggagggaggggtgcacggtattgtggggctgtttctcaggttctgagtgtgggtgcatagccgctctgccagtgcaaggggtgtatcagctgcttggatgctcgggggcctctccttcttgggagagagccccaccctggtttggtcacctcaagtgagagtttgccctgggtgggactgccagattggttctctggctggaagtgtggcagcaaggggttggtttccttgctgtgtaggaccagagtcataaccaattataggctcagtctctgtgcagctagagttgtgtgttcagccacctatgtgggcttggtggaatgaagatggacccctagtactggaaaggtgcagtgactactggcccacagagcggggcgcacaacagaggtggctctggcctcaatggtgccatgctgcagcagggcaggttggcctacaggtgggtgagggttggagagtgcataccttattctcatgatctggagcaatgcaactgcttgaattcccagcagctgtccaccttgacttagggcttgctaggactatgggattctcctgtggtaaggactgtaggtgtttgtgatggcggtgaggactggtggggatcttctgcttaccttttccccagaacgggaagtccctcctgactacgggaagatttgatcggggtgcaggagatgtagctgcagaggccaggtgcctacacactaccctcctggattttcagtcactacacatttccccttccctgctgcactccagtactctcccttcaacacgccagtcaaatcttagctgttcattcattgctgtggtcctttcttgttgggagtacgagcaccaggagtctctaatcagccatcttgcttaatattttaaatctgaacttaatctttttaatctgcttgttgttcccttccacgttatagcaccttttcataaacccctataggtttaatcaatgtactgaaatttaaaggcaaaagcattaaatcatagtatttatcagttaataaaatggatcagttattcttggccacactgacagtttatctactttttgctttttaaaccagagccctattgtggtgccttgcagtcatttattttcactatagtggaatctggaagagtcccttgcatggcattccattttgatatagtttcatatattcctgatgtactctgatgctggcaggttgaagagatgagcattgtttgacttgtgctacttttgtaatttgttgtatgtgtgggagtatcctgagagaaaatatagattgaataaattgtcagatataatttatttttagacaataactctcgatagtataatttttttctttttcttttctttttttttttttctttgacagagtctcactctgttgcccaggctggagtgcagtggcacgatctagactcactgcaacctctgcctcgcgggctcaagcaatcctcccacatttgcctcccgagtagctgggacaggcatgtgccaccacacccagctaagttttttatgtttagtagagatggggtttcaccatgtttaccaggtttgtctggaactgctgtgctcaagtgatccacccaccttggccttccaaagtgctgggattacaggcatgagccactgtgcctagcctcattagtataattatataaattcaaattttaaaacataagactgtagtcttatgtttgtttgttttaacccctaatcctaaccctaagattatagtatatttaaaacactatacttggccaaactgtctgaaatacaaaaatgctaactctatagttaattgaaaaaggcaatagtgtggcttataatattacaagcattttatttaaaaaaaaaattgatatggcttcaagtgacagattgacccctagaaaatacctttttttgttttaagagacaggctctctgtcacccatgctggcgcccagcggctcaatcatagctcactaaagcctcaacctcctgggctcaggcagtcctcctgcctctgcctctcaaagcactcagattacaggtgtgacccactgtaccgacccttagaaaatgctcttacacatgcaatttactgtagacaaatttgctagatggttaaataggatatttctcctagttgcatattggtgaaacctgtgtttattataatatttgggaatagtataagttggtgagcataaaaattactggatgttgggaggtctaagaaaattatcttagtatgtttgtaaaattaaattttaggcacaaagaatgtggaaaggagatgaccaaatttggttatgttggtcagtgtgatattaataaccaactaaatatttttagtgtataatgtagtttaaatatttgaaatgataacatattcaagaaaaaagctaacttaaatggttgattgcataaacaataaattttagcaatacccagattagaactaacattatttgaagactcacttgctaatatatttatcatttcagaccatacacacaacccataaaatattagtgggctgatccaagcaaagcataagttggtgtttaaagtaagttgagtggaaagaaagctataaatctgttacaactctccttatgcatatataaaatggaaggtattattaaaatccccattccttttagcaaaggatttgaaatggttttgaataattcatcaaaacataaaacattgtatgaattaaaacaaaatcataacctaggaaaaaatatattaagcaaaatatcaagagatggaagaaagaaaataccatggattgcaaaaaaaataaaaaataaaaaatttttgctgaaagcactgttttgagagaccaactctgtatcatctagggatgtactcttattatagtgtctgacctgatccagaggtgaagaagtacctctatgcagtcctttaatgttacttctcattaaatgtcacttctcattaaatgtcacttctcagttgggctattactggtagtatgacaggtgatatcttgagattgtctccttttcagaggacctggaattccctatgctttaaaaaccatgcaggtataacaggaaattttttttatttttgttgtcttgttatgaaacatatgtaatttaaaatgaggatcatatttgcttttttctttttagataaggtgttgcaatgacaaataagtagcatattgcaaatacaaacagtattttgttttggaaaatagtttaccagttgtcccagtgccttcgttgagtaatactttttgtcctaagttttgatgccatctctattaatattttgtgtatacaactgcttttcccagttcacttatttatgatagtacctatattttaatattggaaggaacagtccatctttactctttaaataggtttttggcttttcttaattacattcattttcaaattctttaaaaaaaagaatgcattggtaatatgaagagatatgtatgatatcacagtacaagagcaatacaatgttatttaaaaaagtatgcttcatagaaacctttaattcaatgggcttttaactgattacaatgatatttagtagagtaattgtcagagagatgtgtaatgtactaactgagacatgaagtttataagggccatgtcacatgtttaatgtgacatgtagagaaatatttattttaaaacttggttgtttctaaatttgtattaaaagttcgggtaggtgattgagagaatattgtatcagtcctggctcttgtttcttaaaaagagtcagatatgagatgttctagttaaaccttttatctgtaaagaatttgaaaacttacttgttaaagaggtcaatttatttatattctgttcttactgcttgtagtttaaaaacgaatatggacttatttttatcttttacctattattatttcataaacttttcatatttagttaataaatcatgctttgaaagaactcatggaaatagaagaagtgagtgaaaatgtattacaagttcacttaaatggtaagtatgccattattttgccattggagattatgtaaactttgtggggtttttatatgacttgtatatttcaaatccattttaatagttagattttgaaaactagatccatgttttacttagcacaccatatgcagtatttttagaaattaaaataataataatgaaggagtcgcagaaggactctggtttttgtgggttttttggtttttttttttttaatcattctaatcccaaggaggattgttttttgattctaccgaatgtctttattgctaagttttaagaagaaagtgatatgaactcacaggctttgactgggaagatttacttaactggaaaacaacctgctgtatcaaatacatgtttaattttaattaaatacttttaaatggactttattttaggactgctgcagatcaatgacaaaatcgccctaaaggaaatcacaaggcagttaaatctggaaaatgtagttggagataaagtttttgtaagtatcatttcagttattttattaaatagacttttaaggtaatgtctttataccatgtatatttttatatttctggaagggtagggagaggttcagaaattcttaattgaaatatatgagattctttcataaaaatgtgtaatgtataggatacatttagtcattaagtctacaatacttggatttttccatagtaggttatagtagctgtaaaatagctaagaaacccaagtttatgtagatattctgagtttatttcattttctgtaaggtgaatactttgattctgtatctctggagatagattaacacatttttaaaaataccatgctccagcagcctatttctacttttttgagacttgagtagcctgtgtatagtagaaaatgtgctaaatttgaggctgcaataggtgggtttcagtcatgccttacaaccctttgactgcctgataatcctgagctaacaagtatctctgaattcagattctttacatgttaattgggcgttattttattatccatacttcacaggattattttgaagaagaaagaaaacattacacatcatttaacttaaaaaataatttgctggatggtaatgtgctgtacaaatgtcagttattctgttttcagaaatttattcatacttcattatcatatcatcttatagtctcagggcagtgaacaacatcagtaaaagaaactgacttgaaatgttttgaaacttgtattaaacttttacctttcacctaatatatagggcctaaggaaaacatgataatttaattttgcacctacctgaattttcatgatgaaattacctagcctcatactgcttatgcagttggagtggattatacacattccaacttcattttctggttactggtgaccatgcggtggcatcgctctaatttctgaactgtgtgctttgtgctgcaatgacaccgccatagttgtgtaagactcctagcatttatgagtttctttctttaataatcaatctataaaattattaattatataattatatactctataaaattattaattatataattatataattatataatctatgtaattctataataggttatatctatataattatctaatagattatatataattatagtttattatatgtaattatagattataatctaaattattaatataatatattaatctataaaaatattaatataaaatgttaatctaatctaaaaggttgagtaaatttgtcccttccaaagtctgtaggtctttgaagtgcagtttcaaaatgccccatctataaatctaatattctacctcctgtttagaatgtgatgttgaagctagtggcctatactgagccaaagacagttcttgttaagtatgctcagtttggcttttggttcccagttgatctgggtaggtgtttctgacatttttaaatgttacatattcatattggttttatgtgaaataataaaaatgacaattttttatcattctgttctaatcttcgctattattatcatatatagagattattagtttaagttgtacccaaaaatgttttggctgtgttccgagtaagcatagccaaacatgatacgatatacataaattcttcaatgtactcttgaatagagaaatactgctatagaaattaatagtttaattccttcattatataaatttggcttctgctcagagagcataattaggttgccgaaggtcataaaatggcagagcctggacattataagaacctaagtcacttaattcaacccacagcttttctggtttgatataaacagacatatatatgtatattatacatgcacaaatacgtatttatagaagcatatacttagtatcagatgtaataatcttttaagcaaaaagcctgaaagacaagctacctttgagtaactgaccactgatttcccaacagattgtctctttgaggatttgttatattacggtaaattatggataacacctcttggtctgcctgccttggaaatagcataacaacatcacaatatgtgaaagttttaaaacctttatgctatttttatgttagatctctcaactggagagtgaataagtgtgtttcttttctcctttatatctcctcaaatttaaagttggctgtttcttttagttatgaactctgaatgaagtaaaagttaataattttaatgaaacaaatattttaatggggcttctacccacaatctggagcacctggataatgcatctactacactaagtttcatcaagaatatttaatagtatccaaaaatgttttggctatattccaagtaaacatagccaaacatgatatgatatacataaattcttcagtatactcttgaatagacaaacactgttatagtatctaatgtttcaaaaaagccttttctttttgtttctcatttaaattcatggttatttctttaccagtacaaattagagacttgcaagaccccattgtgtttgaagacacaaagtagaatccatttctaggtctcaaactatatttagaatatggcaattctacaaaactaccttcaaataaatttaacattctttcagattttttccggaaaatataaaatttcttacttttctttttcttctttgaccgttttatcctcaagttctaaaatataaaatttcaaagatgacattgtaattgccattttcagtgatgtgccatctttgcttaagtatttaagttttagataggaagtatagagacactcagcagagtctgggcaatgactctaataactagaagatatacagtgtttatataaaatttgagaatcagacagccatcttttgttctttatttcactaaacttttaatcattttatctcattttgttgttcagggaagctttgctgaaaacctttcatttcttctggaagctttaaaaaaaggtaaatattaacatattcagccgtttcagaagatctgttttaactttattttttccctgattataaaggtaatacaagcttttgccaaaaaaaaaagctctcataaaatacagaaacattaaaaagaatacaatgttcactgtattcccaccactataacagtgattatctcaattagcatttggtttcttatctttattcaatgatatactgatctttatatcagtatattattgatagagataaatgtgattttttacaacaataaaattattttacctattttgtaataagattttgatctgcatcatcatttttatggttcttgttttataaggtgctatttattaatcaccaattatgggcttttgtttctaattttttataattaagaagagatactttgatgatcatccagatatttcctgggataaatttctgtgggtagaattctgggttaaaaggcaccatctttaacatttaaaaactaccctaaaggtttaatttgtaaaaatatttgataatacctttttcttcacaacctcaaaaacaattattatttttatgtttgcccatataatagaaaaactttcagctcttagtttaatttgaataattttgttctttaatttgcataattctggttacttaatttgcataattctgatagtggtgatgcttgtcatttcatatttttattgacctttgaaatttcctggtttatgtacagtcatgtgccacataacaacctttaattcaatgatagaccacatatgtgacagtggtcctattagattataaaaccatatttttactgtacctttcctgtgtttagatatgtttagatacacaaatacttcgcattgtgttacagttgtctacactatcacatgctcataggttcatagcctaggagcaataggctatgccatatagcctaggtgtctagtaggctataccatctaggcttgggtaagtacactgttaggatgcttgtacaacgatgcagtcacctaacaatacatttctcagaacgtatctctgtcattaagggacacacgactgtatttcctgttgggtctttgacctattgtggtaatgtttatgttatgcttatttatcggaatttttgtgttttatttttctcttcccttaagtttggtttggacttttctgctgatctaaagttttatgttttccacatagttaagtttatctagaaagttttttctctccttcagattataaaaacattcattgatccatctttttatttaatatatatatatatttgtaatttataatttgtttggaatttattctgattttacctgtaaagtagggatctgactttgaatagactaattttccccactgatgtataatgcaatattttatcaaatactaaaattctatattagtacataagtctctttctagacttttgagtaatccctttggttttgtaccagtattaagtcatttaggctactgtatttgttatttgttgaaataagtctttcttttatcagatatttgtttcactttttaacacaaatataaaggcgttaagcctaaggtaaaagggattcttttactaaagttgtttccattattgaagtgagaaaaatgtaaccagagggtgatgtggaactttccccatgaaaagcattgtagttgaaatgctaaaagttgtgcttcaagggagtttaagtggctttagttgaactttataatctacaagtttgtttataaaaagtatttctacaagaaatgtaccttgtatttctactaaataaacaactctcttttaaagcattagttttgttcattaattagtgactccccttatattttaatcttaaagtgttttggttctgtgtaggtatagaaaactctgtcaattttataatcattaaataagaattatatttacgtaattataaaaataatagtctttagtcatttaaatgatttttgacatttttcaacaacaaactctactagagtctaggaactagactgcactttttattttttggagatggagtttcactcttgttgcccaggctagaatacaatggtgtgatctcagctcactgcaacctctgcctccgcagttcaagagattctcctgcctcagcctcccaagtagctaatttttttttttttttttaatagcagagatggggttttaccatgttggccaggctggtctcaaacccctgaccttaggtgatccacctacctcggcctcccaaagtgctgggattacaagcgtgagtcaccatgcccggcctagactgaactttttttttttgagatggagtttcactctcgttgcccaggctggagtgcagtggcacgatcttggctcaccacaacctctgcctcctgggttcaagcaattctcctgcctcagcctcccgagtagctgggattacaggcatgcgccaccacacctgactaattttgtatttttagtagagatgggatttctccatgtttgtcaggctggtctcgaactcccgacctcaggtgatccacccacctcagcctcccaaagtgctgggattacaggcatgagccaccacgcccagcctagactgaacttcttgagagcagtcggggctgtgtttgtcctttgaataatttttttctgttgaatgaacgtatatgcatcagtaaatcccctacccaaagtaggctatcagaatgtttacagaattgagttttaaaaactgaaatatagtaaatggtttggaaatttaggaaaggtggatataatttcttattaatgtaatgctcttattttatcttaggtgaccgaactagcagttgcccagtgatcttcatattagatgaatttgatctttttgctcatcataaaaaccaaacacttctctataatctttttgacatttctcagtctgcacagaccccaatagcagttattggtcttacatgtagattggtaagtctttctgttcattaaaaaaattgattataatattttaaaattcaagcttaattgctgacactgctagtttttttcacttatttaggtcattttaaaaattttgtttcagcagtgcctggtgtatttatcctgctttcaactcaaattgaggaaaacagtttagtagttaccttagcccattaatgaatacctccctcctcccagtgaaattactgaagaaaaaagtatgaaatcagattatgctaataaatataatttctacattatcaagtaatgaggcggttaaatctcaccaatatttgagaaaacttggtaatagtttttattttaagatttttttccatattttgaaaaggcttgaaatcaactctaagtaatactattccaactttcaaagtacacatctccagaaatggaaaagattctaccaagcactgacagtagatagtggcttcttcattccatgggatattttagaatgattttaactatagtctcaatatcactatcactttgccttgtgaaggctctgtacatattgaaccatgtgtacctttggacagcagtacaggcctttttgtgtttaccttcttacacgcatgtagtattaacttactgaattcagataaaactggtattgaagagtgccttggcccattttgtgttgctataacataatacctgagacttggtaatttttaaagaaaagaagtttatttatctcacagttctgcaggctgaaaaattcaagcgcatggcactggctttgttgcaagggttttcatgctgcatgacatggtggaaggtcaaatggggaaccgaaatgtgcaaaaacgaaccagataggagttggaacctcaatttataacaactcactgtctcaagaactaatctatccccatgagaacaagaactcactccagtaagaaggcattaaatctatttatgagggtccactccagtgacttcccactgttgcactggcaattaaatttcaacatgagatttggtggggacaaaccatatccaaaccatagcaaagttgtctcttttctcatgctatgactgccatgcctccatagctttcttgcaatcctcttccccctccattctcggcagatgtgtcaggcacatttacatgttcacatctcctttcctacaaccctttttctttttcagaaaagtgaaacttttttctaattcatatttcaacagtcctccttccagtgctgtttctctatagagtgactgtcatttgcccctcctttcctgtgctctagagcttatgatacatggctttagtataaacatccctcatacatcactggctggtgctccacatatctttattcctccttgccaaaagcagcaggcgatgacaaggatcaaagaagcatcctccttcttgccaaaaaaaaaaaaatcttcctttgggtggaagtggctgtggtgagtgttgttgacccaataacggaccaaataaaatgccagtaacttcttagcagtgttatcagatgttcttttttattgtatatatataattctccaactgtgtagttctttcaagtgtaattttttttctttttctttttttttttttttgagatggagtcttgctctgtcgcccaggctggagtacaatggcataatctcggctcactgcaacctccaccttcggggttcaagcaattctcctgccttagcctcccgagtagctgggattacagccacacaccgccatgcctggctaatttttgtatgtttagtagagatggggtttcaccatgttgcccaggctgctctcgaactcctgacctcgtgatctaccccccttggcctcccaaagtgctgggattacaggcgtgagccactgcgcctggcctcaagtataattttatctgtgtatccacgtttatagggagagaacaaaagtatagagggagtagtgactttgccagcaagcatcttcttccccattgggagtaattccatttttgttttttggttttgttttgtttttactagttcctgtatgcccacattgccaacttctgtcattactgcctactacaaagacagtatttacttccatctcttttcattcccaaatttagggtctgaattgttgcttgtatagattattacttccactgtctacctatatgggtgacctagaactctttcttaatagaaaataaatgtacaatatctgaatctctgaatataacctttcttgtcttttagttctcatgctggcactatacttttctttgacctcataaaaacattcaaaattttttattcaccctcccacctcctacctcaggctattagtctttcctgtccaccttcccaaactaaccatgatcccattttgatcacttgaattctttcctctatatcatgatttcttcacgtaggtattatgagagtcatctggctagatgtggagatgtatatttctgggcttaaactactccccttttaaaaatctttataacatttcaacaatatacataggaaagaataaataatgagccctgaattcccttctccactcattgccaagattcaattactacagactaattttatttatcctcaacatctcctttcattcctgtattattttgaggcaaaaactaggtattatatcattttatcagtaagtattttagaatgtatttttaggagataagagctctttaaaaatatatttccctaatataattgttatattagctgtaattccttaaagtcatcaaatatcatgtcactgtttttaaaacagctttattgagatgtaatttataccatacaactcactcatttaaattatacaattaacagggtttttgtttattcatagagttgtgcatttatcaccacagtttaagagccacgtaccttttagtgatcaccccaaatcccctgttccctccccagccctatgcaaccactaatctgctaatccactttctgactgtttagtaatttttgaatcatacaacgtatagttttgtgtgactggcttctttaacatgttttcagagttgatctgtgttacagcatatatcagccctttattcctttttattaccaaataatattctgttgtgtagatataccacactttgtttatccattcatcagttgatggacatttgggttgtttatatttcttaagctattaaaaataatactgctgcaaacattcacatacactttttttgtggttatctggtttcatttgtcttggttgtataccttggagtgtaacttaagtaataaatatatattatactatactgtatatatatagatgtatatatacatatataatataaattatatatattatatataatatgctgtgtactataatatattttgaaaaattgctcaagttcattattaaaaagagatttaggaatgacagttcctgcaatatatgtgacttaggaagacagcttacctattgtgcttttgatgtcttggatagtttgaatgcctatcagttttgtggaagtattttcttcatttaagaacacttcgtatgtccttacaagcagtacatattagttatcctttggtttttagtgttctttgacagtaaatttgattcctgatttctttttaaggaaaaatagcacaaatacaaatagagtctaaaagcattactataaaaaaaaaaaagccggaagataacttacgaatgccatgttgcatttctgccactttcctctcctaaagttggttcctgctgcctatcatgctattaattttttaatctcagttcttcatagaatgtacagaattccttattgacactcttggtgttattgtgacatatagctattcaatattgtcagtttttttaaacagtcatgttgggtcttggaatgttacagattagctgagagtaacatggtgggaaaaaggcatgacatcaccaagccagcaaatgcctggaggtggattatttagtttgcataaaatgttttaaatgtttaattatgtattgtagactaaacattactaattataggtgatagtttacttatacctctaacattggtacagtgtttttgtttttttaaaaacattcatcttccttatagagatttctgtttgtttttaaggatattttggaactcttagaaaaaagagtgaagtcaagattttctcaccggcagatacacttaatgaattcatttggttttccacagtatgttaaaatatttaaagaacagttatctctacctgcagagtttccagacaaggtttttgctgagaagtggaatgaaaatgttcaggtatcttaaaaggcaataaagctaaatgttccttgctatatgatttaaagcaattaaaacacaaattttagaaattagtaaattaacacaaagtttctaatattgctgaaggataatgctgcagtaatacaaattatatactttttaaaaattttcttcttagacagttgaaatgtcatttctcctaaattctatctcaaaagaacatcacagttaagctttaggatttatgttattagtttgaagtaaactttaatgaggctttagttttatctgtatgtggtttatattttagataattttattttatatattttacatatttagcaataataataaatagtaaataatgataaataaatgttaatgactcatacctattatgtgtggatattttttttcttccagttttcattagcaacttcagcttttattttgttgggccttaagaggcagtacagactgtggcacctccagttatattatctaataggtgatcacatctcacagtccctggagacttgagagtcttagatacaaaggcaggttcatatgttgttttaaagatttgccacacctttgagactataaatttacctgtgcttaaaatattctcaacacactagcattttaatcttacgctgtcaaaaagtttcagttggcaaagagaaaggaggaagtatgcatatgtgtgtgtatttaataatataattgaaaaacatcattaatgaataagtcccttatgctagaatctcaaaaaatattggcctcgtgagagtggaaaataatatagagtccctggctctgaaggaattgggaaaaactgatttataatgttaaaataccggtaaggataattagatctttgaatagaattacacagtctatattcactgactctataaaaaggatcattttattttaaagcaatagtggtagattgtatttttaccgtgaatttttaaatactaatactaaattggaagcgttttgcatttagtttgttctttaaatgattattgtttgattataaaatatagtctgctcatgtaagcagtattttgacacatttcatttttttaaaatatcataaaagtttattgaacaaaatgtaattagtgcaaaagaatacatgataaacagtggaagtttcccttaagactatatcaattctcctttcttctactatggaataattacttggtctacaacattgcagagtttatatacatgctaaatatgttgtttttacataaaggactcaaagcctacatatttttatattacttttttcccattgttatgattaataattccctgttctttttcttaatacaactatacataattgtatgtaaaaatagctgacattatctttaaaattcagatattatgccttgatataattaggtatggatcctcccttccactcaatctttcctgagactcgggtatttcaattacctgaccaagtgtctttgatactatttctaattataggattccatctataggagcaccttctttgtagttggtactcccacattgtccccttttactggggtctggtgtgaaccagacctctggatcttcagcttttagatctacttttcagtgcctcacagactttcatcttctacaactcctgaactgattgtcttattccaccagtatgtttttctggctgttttagagattcaaatgtagtctttcatagtatttaaatgtctgtactttccatgggcttttttttttccatacctgctcacacttaatcttcttaaggtaactacatggtctaggttgcactgtgccatttttcatccactttccttcccaactgtgttgcattctgagcatctcaaattgagtctataaataaagaggatgctgggagttactggtgaagaagtataactgcgtgacttagaaaatgataaccatgtgttagtagcataactaatctactttctggacttttgttgcagaccttaaatcccctgcatgtgagcactgtcttgtcatcattttgatagtcttaatagtcagtttcattaagtagaaccagcatcactggtgtttgtgtctctgagttctaatattttcttcccctatcctgatcatcttgtgcctgtctttggtatgtgaataaaatgagcttcacttgaaaaatctgtcagcaccatggtcagagtccctgccttgtggagtagggtggtagctgcattaagggagctattctttctcttagtgccgattatccaggaagctattttgaatggcaggattaagccaatagcagtgatacagataacaggtcacacatggaatctcatccaagaaatatcttcaggataagattgaaccttgatatcctgcctaatttgaaggtttgttttagccctacttcaaatgagtcaaataagcaaagtagactctatcttagcatggcagtataagagggatcctttgaaaagaacatttaaaagaatcataccttattctcctcaaatgaaatctcccaaagtactgtagcttatgtggttgttgataatagccttatcctcaaatagagtatagtgtttgaatcaagatggaattaaaaatataatgaacgaggttagacaattttttttgtttaaatggctcatgtagataaggtaggcattttaaaaagcagaataagtaattatagaagcaagaaggcgatagcttttagaaagagggggaattggagtcaaaccactaaaaaataaagagataaagtaggaaggtggagtatagaagattaacctttgaagcatcatgtcaaagagaggcaaatgcaggttttaaaaataattgattcttgcagagaaaatttcttcaattttgtcccaggtgattttctttagttttcctaagtgctccgattttaccacatcaacttttacaacttacagattacagaaaccaagactatagtttgcctgtgatatttagccacatatcttccatattgcaattttaaaactggaaaagctaaacaaatttttttttaatttccaaaaggtattactttgttttttttatgttcaccctgtgtacttccaaggatattctaccgtgtttgtgatagaaaaagatatagtaaccagaagtcctttaaaatacaaagagaagactagaaacaatagcaagggagtgggaactataattaagataatatatttcctgagagtataaaattttattccagtagactagaacttacttctgaatctggtcttcttagagtggacaaagtaaagacatataattacagctctagaaaatacagaaatgcttagttttctgggcttttttttttttttaaaagaatccttattccatgcagatgatttttgaaaaattatgacaatcttttccaggcctttcttggctctgctacttctgaatttactcttttttcatctaatcttttcttcaatgccagtgttcctcaccttccattcaaccctaattactgcagtcacttgcctctttagatggtactttctcaaagggctgtggtgatctttgaatttctaaagccattagcctcttctcaaatatatctttttacaaagtagtttatattgttgaacctcacttctctcttaaaactttgttcccttgttttctagatctctactctgtcttagattctcttccagtctttggtatctttcttaatttcttagtttttctcttttcccacctactacttaaatattaataatccaagattcattttttgaccacatttcacttttcacaggccattttgtttcccatagatcatgtttgatttttatcttctacctttcaaacccttccttctcttctgctaccagttaattctctaccagatgtactcctataaacgtcttaattcttttttcttcataacactcagataattccgacccactttacctcttgtctggacagctacctccagttaggtttttctgccttttctttttgtacattcactttgccagtaattgaaactccagtacgtgactactcattttctgccaatgtgataattttcctgctactcatgctgttccctgtaactggaatgttcttccttcttttttaaatctcttgtctcatccagtttaagcattctttgtaatactttaccttgtatccctaggtacagtaactcatgcacttctgtttttgtgctgcattttgttcatttcactagtatgactgtgtagtagtttcccttattcaagtacgaatttggggttagccaggattgttttatcattgtgtttattgaattaacgtaaagaacaggataagaaaatcagtagactggaaactttattttggttttagtgttctacaaataagaccaacatctatttaataatgaattaatattagatagagttactaaggtacaccaaccagtaaggcacaggattatatttaggttttaaactacatctttcctcaattttggctttttttttttttttccttttagtatctctcagaagatagaagtgtgcaagaagtactacagaagcatttcaatatcagcaaaaacctgcggtcattacacatgctattggtttgtattagttttgttttattgcttgttgctttgtttttgtttttaatagtgacggggtctcactttgttgctcagactggttgcgaactcctggccttaagccatcctcccacctctgcctccctaagtgctgacattacaagcatcaaccactgtgcccagcctacttttatcattttctatctttcattagataattaagtttttatgggaattgattaaacctgtaggtaaattttgggagaatcgacatgcattggaacactacatcgagtgttccaatctctgaatagggttcatatctccttttatttgatttcttgtttgattactttcatcagcattttatagctcttactacacagatgatgtacttatttaatgtgtataccaatatttaatttgttagaacaattgtaaatgggttttgaaattttggtttcccacatattcattacatttcccacatattcattacatatagaatatgtgattgattatatatatacacattaatatatagaaatgtgattgacttatagtctatgctgaactcacttattctaagaggttttttaatagattccttgggacttttgatgtagaccattacatttttcacaaatagtgacggttttttttttctttccaatctgtatgccttttatttcttttcttgcttttttgcaatggctagaatttccagtgttatgttgaattagagcagtgagagtggacatcctttcttgttcccagtcttaggaagaaaggattcaaacttttaccattaagtataatgttagctgtaggttttttatacatgttcattatcaggttgaggtaatcctcatctgtttgtaacttgctgagagtttcttataaatgggtgttggattttgtcaaatgcttattctcgatcgtttcgcatgaccatgtttctctttaacctgttgatatatttgattatgttattttttgagtgttgaaccagccttatatacctggaataaatcctacctggttatgatgttttgccaagtaattatatcttaagcttacataataccaatatcaaacaagaagtacttaattgttctgaaaattaactttcttcactaagagtatttggttttagtctaatatttctagaaaattatggcaaatacctttgaaagacaagatagttttggtttcatagaaaggtcatttttaataataatagaataataatgacagtagctaccatttatggactggcatatgagccaagtactgttgatgctagtagtacctatattatgtctggccattggaataatcttattttttattcttacccctaaagaaattgaggctccttaaagctaagtaacttgccgaaggtcacactactagtagataacaaagccaggacttaatccaaagctctctggcttcaagtttgtgtcctacttggctgtatggttcacccatgtttatatacaagttttctttcctcattgctgcttctgctgaggaatttaagtctttttatccctatttacttttcttctattgtcaaaagcatactgccattttcagcatatcatgaaggaatttggggactagtaatttttagaggaggggtgtgtgtgtgtatgtgtgtatgtatatatatatacacacacatctccatctgggaaaatatctctgcctcagtattgtcaatattaacggccattgttctgccatttttctattacatttttaattcatggtaatgaattaaataatggcttgttttttgtcatatgggattctactttgagggctgcttactcatattcttagctcatcccattatttgttgtcattgtcttactgtggaagctcattatagattacagattttcagcctctccagtaaccagagaaatactacaattaaactttttttttcttgccaatctagtgggtgttaaagattatgcttgatggtatcatgactgtgactattaatatttattgctgctgccaatgtaaatatgtgtaagtgctttggagagcaatttatttagcaaattaggtaactagagaaacatactaattagagaaagtctagttacctaatgcacaggaagacatgtccaaggttgtttattgcagtcttgtttataattgggaaaaaaaaagaaatgaaagatgtctgtcaataggaaattaggaaatgaataatcgtggatatatacaaagaaatataatgaaaaaatgaataaaccagaattgatactgcctcaacatgggtaaaacctcacagtgaagagagttgtgaagatacaatatatttatataaaagttgaaaattactctgttgtataatacatgtatatgtagtagaagtattaggttggtgcaaaagttaccattactttcagtgcccaaaatggcaattacttttgcaccaacctaatagtatagacatacttggttgttttatgtggggaagagtagagtccaatccggaggagatgggcttcaactctaaaatcatatttcttaagcaggtaaagtagtcatagatatttattattctctgttgcctttgtatatgttaaaaaaaatttatgcctttgtgtcctcatagcttagctcccacatatcatatcagtgagaacatacgatgtttggttttccattcctgagttacttcacttagaataatagtctccagtctcatccaggtcactgcaaatgctgttagttcattcctttttatgactgtgtagtatccatagtatatatataccacatatatatatatatccatatatccatagtatatatataccacagtttctttatccatatccatagtatatatataccacagtttctttatccactcgttgattgatgggcatttgggttggttctacgattttgcaattgtgagttttgctgctataaacatgcacatgcaagcatctttttcaaataatgacttctttctttttcaaataataacttcttttcctctgggtagatgccctgtagtgggatggctgtatcaaatggtagttctacttttagttctttaaggaatctccacattgttttccagtggggcgagggataaaagactacaaatatgatgcagtgtatactgctcaagtgatgcattcaccaaagtctcacaaatcaccactaaagaacttactcatgtaaccaaataccacccataccacaataacttatggaaaaatgaagttaaaaaataaaaattaaaaaattaataactaaaggaaaaaggaaaggagagagaaagggagggagcactggcaatctaggtcccaaccagtaggagaatgaaggacaaggattgccaaactctctgcccagctaatcagttgcgcccttgttaaggtgaaggagagtttcttggataattatatcccaaatattgcatggcacatactactaagaaactatttattgtttatttgaaattgaaatttaaccagaggtcatgcatttttatctgctaaatcttgtaaccctaaatgaccaaatttaactttcatgaaaaatacaaataaagaaggaaggaaggaaatcttcaaatacttgagtagcaactctggtccaggacctctgttcatttttgaacagagaagcagcacaagagaaggagactgtgctttcaaggagagttattcctgagtataaatgtgctattttcttttcttttttgtacaattgaacataaaacagctaacttctgtctaaattaatactaacctggctggatgattgggtggtgaaaaagttaacaagtaaggcgtagatctgccttttgggcttgtgtttggggcttttattagtaagtattcttaattattttcagtttcttctccttgacctactcctctttaaacattgttcttccaagcagtaagtaaacaagttatgcaactgggatgggttagagagagcagcaggaactttttttatgctttacatctgcagttatgtgacacacaaattgaaatactgtattttaatacaactgaatttgagaataccttcctaagcattaatatttactctcccttaagaattaactatacaaattcagaagttttgcacagtatctccaaaatgcccatgtaaatacgtaattgtttttctgatctgtctttccctagatgcttgctttaaatcgagtaacagcatcgcacccatttatgactgccgtagatctaatggaagcaagccaactgtgtagcatggactcgaaagcaaatattgtacatggtgagaacccagccttattttttaaattgtggtttttaaaactttgaatttagataatggaatgtttttaaaattacaattaacgtgggcataatgctttataaaatactttcgtatccatatagcctttaacttagtccttttaaaggtactatcactcccatttaaagtgaaaaaaaaatttgacgctctgcctcttttgccacattggaaatccaggtaagactgtgttgctgatgttatcattgtatcaagaactactgaagagcattctctgggtttcagtcattttgggtttgttatttccttttccaaatgtaatgaaccttttcctctccggggaaaaaaggaatacacagatttggatataatttccaggagtttaggaagtctctagataaatcctacgcaaaggccctgtgtgatttaaagtcacataacaattgaagtttattttgtttactgtgggccatatggtgagtgcctgataatatttcgccaatctttgtgacatttctaaaagtttaaaaatatccttattttgcagataggaaaaaaactaagctcagggaggttaagtaacttaaatttatatagataattgaaacacattgaaatctagaagaatcttgaccttcttcacccctcagaaccatagatctttcactatattgtattctttggagaacagttatttcagtcttatatgtcattaaactgatagttttttttcccttttactgtaggtctatcagtcttggaaatctgtcttataatagcaatgaaacatttaaatgacatctatgaggaagagccatttaattttcaaatggtctataatggtgagatgagacttaagtagcttttttctgactcttccccactgcttatttgaaggtataatgttgtcattgctttctactcagagtttcagaagtttgttcaaaggaaagcacattccgtttataattttgaaaaacctgttgtcatgaaggtaagatttagtttgctgtcatttttctacagacaagtatattttttacatccaatttgattatgtattaaaattgcactttcatttttaaacattaagtattatagagatttttttcaaaacaagaaaattatctaaaaatgaaatattttggaaaaatctgaggaagtgaccggttgttttagtttgtggaggtatactgccctctgctgtctcttcagagcacttgcatcccgaaaacaactattcagtatagtgtgtgatataacctttccctttccaacccaaggattggcttttataatctcagcagtaaaaggagaaaacaatgaaaattagagccattaagaaacttaaaagacaaaatcttattggcctgtgagggcatacagagaaagtgttatttgggggctgagtcatgagttttacaacttcaggacttcatgtagattaccattgtccactacaaagataatgtgagccatgtaatgtagttttaaattttctagtacctgtaagaaaaataaaaaggtttaattttaattatatatttaatgcaacatatcaaaaatgtgtcattctataatcattatagaagaacagtaaggtattttacattcttttgaattaagtctttaacatttggtgtacattatatttaagcacatctcaatggcctaaatgtttactggaaattcttgctgtttagattccataaaatgtatagctgagaaagtaaatttacattttgaaattgttctaaacatgctcagaattttctaatagaactaaatatccatttttaagtttaaaaaaaaattgagtcacacattgaagtgctcagtagcctagcgtggacagtgcagctcttgaagattttaaggaaagaaacttttaaaacagtggattccccaagtccattggcatcccttataggccctagtaaccagaatttcatttcttgtagcaacaaaaatgagtacagagcattgccatttcttcaaagaaacaggaaaagtattttacaatactggagggtttttttcccctaatagtcttattttgtgagagctgtgaaaatggaaaggttacccaagtatttaaattttttttttttttttttttttgagatggagtctcctgtcgcctacgctggagtacagtggcgggcgcaatcttggctcactgcaacctctgcctcccaagttaagcgattctcctgcctcagcctcctgaatagctgggattacaggcgtgcaccactatgcccatctaatttttgtattcttagtagagacagtgtttcaccatgttggtcaggctggtctcaaactcctgacctcatgatccgcccacctcggcctcccaaagtgctgggattacaggcgtgagccactgcgcccagcctgcatttaaattctcaataatttgtagctgctcatttctgaattttcaattatgaagtattttgctatttagaaatgttttaaatctgcacagttctattcagctcttaacacctgcagcctccagtattttctcatgttcagatatgaaggtatctgagctgtttctctatcagaagaatttatgtgatacatagagaatatgttccagtgatgttttttacagtgagttgtaagaatataatagaatcctcaggaatctatttcagtgtatcattatttaatggttagtatatcatgatttaatggttttttttttcataacctaataacgtacctaacacaacactcaaggttagaaaagatataataggtgaatattaaggataagaggaagtagacaagaaagagccctattaagatggggaagatggaagaaggttgtgacagtctcagtcagacttcttagaggaaacaggagcctgtcccttctcctccatgtccatactagcctgctgaatcctttacttacaggatcagctgaatatgtctagttgactcaagggtctttttctgcctccctctgttacagctgtgttacctttttacatagcaaagcaaaaatagagacagacaaaatataaatgcaaatctgagtagcctagggaattgatcagaaagtcttatctgattcttaggtttttacagagaactggaaactatttattaaagtactaggaggagctatgatagagaatgaggctaggaagaaaaccatattgtatatattgaattaaagtttgccgtgtttacattcaacaatatatggacaagtaagtgtgcactgacactgttttacctgataatatgagttttcatggggttgtgagagtttttttaatcctattgattgttgttacattttgcttcccagtactctgttctgcagctgaccaaaatgctaactgttctctgggagagaacaggagagttgtcactctcctctcctattcaacctaaactatttctttcatctttcaggcttttgaacacttgcagcaattagaattaataaagcccatggaaagaacttcaggaaattcacagagagagtaccagctgatgaaactgcttttggataatactcaaattatgaatgctctgcagaaatatcccaactgtcctacagatgtgaggcagtgggcaacatcctcactaagctggttatgaatataaccagtgacttcaactttggcatttcattcatacttctgtagagaacggaaaactattgtccattaacatgatatgctaaacattctataaacattcttgtatttatgtgagacttgcccatctactgtcttggctgtgtcttgccttttaatcatgaacagttacatgatttataatttcactgattgagattactttgtaagtagctgttcagaagaataaaatatgactgttttagggactagaccatgtgcttttttaacacttatatatataatggtctatttgaagagctcacttcaacctaacagctagatgtctttacaaaccttaaaccaaaggagtaaaaaaaacaatggtaagcactgaagtataataagtaacctttggtacagcaggtttgctgcagtgtttttttctgtccacatgcaaattttggattctatcccagacccaggttttctagttcagaagactaaccagcttagtcagaagatggttccatggaagaaaaaggccaaggagtttgaagatttttcttctagacatctcaaaatgtggtactcataccatccacatcagaatcccttgtaggattttctaaaattacagattgttgagcctaccataggtcaaaaggactggaattttccttcttaacaagtatagtcatggcaccacgtaacattttggtcaatgacattgtataaagggtggtctcataagattataccatatttttactgtaccttttctatgtctaaatatacaaatgttttaccattgtgttacagttgcctacagtatgattacagtaacattctgtacagtgctatagctgaagagtaataggctaggctatctgtatagcctaagtgtgtaacaggctatatacatatcatcagggtctgtgtaagtatactctgtgatgttcatacagtgatgaaatcacccaaagacacatttctcagaacgtagccccatcatgaagtgacgtgactaccagagatttctggaaaagcactcccaaaagtaatgagatgtgtatggcaatgttaactgaacctgtttgtattaaaaagtaaatccctatgaggaatgtggaaatgtccgtcaaagcattgtcttttaagtaagttccaagatccatgaattaacagaggcatatatttaaaatgaaatttaatgagcacttagtgacttcatttgttcaagaatatttgatttcctattgtgtgcatgggaggtttacaaaagacagactgtccctatgcttgtgcagcttacaatctatttaactattagaggccctgtgagatgtaggcagttatttacagatga

SEQ ID NO: 36394 - DNA, 46690 bp, Homo sapiens
gggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggtagggccgggcccggcgcttcggtcggagttgctcagtcggagtgcggcccgggcctgcggccgaggggcgggatccgggtgcggaggctagcggccccggctttgcttttccctcgtccgcctcccggccctcctcttgttgggagcggcaagcccgagtgcagaggccgacgctgaggctgcggggaggctgggtcgcggcttgcagccgccgctcctccacctgtagtcctgactggcaaatgcccaccgttgagccgctttggggggcaggtgttagatatgggtagttagtagccaattcttgctgtcacttgactctgatttacagctagcgggaaatggcctgtgatatatatcaaaataatgcatgctcgttaaataaacttaaaaagaataaaaaccatctcctgtcatagcatttgacatacagtcatgcgtccttagcgatgtgatattttctgagaaatgtgttcttaggccattttgttgttgtgcgaacaccgtagaaagcgcttacacaagcctgaatggtacagcctgttccacacctaagctgtatggcatggcctgttgctcctaggttacaggcctgcgcagcgtgttgctgtactcagtggtgtgtgcagttacatgcagtggtaagtatttgtgcatctaaacatagaaaaggtacagtaaacatgcagcataaaagataaaaaaaaaatactacaccagtgtggggcacttacccacaaaaggagcttgcaggactggaagttgctctgagttggtgagtagtggtgagtgaatgtgaaggcctgggacattcactgctctactcttgtagactttataagcagtgtacccttaggctacgctaaatttttttaatctttcttcagtaataaactaaccttagcttacggtaacccttttactttataaacttctaaattttcttaactttttaactcttttgtaatagcttaaaacgaacttattgtgcagttacacaaacattttctttatatctttatttggtaagtttttttgtttctttttttttttttattctttagttaaaaactaaggcacacgttagcctaggcctacacctcgtcaggatcatcaatattactgtcttccacctccaatcttgtcccactgggaggtcttcaggagcaataacaggaatgaaactgtcgtctcctatgataacaatgtctcttgaaatatctcctgaaggacatgtcagagactgttttatagttaacttttttttataaaaggagtatactaacagtacatagtatagcatagtaaatacataaaccagtaacatagttgttgattatcaagtattatgtactctacattattgtgtgtggtagacttttacaccactggcaccccagtaggtttgtttacatcagcatcaccacaaacatgcgagtaaagtgttgtgctatgacattatgatggctatgacatgaccaggcaataggaatttttcaactccattataatcttaggggaccactatcatatattcagtctgttgttgactgaaatgttatgtggtgtgtgactatatttttgtgtttttttatgcgtatgtgtatatgctttttttttttttttacaaactggtttatactgtttttagtaatagctgcacagtagttcattatgtgggtgtaccatatttttttttttaagagacagcgtcttgccctgtcactcagcctggagtgccgtggcccactaataatagctcattgcagcctcaaactgcaaagctcaagcaatcctcctgcctcagtctcccaattggtgggactacaggtagacacaaccacacttggctaattttttttttttttttttttttgtgtagaaatggagtctcgctgtgttgcccaggctggtttcgaactcctgggtcaagcgatcttcctgcctcagtctcccaaaatgctggaattacaggcgtgagcctctgtgcctgtccagtgtactataattaatttacagactcttgggcattcagttgattttgttttttcaacatcataagtaacgatgtagttcatatctttataactaattcttatgactagtgcaaatttttgcctgaattttctttgggataaattaccggggacagaattgataaatcaaagggtatgagcttccatggtccactctcttctctccaattctgaggatttgcaaatatacccctctagctctagctagatttggagggagctgtgtcctcatgatagtgtcaccttttcttttagaaagattatcagactttgataatactgtacaatagtagtactttttttcacaaatgtatgtgctgtcaataaagtgtggtttgtttcagattaatattttgttgctttcattttataatcttttttcctttttttttgagacggagttttgttcttgttgctcaggctggagtgcaatagcacaatctcgactcgctgcaacctccacctcgtgggttcaagtgattctcctgcctcagcctcctgagtagctgggattacaggcatgcaccaccacccccggctaattttgtatttttagtagagaccgggtttctccatgttggtcaggctggtctcaaactcccgacctcaggtgatccacctgcctcggcttcccaaagtgctgggattataggcatgagccaccgcccccagcctatttttttctttttttattgataggtaatgtacatagtttcagggtacatgtgataatttaatacattaatataatttgtaaagataaatcagcatacttgggatagccatcaccttaactacttcacagctgaactgtgcagcttttattactgaatattattcccttaatatttatgctaggaacatttgaattaatctagctattttgaaatgtacaatcaaatattataaactctggtcaccctgtgatctatcttaacagtaggtctcattctattataatctgctttatgtttagagagttttggtgcatttcagaatccttttagacttttttgacaatttcacaaggcattgtttaagagaaaaattgtgtgtgttttgtgaaatagctttgacaacaggttaaaatagtgctatataaaaatagattttattaaagcaaaagaaactgctatgcactgccccttgtttcctatagacttacatacatgtcaggaagaattttttatctttgagaaagccaaaaaaagtggttgtacttctagaaattatttatataagcttcatcagtttagtatttagtgttttctgcccagtcctttctataagctatttatttcttgtcagttttgaatataaatgaaatgagtaaaataaaattgacaccagcagttttttaaattggctttattttatttttcagagacagggtctcattctgtcacccaggctggcgggcagtggtgagatcataactcactgcagcctcaaactcctgggctaaaacaatcttccagcctcagcctcctgagtagctgggactacaggtgtgcaccacaatacctggctaattttttttttttccagaaatggggatttcactatgttgcccagttagtcttgaactcctggcctcaagcagtcctcctgcctcagactcctaagtaaaaaaaatagctttttttaaaaagtacaataattatttggaaattaataatcacatacaagataactgaaggggcaatatatgtgtattatatacttatataatttacatgtatcaaaaacattccgtttattggatttaagtgtagttacaatgtatttagataatgatggtatgtaagatatatttaatgtttacatgtaaagttatactttcctcctctgaaatagttatagaatctaaggaagtcatatcttttctatcccactgcctttaggctgaattttcattgtagtcaaaactgtactttttcattccttccttgcttccttcctttttttttttttttttggacagtatcttactctgtcacccaggctggagtgcagtggcccgatcacagctcactgcagcctccacctcccagggctcaggtgatcctcccgcctcagcctcctgagtagctgggactactttgtagagacagggtttcaccatgttgcccaggctgaaaactgcacttttcttaattttgttaggttcagtgaaacaactcctgctcaaacaactggattcaaaaagtgatgttcagtagatggcatctttggaaacaggcatgatgacccatgaagtgtacacgcttgggttactgcagagaaggtgctgttacttgtagaaatctgtctttgcttttctaggtggtagcattggtaaccttcctggaatggtgatgaggagaatggaaacaccaccttctagccatagcataactggtcgtggaagttatggaataactggaagaagaatccagattttcttaaaattaaaataagtgtaatttatacaactaaaatctgctttaaaatgtgtcatcctttgtcagtattttctgtggagaaaactgttttccttttactgtgagatatttaacctgtgtaatctcctgtaatcttttcttgataattttattttagcaattattactcgttttaatgctttgaaggctcaattcatatttttttgcgtgtgaattacttgcaatcagttcacattttcaaggtatataattttaaatctgatctattgcataaggaaaaaggaaaacgaaacatgtaaactgcagctattctaaagaagtgtttataatcagttccttatgcgtgaattcataaattttcaatgatatgttaaaattgagagagagcctggatagctccttcggtagagcatcatcagacttttaatgtgagggtccagggttcaagttcctgtttgggcgtgtcctgtggcttttagcacctaattctgactctatctttgaaaaagccaaaaaaaaaaaagtatgatttgggccaggtgtggtggctcatgcctgtaatcccagcactttgggaggccgaggtgggcagatcacttgaggccaggagttcaagaccagcctggccaacatggcagaacccaatctctactaaaaatacaaaaattaaccaggtatggtggtgtacacctatagtcccagctactcgggaggctgaggcccaagaatcacttgaacctggggaggttgagctgagctgagatcacaccactgcactccagcctgggtgacagagcaaaactctgtctcaaaaaagaaaagtaaaagaaaattgagaacattgaatactgaagaaaacattggaagattgtataactactttatgaaaaaaattactattaataataatttaaagacattcttgttttgtcattcatggaaaccaatattgaatgagaatgtgataaagaaaattcaagttgtaatacatctattggattcctttgaattctttcatttttaggaagctgcacaagccttaatttatgctgagatggcaggatcaagcctagaaaatattcaagaaaaaataactgagtatctggaaagagttcaagctctacattcagcaggttagtaaaggactactaaacttgtcactctattttttcttttctcccatcatgtctttcccccatgtttgtttctcttcttcatttttatctttgaatcttgatgctcactctgttgctgctcattccacttttggtaatcacctctttaaaagtcatttagaaataagtcatagatctttgaagaggaaccttatagacaatatagtccagtttcctaatttcccagagtgcagagatggtgaattacctatgttcaaacaatttatcattggcaaagttaggattaggattcagttaaagtctgcttttaaaatatctgtcacgtctcttccttataaaattaagtgactgttcctcttcagtgtttacagacttcagcagtaggttcacagtgtcttctctttcggtgtcttctactttcagacctttgctaaactctttaaaaccatatcttgggaaagtgacatgtaaacagagacttggaactacttgtatttatttttgtaaacagcacaacaggtacaataatagaaatatatagtcttaatggtcacagttttgttagaggtaactgatgttgacattgtatttacaaatacattgatttctgtagggattctttttaaccctctttttctgttgctgcatgataaagcgccaagcagaagaatatttattctcatggactttgtgtaactttctaccactcattttgagtagatacgagcaattacaagaacatcgttgggataaagtagatttaatcattggattccttgttatgacagttcccttaaaaacaaggcggtttacttttaatacagtgcccagaaattgcatgtattgaaaagtgtactgcctgtgttattggaacctcacttgatacaaagtattgattcatgtattcaaaatatcatataaaattcaaaggaactttcttttcccagccaagtaaatgaagttcttaaatttaactgcccaatattaggaactttgtttcataaccagtgttttcaaataaaattatctttgaagtagggaaggtagtctttcatgtttacttccatgatctccttgttttttcatagatagttttcttcatttcaataactatgtattgaatacatgtttgggctctatggtaagtacagggtaatagatgagtgacagtccatgtcctcaggaggacttcatcaggtgtggagagagaacagtgtcaacattgcactatcatggaaacccctttctgaagcatgctagactaaatgttaaagcagaatgctctagaaaggagagattatatggtgatattattccaggagtagaatctctggcagcctaaggtatatttccatctttcttttccatatgtacacacagtcaagcacatttatgccctagggtcttgattccagtaagattgctctttaaacccttgaaatccttgtgacaattggaaaaaataaatatgaatcatttttttctaaggaattttaaaaattattcttactttatattaaatacagctaagcctaaaaacttacatgtgatttttgggaaataaattctaaacattgatatatatgtgatattcaagcatcaaatgagacaccccaatctcttgaagaataaagacttgccagtgaaatagagttcaaaaaggattttttttttttttttttgaggtggagtctcgttctgtcttccaggctggagtgcagtggcgcgatctcagctcactgccaagttccgcctccggggttcacgccattctcctgcgtcagcctccccagtagctgagactacaggcgcctgccaccacacccagctgattttttatatttttagtagagacaggatttcaccatgttagccaggatggtctcgatctcctgacctcgtgatccacccgcctcggcctcccaaagtgctgggattacaggcgtgagccaccatgcctggccttaaaaaggatttttaaagcataacatagcttgttttaccaacttctttctgcttttgttgaagaaatggagtataatctctagacaatttaaaggattttcttatttattattttaagcagaaaagtcctttttcaaataaaaatcctgttaggaaccctaagttttaaaacaagatagtctgctgacagttaagagaatcctgagagagagttgattttggggtggggaaaggtaacataatttaaaattaaccagtataggccggcacagtggctcatgcctgtaatcccagcactttgggaagctgaggcaggagaatcccttgaatctaggagttcaagatcagcctaggcaacatagacttcacccctacaaaaattgaaaaaatttgctgggcatggtggtgtgtgcctgtagtcccagctcctcagaggttgaggcaggaagattgcttgagcccaggaggttgaggctgcactgacccgtgattacaccactgccctcagcctggatgacagagtaagaccctgtctcgaaaaataaaaagtaaaattaaccgtcgtagtacagagttcaagacttggaattaaaagatccctgttgagtctctaccctttcacttgtagctgtgaaatcttagactagatcaatgggtctcagtagaaagcaatttgccccccaggggacatttggcaatttctggagaagtttttggttttcacgctgctgggtggcaaggaatatgcttctgggatttagctgggtagaggccaaggctgttgctaaaaagtctcccacaacaaagaattatccagcccaaaatgtcaataatgccaggctgagaaacactgggctagatatttcaacatttttgagctttggtatctttttcatcaatggaattagtatatacttcagagaggcatttaagaaggctaaagttttgaaaacatcagcacaaactgggcacagtggtgagtgcctgtagttccagccacttgggaggctaaggcagaagggtcacttgagcccagtagtttaagagtttaaggccagcctgggcaacctagtgagaccgtgtatttaaaaaaaaaccaaaaacacgtaactttaaagaactaacaaaatctcagacttttcttaaatagcaagtttagcgagatacaatttccatatcataaaattcaccctcttaaagtatataattcaggtgtttttagcctattcccagagttgtgcagtcatccccactatctaattttagaaagttttcatcaccccaagagaaacctcttacccattagcagtcaatccccattcctccctccccctagccaccactaatcttgttgtttctatggatttgcctattgtggatatttcatacaaatggaatcatccaaaacatggcccttttgccatgtggcttctttcactgagtttaatgtttgcaagatttttccatgttgtagattgtatcaatacttcattgctttttatggctgagtaatatttcattgtattgatgtgctgcattttgtttatccgttcattagtttttggagacatttgggttgtttacaccttttggctgttataaataatgcagttaagaacattcatgtacacgcagtggctcatgcctgtaatcccagcactttgggaggccaaggcagacagatcacttgaggccagcagtttgagactagcctggccaacagggtgaaaccccgtctctactaaaaatacaaaaattagccaagcgtgatggtgcacacatgtagtcccagctacttgggaggctgaggcacaagaattgcttgaaaacccaggaagtggaggttgcagtgagctgagatcgcaccactgcactccaacttgggtgacagggtgagattctgtctcaaaaaaaaaaaattcatgtacagatttttgcatagacatgttttctcaattctcttggaattccacccagaagtggaactgctgtgtcataggatgtagctccatgtttaactttttgaggaactgccaaattgttttccagagtggctacatcatttcacagttccatcagcagtgtatctgggttccaagtccttcacatcctaacacttgttattgtctttctgattttagccatcctagtgggcataaggtgtcatctcattgtggttgtgttttgcattttttgatggctaacgttcagcaatttcttatgtgccatttgaccttttgaatgccatctttggagaaatgtctgttcagatcctttgcccattttttaactgggttgtctttattgttgaattttaagagatctttatatattctggatacatgtttcttatagatacgtatttttttattaaaatcaaatgaaaatattatttcaaagagcaatgaaaatacataacatattctaggctcagggtaaatagaaaaagcaggaactttatcatcagagcctagtatattacacaattttgtctgtgcagaaaaaaaagttttaattgccttaaaatagatttcttaatatttagcaatttccaagtttttgttttgtcttttgaggtagaggagcatatgaggagaatgcctgtgtttcaatttttaagtgaagaaagtgccagtgggagagagaaattcagggaaagaattttttaaataagtagtgtattttttactattctttatctctgatgtctattgtgtggtaaataattgcagattttttttcttagaccttaagattaaaaagagaagggaggaaggctgggcatggtggctcacacctgtaatcccatcactttgggaggctgaaactggcagattgcttgagcctgggagttcaagaccagcctgggcaacatggcaaaaccccatctctacaaaaaaaaaaaaagagagaaaaattagccaggcatggtggtacactcctgtagtcccagctactcaggaggctgaggtgggagaatctcttgagcccgaggaggtagaggctgcagtcagctgtgattgtgccactgcactctagcctgggtaacagagcaagagcctgtctaaaaaaaaaaaaagaagggaggaaatttgtccttttttaaggatttttttaaccttgctaagttttttaaatgaagaatacagggttttggtaaaaaatgtcttaaatagtgaaaatagtgtgttttctggctgtatttagataatactccttctgcgtatttttttttctatcctagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacagtgtgtatagctacaaattacgtttgatgagttatgccaaaccatttcttctcttgctagtgaattttacataacaccttgaataaaagaattttaacagaataaaaaaaattattttaaatgtaacaactactcctcaatataagatgatgagtagaaagctaataatgggtttttgcatcttattaaaattttgaaagtattgagtcttaaattacaagaactatttttaacatttctgttcttacaactaaaataaacttacagaattcattatcacaaatctattaatttagaataaacttccccttttttcagtttcgtgcactaaaaaataagctagtggtttggatgagccttacttatttgcagtgtaaaatctgtatgctgagtggcttttactgctccctgctgagccttggttgggactcttagcttcaagggacatctagtgcataagagagcagtgtatttgacaggaggatgaggtaaagtagttgagactggtatccccatgtctttctgactggctttttggcagagacttttgctcagagagaccatctggcctgatttctgtaggtgccttgagactaaatgagtgctagtgttctgaggttcctgccactcagcgttccacagcactatggtcaaacagttctggtccagttatcagttgtccacataagtggttttaaagtgcacctcagtgacaaattttcaacactattttaaatgatacctttaaggatgagaattaatgtcatctttgtttgttctcaatttcagcaagtgtaatatgcattgtaaattttttgcttagaaatatggatcaagcaaattgaaaaataattatgctttaaaatgtctgtctctttctttctcttaagtcttatgaaactgctgataaagtcctgcaaaataaactgaaacagttggctcgacaggcactagacaggtgagtttgatctctcaagttctaatccatggatggcacttagtgttatttaaacaaatttatctaaatgtgttgtaaaggctgcagtaacaaacctccatcttttaactgtcatctgaaacaaatctactttctacttcttagtgaatttacctcctctctctagttccctgctttaaactcaagaaatagcaaatcaataaatgtttttaattttagtttagaacagaaaggactgtgatatttgcaatggaggacctcctttctgttatgtaatatcagactttcaaagagaacttccagagagccttccagatctgctaaaaatagaaaacatgagcatgaacttgctttcagccatgtacatacctcagattatacagtgtgtagctctttcacctcttagctgaaatgtcaacttttcaatgaagcctgccctaaccattgtttaaaattgaatctcccccagcagttgcaacctgattattctggtatttttcccacagctcttattttctgaggtctgtgagatttactagcttattatatttgttgttaatgtctgtgtcccctccaaccttcatcccccagatgtaagctctgagggcagagatttttgtctattttatttagtgctgtaaccaagtacccagcagagtgcctgacatgtaatatgtgctcagtagatatttgctaaaagaatgaatgagtttgcataagcgaattatatatcttgaaagagtgttgtagacacacaaaaaatgaaagggtggaaattgcttttatacctacatcatgaattatctccttttgaggctctgacctgatagataactgtaccaccccaagcccttctttttttaactgaagtaaaatagtcatccctccttttcattgtcatctactaactttagtttgtttcctcagattcacaaagatacgagtccttgacatacagttgtcttctctatcttgacttctttcacctgtcagaattataagtgactttattacgtctgtggctaacccatccaatattctcaagtgcaccctaagcaaagggtgggtgagatagccatgggctcctatgaggatcttttgaaacttatggatccattctctaggaaaatgtacatgaaatttttttgcatataatttcagagttttcacaagaatcctgaagctcatatatgcacctcaggttaagaacttctattttttagctcgttagttctttgacagaacaaagttaaaattctgttgcatatcatgtgaggctgtctgtgatccagcccctgctttcctctctagtctcatctcctgctgcctctcgtttgcacttctcacaggggcaacattcattcttttgcaattacctggccgggcacggtggctcacgcctgtaatcccaacactttgggagactgaggtggacgaatcacctgaggtcaggagttcgagaccagcctggccaacgtggcgaaaccctgtctctactaaaaatacaaaaattagccaggcgtggtggtaggcacctataatcccagctactcagaaggctgaggcaggagaatcgcttgactcggaaggcagaggttgcagtgagccaagattgcgccactacgctctagcttgggcaacagagtgaaacgccgtctcaaaaaaaaaaataaaaaatttaaaaaagaaattaccttaattcattgtgctgtttcatacttctgcacgtttgtacatgttcttctgtctacttagaatgcttcctcactgcccaggtgaacaactctgcagctcaagcatcagttcagagcacccttctccaactcatccccacttggcaattcattaagtgaataacttctgttgtacattcatttgcatgtaatactttcatcctagtatctgttatttttgatgcagttgtctgtctttccctacaaaactatgagtaccttaagggtagggattgttttatacgttcttttataccacttaccttaccttgtatggtgtctgattatgtaagtgcttaattaatgttgtcaatagaatattgtttgtaaaagatgcttatctttggaagtagctgaagtagtgaaatgttgattagtatgtaagaattttatatactaattttacattagggatgcttgactggttcttcaagtaaattttgtttcctgaaaagcttaaatgtgagtagaaaaactagaacagttgtttgttcctctctgttatagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggtaaataagtttacaattaattgtaatgaagaattttgttaacatgaatgcagaattttattttcattaggtttgctgaattgtattcagatttctcctatagtgtattgtgctgttattatgtaattatatcatcatgtagtcacaacttgaaatagttaaaattttagttctgatatattttattttattttattattttcatttgtattttttgagacagagtgtcactctgttgttcaggctggagtgcagtggtgtgatcttggctcactgcaacctctgcctcctgggctcaagcgattttcctgcctcagcctcccaagtagctgggactacaggtgtgtgccaccacatctgactaattttttttttttttttttttttttttagtagagacagggtttcataatgttggccaggctggtctcgagctcctgacctcaggtgattcgcccacctcggcctcccaaagtattgggattacaggcatgagccactgtgcccggctttagttccagtatattttaatattagcgtttttgctagacataatacactttgctgaaaatcctagcattctgtgaaactgagccactaaaggttaaggagcaaaatgagctgtagcagaccactcttaatctatgcaactttgtaaccagagccctaatgggagaaaaaatgttactttgaaataggagtgtaggtggtgtgctggcagctcacccctgcaatcccagcattttgggaggcagaggggggcagatcacttgagctcaggagtttgagaccagcctgggcaacatgccaaaaccccatctctactacaaatacaaaaaatagctgggtatgatgatgtgcactgtaatcccagctacttgggaggatcacttgagcccaggaggtggaggttgcaaagccgagatcacgccactgctctccagcttgggcaacagagggagatcccgtctcaaaaaaaaaaatatgtgtgtatacacgtgtatatacatacgtatacatatacgtatatagtatacgtatacgtatatatatatgtaaagtttttctttgaaaggttttacatgcatcaaaaaaaaaaaaaaagaatatatgacagaaacctcattgcaaagcctaagctatataccatatggctctttacagaaaacatttgccgaccccctgtctagcgggggttatagcgtgtctgaaagcagtctcagaggatattaaaaatgtaaaacacggctactctgggcacactgcctatggagtagccctgttccacaaggagctgtaccaaaaaaaaatgaaatgtgaaacacaataatgtggaaattcttgattgccctctgaaccagtgtagctaggataagtccctgagccagacagggtggcttttttaaagttgagcactgcagaaagttcagtctgcttagagctgtgtaagtcatgtaggtgttcatctttttattttctaaaattgagctgaaagggcttctgcctaggtagcagccatctgagagcatttttctttcctttcctgctgaagattgtaattgtactcctgctaatctggctccctttgtctaggaaaaattgcatgtgcaccaacacagcacaatacaggacaaagaagggtagttttgaagctaaaagactaataacagtccaacacttttccatatgctaccttcacatgtttgaaattctgtactacaccagaacaactctatattccacctaacaaaatgcagctatccttcatgcgagtgaaaagttttcattatctttccaaaataaggctgtacatagtcccaacaatcatttcatctattcctgactatattaagtagtcctcagatttccaggctattgttacctaaagactaaattctgaagttactctgcaacatctcataaatagaataagggagagaaacagatacaagaaggaaatagttaatatagataaataagcatatacacaaaacaaggagaatgcaaagctactacaaaccttatttctttaatttgtcagtagaccatagctgatatctatgacacttccttcttccactacccatttcatgtcctcataaccagaaaacgtgaagagcatgtatttcagaattgttaatgtgtttttttaattccaaaataacttaagcaattgatttctccctttaggcttagcatagaattggttttgtgtcttggtgtcaaggacactttcattacctcttgaatagtcttgtcttcttgtgggtgttagcctttaaagaatattcttattggtttgaattgattcagttattttctgattttcaattattttatgaaaatattgtccaaagatatatcaacaacatgaggttgtcagtttaattttaatacagtatcataccttgtcatttaaattttaaagagttgaaataagattggcaattaaggtaaacttgaacatttaggtttttttctcgtgtttgataggacaacatcaaaaataaatggtatagaatatgttcctttcatgaatgttgacctgagagaacgttttgcctatccaatgcctttctggtaagtaagcactgttgcaatttttaactccaatattttaacttttcagtactctgaagttcaatttaatagccttgaaattaaaatttgtaataaaaaaatttgttggaatagaggggtggctgtgggaaagggatagggcaacatagcaagagcacttttgttatttgcccagtcatgaggacatgaggatctccttttgcctaatattatttctgtagtgtctagcacagtacctggtgtaaagtaagtactccgtaaatatttgtccaagcagtgattgaatcacaacagaaattctaacacacagtaaagaaactgaatggaaaaggggaatggaatgatgtcattgtttactaagaagaccaattcaagcaaggactatttatgagagaattagttagcacagccttccaggacaatggcagcttatgtcaagagctttaaaaatattgtttggttcaggagtccgagcttgtagtcatcgtaaggaaatcaacagtcaaagatgtacataataaggacactcatcaaagcatctgttgcagcaaaaaattattgaaacaaactggcaatatgggaatgattaaataatagtacatctatacagtcaaatattatgctactcaaaataagtatttaaaactgtaggaaaaaaaatgttcccattacagaaatcaaaaagaaaattatgatgtcccaaattttttttttttttctttttttttgagatagggtctcactcccattgcctaggctggagtgcaatgatgtgatcatgactcactgcagccttgacttctcaggctcaggtgattctcccacctcagcctcttgtatagctgggaccgcaggcatgcaccatcacgcccagctaatttttgtatttttggtagagacgagattttaccattttggccaggctggtcttgcactcctgacttcaagtgatccatctgcctcagcctcccgaagtgctgggattacagatgtgagccactgtgcctgacccttctttttcttttcatgtatttatagatgcatagaaaaaaaaaatgatgtggagaaatatacccgaatatttacagtggttatgtctaggtaacaaaattttgtgatttaacctctttcagtacttttttatttttcaaaatttctccaatgagcatgttatatttattattagaaaaaaaaagctggatgcttactatatagaatatgaaggctctgtaaagaacaaaagggctgctttttattttctagtgttttgctgttcttttgccaagggttaggtatcacaaagccagttaacatatttttttcactcaggtagctgtgtgatgctagtaactgattgggaccaaaggaatttttatatctgagaaactttatagcattaatgttcagggaaagattctagagccagactttctggtctcaaaccttgtgtaacaccgggcaagttgttaaatctgtctcagtttcttgtctgtaaaatggggataataatagaaactacctcataatgttactgtgagttaataaaatgtaaaaccctgagaatggtgctgttatatagcaagcactatataataaaggttacctgctagaaaaatcatcattttgttagttactaagttatataacaatttggctgtatattccaaatactttaacattttttatacctctttgactaatgattttacttcaggaatccagttgtaaggaactatttagagatatactcaaaaattcgtacgaaagcgatttatcattgttgttataattgtgaaaatgaatcagttattctggtattttcttgacaatattcaaatagagatgtaaacttatcatttctatctttttgcaacaaattaatgtaaatcatatttgttatgcttatacgacacagtgtccataagaaaaatgttatatagccataaacaatcaagttttcaaggaatgtaataacatgggaaaatgctcataatataattggaaaagtaaaatacgtagccatgcagactcccttaatttaggcatagcacttgtcacagttggaatttttcttttttttctctttaaggtgattacttgcttaatgcttgtctgctactctagcatataaacttcataaggacagagaccatgtctgttttaattaagttgcaccccagtgcctaccacagtatctggtgtatagtaggtattcaataaatatttcttgaagtagttaaattgggagaaaaacaagaataaatactaaagttactattctaagtggcacggtattttcttattttttaaattattttactttaggaacaatcagaagaaaaagcaacagtaaatgtttttaagttgggttaacagatcatcaggaaaaggctccagaatttatctttcgctagagagattgaattattttttaaaattgtttctattcggtcgtgtattacttttaaaataataaaataagcattattgaataaatattataattgtaagtttttttattttttattttttgagatggagtctcactctgtcactcaggctagagtgcagtggtgcgatctcagctcactgcaacctccgtctcccagattcaagagattcttctgcctcagcctcccaaggaactgggattacaggcgcccaccacacgcccgactaattttgtattttgggtagagactgggtttcaccatgttgtctaggctggtctcaaactcctgacctcaagtgatccgcccgcctcagcctcccaaagtgctgggattacaggcatgagccaccgcgcctggctgtaaaatatttttaatatatttaagttctgagggaaaaaaccttgaatttaataatcctctagtgacttgagagaacaaatattatggaatcttggatttatgctgaaatatggttcatatgacaggttaataatagattacgaatttgaatttgcattaattttttctcctcaaaatttttgagagctgtctttaaactcttctgaattcaattagctcactttctgtttacagttagctcctggtattatacaggtaccaaaatgctacctggaatactagtggttctgtgagatgataataaaaaatgtttgagatatgttatatgccatattctattttaagagattgcaataaacattggcttatttaaagtctagaggtgtccttcaatgaaaaaactaatactttaaccaggagtttgtagatcatacttgaccacaaaatcctctcttctcccagtatctgtcagcattctttgaaaaaaaaaaaagttatgtttgtgccagtttgcatattatatactttctattactaggaaatcttttgaaaaccaaggatttgttgcttctgctctagaaagggtttggggatggttgggcctggtggcttgtgtctgtaataccagcactctggtatttacttcaggaaggctggtatcagccttggctggaggatcgtttaagcacagaggttctagagcagcctgggcaacatatggagacctcaactgttaaaaaaaaaaaaaaaaaagtttagggaaagggggaaaggtagatgtttccccttggtgtacacatcaattttagagaaacattgttacacacagtgagtagagggtaatggataagaatggtggatttggcaccagagacctggattcagatgccagttctgctgtttcttaggtgtctgaccttggtaagtcattaatcactttaagctatttccaaaaataattcctttaatagagttgttttaagaattaagtggattatgtatgtaaagcactttagcatgatgcctggcacatggttagtattcactaaattagctacactcattattagccttgccaagtggagtttgtaaaaaaccagctttgaatctttagcttcctaggtccttttgaatgaatcagcttgtactattgttaatggtttcattttattgctgaatttcttgaatacagttatgctaaatttaaaaaattatattcttaaatataaatgaatttaagttgttcttctgttttcaattatttaggtatattttttaattggaggggatgatcaggttgactggactctataaagagccagatttgaccagaaggttattttaagataatacagtactgctataatcactagaccaaaaaaaaaatctctaggaaatttaattttggctttgagtcatcttttaagattaatttttttattttaatttttattattacctcagtgatagatggggcaagctaccattatcacctaaacaaaaaactacattttccaagtgggtacgaccagaagacctcaccaacaatcctacaatgatatatactgtgtccagttttagcataaagcaggtgagcatttattttgtatgattttatagaaaagtcagcattttaaagtaatttgtgtatagatttgagttttttcttagattttttattatatattcaggtacagaagtgtaattggaaaaattgttcattctacacattttgactgaaacatactgagataatataagtataaatcactgttttgagtgattacagatttttatgtgggccctgtttatcattatgtacctgtaaatgtaaaacttgagaatctgaatttcacctttgataaaggaatagatatcagcaatagaaggatatttaattatttgagtaattattcaaaatcaatttttttgaaatacattatttaattttctaggatttattagaataaaatgtgtgagtcagcagtatggtgtttctatttgttactttcctattcaaataataaccaggaaaatatttagtatacattgtagcactattcaaaataacaaagacatggaatcaacctaaatgcccatcagtgacagattggatgaagaaaatgtggtacataaacaccttggaatactatgcagccataagagaacgagatgtcttttgtaggaacatggatggagctggaggccattatccttagcaaactgacgcagaacagaaaaccaaatactgcatgttctcactgataagtgggagctaaatgatgagaacagcttaaaagaaaggaacagcagacactgggttctacttgagcgtggaggataggaggagggagaggagcggaaaaaataactattgggtactgggctaatagctgggtgttgaaataatatgtacaacaaacacctgtgacacgagttcacctatgttaccttccacatgtacccccgaacctaaaatagaagttttaagaaaagatatttagtataaaaagtaggtacttggggcaatgtacgtatattgcggtaatgttgaaattacgtgaatgaatatgaatatgttaattattcttattaacagacaatagtatcggattgctcctttgtggcatcactggccatcagtgcagcttatgaaagacgttttaataagaagttaattaccgggtaaaaatgtgtctctctttacctctttttgtgtaattgtcccttaactagaaatttaaaacttaagccttatctgtatagaaagtggagagggcatatcattcagaatatggcccttctgtagaaattaagcagatgatttatgaatgtggaaagatacgctaaaacagtcttaagaacctatacacgtagttaatatatatgaaattaatgtgttttgaaataaatgaaattgatcaaagtaaaatcatgtcatattgataatactttatgattggactgttaagtgaggtagtcactagccacatgtggctatagacacttgaaatggattagtctgaattaagaggagatgcactgcaagtgtaaaatgcatgagattttgaaaacttagaacataaaaaatgcaaaattgcaaaatatctcatttttgtgttgattatatgttaaaatcatatttcgatttgtgattaaaacatcaaaattggttttactttttttcttttttttttttttttttttttttttttggagacaaagaatttcgctcttgttgcccaggctggagtgcaatggcgtgatctcggctcaccacaacctctgcctcctgggttcaagcgattctcctgcctcagcctctgaagtagctgggattacaggcagttttacctttttaacttttaatgtggttactgggaaatataacatatttctgttggcttgaactgctttagaatgtattaaaatgtttctgaaatactttttcagtttttaaaagatacattagcttaaaatcattcattgcaaaaactaagcattataattttttcaacttttcctgagcggtttttgtgtgttaagtcctaagagtataaagatgaattagacgcagtccttagtttcaactatttgccatataagtggtccaaatgtattttaaaagaaaattgatactgatagttgttgaagtatgttactgtataatttcatgcaactatatgtcaaagttgtatctacttgccttagttgtggttaattggtctttacttcttagggccagtggtaaaagattattttaactggcttaaaatatatacacttaatagatggtttattagggtatgtaagttaacattgagcacttttcagagtattttgaaatttatgtccactttgtgatctcagaaaattacttactaatagtaaataagcactttgattagggtgtagttcattttctaggcctattgtaggaaaatattctcctgtttgtttttatgaaattgccaagacggtagtatatacctgaatgaaatgtgctgtatagtagttgatattgaatactaatgttggtattttaatatttatttttcttacaaaagcataatttaccctcaaaacaaggatggtgaaccagaatacaatccatgtgggaagtatatggtaaaacttcacctcaatggtgtcccaagaaaggtgaataatgtctctccccactcccatcccttgtctctctccgttccctacctttgaatcttgagtgaaatcattaagaaatgtcatctgtttgaacattttaaaagttagagtctgtgatattatatattactaccagtagcatcatgtgttaatcattaaaaattaattaaaaccatggcaagtataaacttgttttttaaatggttttgagaaaatgtatacagtttcaaaaagtaacgttcaactaaggattgctaatgcttaaaataaattttcatctgatagttcatctgattgttttgattaaaaggaaatcagacaaactaaatctgttaggtcagaagagtgtatatgtagtcataacttaagtgtaagaagcctttgaaattatttccttttaaatatatatgcataattttaattcacacaaatttctttaaggaaagactctgaactctgttataagggccttgcattgttaaggttctccaccacctgtccatgttgagatccatgcagcaacatcagcatcacctggaagtttgttagttttgcagaatttcaggcttcaccctagacctgctgaatcagaatctgcgtttcacctagatcccctgtgatccagcctgaaaatcattgctctgtagttcagtaatactcaaattttagtatgcacagaatcacctggcaggtgattatctgttattaaaacacaggtttctggacctcacgcccagagtttctgattctggaggtctgagatgagatcaaaatttgcatttctaacaagattccaggtgatgctgatgttgttgtctagaatactctctgagagccattttacctgatttacttaaaaagtaaagaaaattattgagaataattttactgaactataattcttgacctcttgtttaaagaatctttaaagatgtatggcataatcttcctattggtgttaaatcaaaattcttatcctcatatctctgagaacactttttttttttttgagatggagtctcactctgtcacccaggctggagtgcaatggcacaatctcggctcactgcaacctccgcctcctgggtgcaagtgggtctcctgcctcagcctcccgagtagctgggattacaggcacccaccaccacgcccggctaatttttgtatttttagtggagacagagtttcaccgtgttagccaggatggtctcgatctcctgacctcatgatcctcccgcctcggcctcctaaagtgctgggattacaggcgtgagccaccgcgcccagcctcagatcactttttaatatgaattagatactgtatctgatgacttcctctgttatttatatgtattttctagccataatgttctactcttacaactatacatgagtctttttataggtttagaataaaatgacaataatactgcatttaaaagtgaggcccttttgtaattattttaaatgtacatttctagaataatataggttgagtatcccttatccgaaatacttgggaccagaagtgttttggattttggattttaacagattttttaatatttgcagaatacctacaagttgaacatctctaatctgaaaatccaaaacactccagtaagtatttcctttgagcatcatgtcagtgatcaagaagtcttggattttggagcatttcaaattttagattttttatttcagatgctcagccttttaatttcagtgatagttacatgacatttaatcaattgattgaaggttatcatctgacagattagcttgtaaaattgaataaagacatcatattaaaaagaacaacattttgtaattggtatgattctagaaacattaccttaatagccgtcagcatattgtgcgttatattttatcagtatgaaaggtatgtttttatttcttgatagaaaggattttaagatattttgtgcacctaagaaggttaatgttctctttctccaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccgtaagtaatagataagacgatccagacacagatttaagctatctaatataactgttttaaatttgaaaaattctagatagtctttttgtttatagggaaagagagcagattatcaacccctgaaacaggatgaccagtccccgtattatggggatatatatattttcttgtgtatccgggaaagcctaaactgtgtctgcttttgttgggatacaaggccaattataaatacagtgtacatttccagagcagtctgtttagatcaaatggatgtgtcatattgtcatgtatttttttatttgtaattcaggttcaaggagttacttgttttatccagtcttaacagaacttaacctataagattgaggtgtcttccagtgaccttttgttgcatgaggtaaactagacttgagccagaaagaaattagtcagattggcatgactttaaattcttacaataaccagcctgtggccttagaaaatgtgtttaacctttcttagcctcttcatgtatccataatataaggataatatccacctcttgtcttaaagtcgtaaagatgaaaattgcatctttattccaataataaaatgaagtgacatatgcaaatcacccatcattcataagtgattagtttccctgccaaaccaggtgtccttgacttttccagttttatgcccagttctaatgctaggcaaagaatatataggtcataattaaatgcaataggatgttacagtttttcttttcccagcctatactttcaattgctctatccttcacatacttttagtttagctttctaattgttgcttgttaatttactcagtggagtttagagagagaaagaatgggaatgtatgtaaaacatgaggaacatcattgcaagaactcactaaaggacttgtgactgcatcgttgaagcagttttttctgttacatgtctttttatcatattcacctgtaaaaaatagttttttattcaggaaaagcaacaaagattgtagggaaaaatatgcatgttcaaattcagttaggaatttgagttaaataagaaatatattactagttgaaaacaactaccttctgatttatttctaccaaaatcattatgccaaatcagtgagatgtaatagctgctctggggatttaagaacttgaaaatgacactggcagtcctgaaatgtgtttctgttgcagaatattgatcttcatgcactgactggctggataccagaaagaattgctatgcattcagatagccaaactttcagtaaggataattctttcagaatgctttatcaaaggtaaacatttttctttgttttatgtgtgtggtaaatgtggccgtttaaaaacatcatgctggctgggcgtggtgggtcatgcctgtaatcccagcactatgggaggccaaggcaggcagatgacctgagtttgggagttggaggaccagcctgaccaacatggagaaaccccatctctactaaaaatacaaaattagccggatgtggtggcaggcacctgtaatcccagctactcaggaggctgaggcaggagaatcgcttgaacgcaggaggcagaggttgtggtgagccgagattgcaccattgcactccagcctgggcaacaagagcaaaactccatctcaaaaataaataaataaaaatttaaaaaataaaaacatcatgcctgatttagaatagagattgcagaagttgtcgtttttagttattaaggaaattgtttttaaaatagacttcacattatgtacttcctatagccagtcctcagttatcttcccttaatagttacagttaatccaaattgtagataatccaaaatattagaatatgtaatatagaaaaattattttagatttactaattagttaccaagttgagggaaagtgggaaaagagaagtctgagaagttaagccttaaatggataatccatatccatttaagggactggaagtttgtctaaacagtgatacacattcggttgcaaaactagaaagctcagtgatttgataaataaaatgatatgcctgtttgggaaatgcctgtggtatttcacgtctttatttttatttgtaaaccacttgaaatttagcgtttgttttccttctttggtaggtttctggtttagaattaagttgccagaaacttaaaaaaagagaaatgtgataatttattttatatactgtgcattagaaatgtacttctttttgaaaattcttcaggggtaggaacagcccattttcatgtaagccattagactaaaagataaaatggtgtgatcttagattacaaatgtgttttactttaattaattgtctttggggttcattccagatttcacaaaggagatgtcctcatcactgcgtcaactggaatgatgacagaagctgaaggagagaagtggggtctggttcccacacacgcatatgctgttttggatattagagagttcaaggttttgccttaaatctttttcttttatttttcttgttggataagacatttcagggatcccagataatttatcagacttctgaatactgacaaatcaaggtttaagtggagtttataaaccatttcacctacattaacttgatctctaccgttgaaaattatgaaattaaaaggtgggaaaggaaatcatagggatggcacagatactgatgacagaacagaaatgctgttacacctctttgtcttttccataaaaccagcagttttgaggcggaatacatagcttccaagattccaagcttcttcttcgtgtttggatcaatcacagtgttaagctctaaagcagtggtcgccaacctttttggcatcagggatccgttttgtggaagacagtttttccacagactggggggtgggtgggagcatggtttcaggataaaactgttttacctcagatcatcaggcattagattctcataaggggaacacagcttagatcttttgcatgcacagttcacaatagggttcacactcctatgagaatctaatgccaccactgatctgacagggggcagagctcaggctgtaatgctcacttgcccactgctcacctcctgctatgcggcccagttcctaacaggccatggaccagtacctgtctgtggcccgggggttggggacccctgctctaaagcatagtagacactgaataaatacttatgaaagtgggccaggcatggtggctcacatttataatcccgatactttgggaagctgatgcagaaggatctcttgaggccaggagttcgaggccaggagttcaaaaccagcctgggcaacatagtaagaccccaccgctacaaaaaataaaaaaaaattagctgggcatggtgccatatatctataattccagctactcaagaggctgaggtgggaagattgcttgagcacagaagatcaaggctgcattgagccatgatcacaccactgtgcttcagcctgagtgatagagaccctgtctgaaaaaataaaaaattgtgaaaggggaagaaaataggaagatagctgggcataagatacatgccagtgtgttttgtgtaagcaagtatttttcttcctagaagcccttgcatgctgtcaggcctttcagacagaccctgtttctgcaatatctggttagaatatttgacttcattacttctgaggttgttgttatttttaactgaaaaatggatttgttctatggattcaaaaataaaaagattattaaacaagtactatttcttaatgaaggacccttgataacagaacgaatagaagtagtgatcagtcagcaataacagagcactactgtgtgttaattagactggttttcttatgtgtggcacatggatttacagtcacgtgttgcttaatgatgagtgtacattctaagaaatgcattgttaggtgattttgttgtggcatgaacatcataaaatgtacttacacaaacctagatggtacagcctactatacacccaagctctgtggtatagcctagtgctcctagactacaaacctgtacagcatgttattgtattgaatactgtaggcagttataacaacttggtatttgtatatctgaacatagaaaaacacagtaaaaatacagtataaaagattttgttaaatggtacacctgtatagggcacttacatggttggagcttgcaggactggaagttgctttgggtgagtgagtgagtggtgagtgaatgggaaagcctaggacattgctgtacactactgtagactttatgaatgctagacatgtagactttataaaaatatttttttcttcaataatgaattgttctaagccagtcaaatcatcagtggtggttgtataccaactttagtgatatgttattaataagttctgattaacccattaccatcggagcagcccaataataaattaaccttggcttactgtaattttttactttataaactttaaattttttttaactttctggctctgtaataacaactagctgaaaacacaaacacattgtagagctgtacacaagtactttacctgagcttttttctgttaatttttttttaggctgttttcttaaaatccgaaacataaacacacacattagcctaggcccacatgggggcaggattatcaggatgtcaattggcaatagaacttttccagctccattataatcttatggaaccactatgatatatgtagttcatcgctgtcttaacatttcattatatggtgcatgactgtatatgaagttaatgaggacagtagggacctattgcaccattttaaaatttatagtcttggaactttctaaattagctggtcagtgttgaaccccccagccatgctctatagaattgcttctttaaaagtggcataaaaattgcccacttaaagcaaaaaatataaaaattatgtgaaattaagtacgccaataagtttggggttttttaaaattataatttgccacaaatgccagtcaaaacattttaagtggctgggcaccgtgggtcacccctataatcctagcactttgggaggctgaggcaggaggaatgcttgaggccacgagttcaagaccagcctgagcaacatagcaagaccccatctctacaataaataattttttaaaaaattagctgggcatggtggcacgtgcctgtagtcccagctaattgggaggctgaggtaggaggatcacttgagcccaatgttgcagtgagctgagatcacaccactgcactccagcctagttgacacagtgacaccctgcctcaaaaaatgtatatttatatataaaggttttctccagtactcttttattgggtatatattcaaggagtttcctaggtgcattatttttattttttattttttgctacttatattttgaagtgtttatttaattctgacttctttttttttttttttttttttttttgagacagtctcactgtgtcgcccaggctggagtgcagtggcgcggtctcagctcattgcaagctccgcctcccaggttcatgccattctcctgcctcagccccccaagtagctgagactacaggcgccccaccaccacgcccggccaattttttatatttttagtagagacagggtttctccacgttagccaggatggtctcgatctcctgacctcatgatccacccaccttggcctcccaaagtgctgggattacaggcgtgagcccccacgcctggccaattctgacttctgttttaaaatatttccatatttgattcaagcatttatctctaggacctcttttttgcagaaagacctaatcttagactctgacagctctgctcagtattacatcattggtgactttcttcacttaaagagattttcaatatttattaatatttgcataaaagtgctatcatttttgtttgactacctctaatctgcttgcatattccaaggtcttcattttagtctcagcgattctctctttgggtcatttttgtgtttttgaggtgatgtttcatagtctactatggagttacatctccagatcagggtgctgacttcagttcagacaggtgttatcatagaatttctgaagctgtccaaggcttttcctttgctgctacttggaaataactttagaaattggatgcttcagcaaaatcaaattttttttttttttttttttttttgttctctagcattccttctttttagagctggttctctacccatccaaacaaaatctacatccatatcttggtgtccttgaatatcactgatgctgggggtctgtctctgaaaagcttagcaacaatttgctctcctttgtgctcctcttttaggaagtgttgagagtcctgaaatgagttaaattttttgaaaagaaaggaattagagttaaatgtcggttgacttatgtgtggtgagacacatacagtgtagaagatactgatgaaagaaactgtattaatgaagcttctagggaatatagcctaagaggaatgagtcttatgtccagaaatcacatacatctacccccagccacaatttgtcaccatttaaaatagcaaaggaatgtgttgttgtggttgtttagatgtcttccaaacagtttgatttatgatatcattagaaaaagtacacaatttcctaaggtgactgcttgcagtaagacaaatattattttggatttaccacctcttttattttcccgaatcaatgtaatcaattctgtagacatgcctggtatttactaagcatttacctttacattctgttccataaatgagtggaaaatctgaaaagggatgatagtgttaccatttcaaggagttgatgattacattggggagacaagatgactacatttgtaggaaacagtataagataggatactatttgttttaaactaatgtaatacagattgctagcactatgaaggttggagaattcaaagtaattaaaagaaagaaattactaaatgctagatactttatgttaattccatttgatcttcacagccatcttctagggacacatcataatcttcattttacatatgagtaaatgaatgttcagagagggtaaatgacccacccaaagaactggaatttggtcccattttattctgaccccaaagtccatgttcctttctcttttcttcactatgtctgtctgcactgagaagaaagggtagctaaagggatcaaagagggcctttcagaaaaagggaacagcatgatcaattgcctttagaggcaaaattgaataaggattttattgcactctgaaaggaaaaactagattagagccaaaggtacatggagtataaatactggaaaataaagtggagccagagtagagtgagctttgaaaaggcagaaaatacttcatgctctaaggcagtactgtctaatagaactcctgcaatgatggaaatgttctgtatctgggctgcccaatgcattagccactatagctactagctacctgtggtcatttaacatttgaaatgtggctgctgtgactaaggaactgatttttgaattttatataattttaacttaactacatgcggtgaaagactgcactattagctctagggagtaggcagccatttacagtttttgatcgatgtatgacctggtgaaagtgttaaaaatattaatttcaagttgatttgaggggaaaagaattgataagtactcagttcatcctctaataagagaactaatatggtaaaaactgttttacaacttaatgttatctcctgtttcttttttatataggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggtaaatatatctttttaattttaataccatttattcttcaaaaaaaaacatgttttaacaagacaaaacatgtgtaactgacttaaatcatttagcattaagatttttttagattaacaaagatattaattttcaggaatattttggatttcctgggatgatctctgccagtattatgatgtgatttatttgagttggaatccaggtctttttaaagaatcaacatgtattcacaggtaactttttgcacattgcagagtatgctttataatagcatccactttcctcacttaaaaacataatggtgccaggcgcagtggctcatgcctgtaatcccagcactttgggaggccgaggtgggtggatcagttgacctcaggagttctagaccaggttgggcaacatggcaaaaccttgtctctacaaaaaatacaaaagttagccaggcattgtggcgcacacttgtagtcccagctactcgggaggctgaggtcagcagatcgctcaagcctgggaggtggaggttgcagtgagccaagatcatgccactgcactccagcccggacaacagagcaagactctgtctcaaaaaaataaataaataacggaatggttaatttaggaagactagcattccatctttttgtcacgcccacagtgactatcttgttaatagttgttttctttccatgcttcctagttatgccaaaaaaatttaaaaacagtaaaacaaaaccaaaaacttggatagcttaattcactttttgaaatagtgttatattttagctctatgagaaatttaattacaaccttctttgttgactttatcttttagtacttgggatgctaagcaaggacctgtgaaagatgcctatagcctggccaacaacccccagtacaaactggaggtgcagtgtccacaggggggtgctgcagtttgggttttgcttagtagacacataacagacaaggtactgatacccttctaatgatatcccatacagaaatttttttaatatagttagaacattgtgaaagacatacgtaaacaccagcctgtttaatttacataggtgccctgagaatagtgttttctcagataaatgaatattttcctctaaggaaatttgtattttataattatacacttaaaatcttgttcaaaagtcatctctgaagaaaagtatgagggagtttgtgcttttcagtgagggtttgggggttgatcgtgtatagtttagatcttaatattaacattgaaatatgctgaagggaatttggaaatgttgaatcattagtcttgattctgtaaaggttaaccataatcttaatagcctccgaatcttaatatacattcatacattgtggtcatctattaaaatgacaatttaattcagaaaaacaatgtttcttatagcactaaatagctgaaaacaatgctcttaaaattagagattttttgtggagagatttagagcatttttttggagagatttaaaaagaaaataaatagcattttgaacccattttctaaccacattggattctttgtgattttaggatgattttgcgaataatcgagaatttatcacaatggttgtatacaagactgatgggaaaaaagtttattacccaggtatgtttagtagcccagcaaacattaaaataaacatacataagattttatttatatgattaagttgaaaaatgacacattttatgtagataatatagagaaataattatgttgatagactaatagaaaccactcaagcagatgggtattcatgctgttctgtgttttgttttgatttgttttaatttggagactccaaggggggatttccatattctcgcacatggctgtcagaattttatttctgaaacttaaatgatgtcttttactctaatcaaatgtattctgtggttttccttgaacttctggataaaatctaagctctttagcatgatatataaggctttttattcccaccttaatctacctgcccccctttatttcatgccccagcttctcacagttgacatagttgctactccagaatacaccatgcccttgttgccttctttcacatggtttcttctctcaagaatctctcctcctgccttattcctttctccctattctgcttaatgcacatagttaaggtccagcctaaataccattccttccactgggcacctgagatatttaacacattgtgttgaaaccactttgctttcacatttttaaaaaatgtgtatcacttagtgagagaaactatcttaaggctctggagaatagtgatgaacaaaacaggattctgctttcatagagtttatgttctagttggggagacagttaataagcaaaatatcaagtactgatacacgtgtaaaaaaaagggttatgtgtgagtgactggttgcttttggtgggtggtcatagaagacctctttgagcagggatgagaagagctatgaataacaaaaaggaaccagtcatgcaaagaaatcaagggaaaagcattacaggcagagggaacagcaagtacaaggaccttacagtgagaaaagatggtgtatttttgggacagagaacaggccaattgcctgggtaggtgtggtatcaaaagaggtcagaaagatttgcagaggtcagatcacatgaggttctgtacaccacaggaagggttcggagagtctttggcttgtcataatcaggaaaatgacatgtcctggctccaaatgaagatgcagctaggctgttggatttttgaatagagttctggggtaagggtagagatacagataggggagtcaggagcatatagatggagtttgaagataggactgcataaatcacctgtgaagagagttgtgggtacagagattaacacccaggatctgacccttggactctcagacaccttgaggttcagcagaggaaaaaggtaccacaaaagaatttgaacagagggcctgatgaaacagtgaggtttcacataacccaagcaaagaacatttttcaagagaaaaagaaaggacagttccatctattgatgtttgagaaatcaaatgagattaggtgagagaagaaactattgtgggaactaaatgataagaacttacgaacacaaagaaggaaacaacacatactgaggtctacttgaagtggggggagggtgggaggagggagaggaatagaaaagataactattgggtcctggcttaatacgtgggtgatgaaataatatgcacaacaaacccccatgacacgtatttacttttgtaacaaacattcacatgtacccccaaacctaaaataaaaattaaagggaagaaactattggacttagcatcgtggcagtcagtcattgttgaccttgataagaacaggcatagtggagaggtggggctagaagcccagttggattggttttaaaagagactatgatgtaaggaagcaactgttgacagttcttgcaagaaagctgtgcaaagaaatgggcagtgatgggaagatgtgatcagaagtggtttaagtcttactttgtttaatcatagggaagtatggcattcttccctattacaatgtgttgatggcaggcactgagtcttgctagtcaatatccctgcgttctggaatgggcatggcacatagtaggtccagtgacaaatatcgagttaaactagccaagctttcctttttttaaaacaatgctccatcttatgtatagtgattttgccttttcagaatactttcatgtttataattttattttaattacaacactctgcagtaaataggacaggccttgttccctgtttgacagaagagtaaactgaaacatggaaaggttaaaaaccttgttcaagatccacagatatgccaattctttactcttctcactagaccacaccacccctaatcattagagacttatgatttgtttgagataccaaaatacttagtttttctgataggtcccattataaatattcagcgttcctaaataagctaagtgagaccatcgatcttaacatatagtaattgtcatgcataaaattttattgtatcaggcttgactgatgggactatcaaataatatattaggcagcattctttgtaataacaaaatattgaaaataatctgaatatccagattttctaaataagcaattgggggtgtagataaaatgtcatatttgtatgatggaatattatacaggcagttataagaaataaacttatctgtatagaacaacatagctctttttaaaatgttgagtgaaaaatgaaagatataagacatgcactattttttttaatatatacacttataccagaaacagttatttttttcattcatttttaggagtgggtacgtttgtattcaagtctaaaaagatgctgactaaatccatcaatagaagggaataagataagtgtagtggttaaaagagacattgttttatgaaaaggctagaatgaccaaaaaaaaaaaaaagttaatttaaacctgagtggtggggaatatatatttttatatacttctttttatttttttaaatttcatctcaaaaaaaaaactaatcctgactttaagatcctctacgggagaaaaatgcaacacagaacaaatagtaggaattactgaaatgcaacacagagcaaatagcaagtactattatacttcattgaaagtattcaaaaagattatttttgtttattaggaactgtttaattttaaagttttcaactgaaattataattcactaatatcattatattttaaggagagaatcagttaaggagatgtccatccaagtaattatttttcctacatcaaccataaaattaaagaaagaaaagtctccttttctctaagcctacttgtttgtttgcagctgacccacctccatacattgatggaattcgaattaacagccctcattatttgactaagataaagctgaccacacctggcacccatacctttacattagtggtttctcaatatgaaaaacagaacacaatccattacacggttcgggtaagtaaaaccaacacacaatgacaaaacacagtaatataaagtatgtaatatgctctgctttgtaagtggtattatctggagaaaaagtttatttctgaaaatgtattgctctctttttttgtgcttatcattttaatagtaaattatactttctgtagaaaataatacatttgaaaagaaatgtctttattttgaaagagcatttttattttcatagtaatagtttagccccgtggtaatatagtatgttggactaataatacatttctttttttctttttgagacagagtcttgctctgtcacccaggctggagtgagtgcattagtgcaatctcggctcactgcagcctccacttcccgggctcaagtaattctgcctcagcctcctgggtagctgggactacaggtgctgccaccatgcccagctaatttttgtattttttgtagagatggggtatcaccatgttggccaggctggtctcaaactcctaacctcaagtgattcacccacctcagcctcccaaagtgctgggattactggtgtcagccactgcacccagccaatatatttcattttaaagcaagcaataaaaacttatttcgctgtttaatatttttattgactttaaaaagactttgaacttagtgaaagagaatcagtcacctagaaatgtactgctctcatctagctgggaaggtcattgtaattttcttctatatagatttgtttgctctagataagcggctcaatttgaatagatttttagtgatgaaagggacattgggagctgctgccacccattcctttttcagatgcagaagccacagcctggaaaaattgtgatttgtcctgaggcatacagttactagcagagaaagccaagaccagacccctagcttctcagttcccagctcattaaacctgacctgatactaggctgcctataatgacttgtgtatgccaactgatttttttagtcttccaatatattcatgtatcactttgatgttcttgtaagtgtaaaatttatcaatacagtctttttttaaatctaggtatattcagcatgcagctttactttttcaaagattccttcaccatacaccttatcaaaacgggtgagaaaattcatttggttgtaatctcagcattcttttagaatttttaaattccctttcccatttctctcattttattgtttatatttagcaaaggcttcacaggaatataagggaaacgtaaatggcctcaatttgggttggaatacaagatcttcagtgagcaacatctgtgaaaagaaaattcagagaaagaagatgaatgcaaactttggttgttagagaaggcaatgtggatgaaccttaaaagtagcatttgagactaactgcagggtgggctacatgtatagaggaagattctatggaaaattcctggtagaaagaacaacttgattagaggctaagagatggaaataggggttagtggagcaaagcagcctggctgtcagcagcaaataaagatgggagagaggggttggagacacagagtggaaaattgccttttttttttttttgagatggaaaggagttttgtctttaagtggaattggaaatgaaattttgttaatactaaaacttttgtttttattagattaatggaaagtggagtggtcagagtgctggaggatgtggaaatttccaagagactcacaaaaataaccccatctaccaattccatatagaaaagactgggccgttactgattgagctacgaggaccaaggtttgtgatgagtaactttcttaaattaatgatgttctattacaaatgaacatagtataacaaaaaagtttagaaacagacctaagcatatatggacattggatttataacaatggcattatagtggagtgaggaaaggacaatcttttcaataaatggtatggaataattgagtatccatgtgtaaaaagggtaattagaaccctgtttcacatcaaattccaggtggattacaaacctaaatgtgaaaggcaaaacaatacagcttctagatgataatgcaggaaatgttttaacctcaagagaggaaagatttcttaagacaaagagcatattaaaatgtttgtaaatatgctgcattgataagaaaaaaatctgcagtttttaaaaaataaaaacacattcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtgaggggaggggagagggatagcactgggagatatacctaatgctagatgacgagttagtgggtgcagcgcaccagcatggcacatgtatacatatgtaactaacctgcacaatgtgcacatgtaccctaaaacttaaagtataataaaaaaataaataaataaataaaaataaaaaaataaaaacacattataaagggggcaatccagatggccagtaaaccattgtaatagccagaaattggaaacatatattcattgacaacatttaagattataatatagtcatataatagtcctgatataacaatggaaataaattacagctacacacaacataatggataagtcttaaaaagccacatgtacagaatacataccatgtgattctacttctgtgaagtcaagaacagacaaaactgaaatactcatgtaaggatgcacactaaggtagtaaaactataaagcagagcaagagagttattactataaaagctctgtcgagggacaggagttgcaattaggaatatacagggaattctgtggtgctgagaggatttgttgatctgggtgatggttacccaggtgtttattcactttgcaaatgattaagttgtatatatgttttacttaagtgttatatttcatagttttaaaaggtttaaaaaatatagagaatacagcctgggcatggtggctaacacctgtaatcccagcactttggaaggccaagacaggaggatcgagttcaggagttcaagacccgcctgagcaacatggcaaaacctcatctctgcaaaaatttttttaaaaatttagccaggcatggtggcatgtgctttgtatagtcccagccacttgggaggctgaggtgggaggatgacttgagcccgggaggcagaggttgcagtgatcccagatgatgccactgcactccagcctggttgacagagcgagaccctgtctcatacaacaaccaaaaaaaaaaaaaaaaaacaaaaacagaatacaaataaaaacagaactaccttctaaataagattgggcttaattttgcttttcttacaaactaatccagcagcagcagttaataacccattagatacgaagatttgattaaactatttttccacaagaaagtcatttttaaaacctctaccagtttgataggtgaaataggtaaataaacctatttgctcttttgtacttaatttctagatagattgaacatgtaataatgttcattacaatattgtttattccctattcatgtttcttgcccatagagttgtcattttttttaattataagcatgaaaaaggtaagggtattaactccttcacatatttgtggatatttttctcagattgtcatttttctcccacatagaaaaacatttcattttaaaataatgaatctgtcttctggtttcattttgctgtggacaggaactctcaccacattaccaaattaattttcaccatattctgattattttatggttcaattttttgcatttaaaaaattcatatgaatatatttttatatttggtatgaaatacaatttaagagtttttttctaaattttttgttacctcatcaccatctaaatgaatctttccttactgatttggaatgccacgtttataatatgctaagtacttctgtaaattcagagtttgtttcagggctttctttcctgtcccataggcctttccatttgttacaataacaattttttttttcttttttttttgagacagagtcttgctctgtcaccaggctggagtgcagtgtgtgatctcggctcactgcaacctccgcctcctgggttcaagcgattctcctgcctcagcctcccaagtagctgaggctacaggtgcacaccaccatgcgcagctaatttttgtatttttggtagagacgggatttcaacatgttggccaggatgctcttgatctcttgaccttgtgatccacccacctctgcctcccaaagtgctgggattacaggcgtgagccaccgcgcctggccaatgacaatatttttaattataccctgtggccaggcgtggtggctcaaggctgtaatcccagcactttgggaggccaatgtaggaggatagcttgagcccagaagttccagaccagcctgggcagcatagtgagaccccctgtccataaaaaaaaatttaagaaattagacagatatggtggtacatacccatagtcccaggtcctgaggaggctaaggtgggagaatcccgagtccaggagggcaaggctgcagtgagccatgattgctccactgtactccagcctgggtgacagtgagaccctgtctcaaaaataaaaaagaggtcgggcgcagtggctcacacctgtaatcccagcactttggaaggccgaggctggcagatcacctgaggtcaagagttcgagaccagcctctccaacatgatgaaaccccgtcactactaaaaatacaaaaaaatttagccaggcacagtggcatacccctgtagtcccaactattcagaaggctgaggcaggataatcacttgaacccaggaggcggaggttgcagtgagccaagatcgtgcctctgcactctaacctgggcagcagagtgagactctgtctcaaaaaaaataaaatatttcccggggagcccatggtaaaaatacagtctctcttaaagtaagtttaatctggtgttaatctttaaggcttcaactgaaaaatataaatggtgtgttatgatcaaaaatagagtgtgtatgtttctactgaaacttcagaaacataaacttagtatgacatctgcacttcagataaagttattttaaatcacgtttgagaatatatattaatacagtaattctgttcattttaaatgctaggcaatatagcgttggatttgaggttgtaacagtttctactctaggagatcctggtccccatggctttctgaggaaatctagtggtgactataggtaatgttggcatttttattgtatctattttatactttactttttgtggcatcatcttctataaaccttattctcattttctctaaatataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatact

SEQ ID NO: 36395 - DNA, 18649 bp, Homo sapiens
aaaagcaaggataagcagaaagggacatggattttagttgatggatgactcactcactacattcaactgaactgaatctgctctataccagcaaagggacaaattcagaaaataaattgaagatggccatgctgtaacttctaaacatggtttgcttctcagatttacctaaactaagaaaggtttgtgttaatctctctgttttagcttattaagaaagagttgtttgaaatgtttttatctttttcttttgaattctatggtactgtatatatgtataccagtttttatgtcatttgctatgaaagctttaatttgtagctaaatactactgctccttctttcaggaaatactatgtgttgtcctttatgaaaaaaatattttctttctttttatgattataaaagtaaaatgcttatagtaaaaaattaaaatacatgtaattacaatatattaagtatataatttgtaatcccaacatccagagctaatcaccgttaatattttcatgaatatccttctagacttttttgtatacatctgtaaatgtaactaaacttataataatggggccatattattctattttataacatcaatttcactgaaatgaaatatcaaatgccattttatgtatgtttatcatttctactggttgcatagtatcacaccgtggatgtagtcgattatttaaccagtttttcttgtattattattttatgtttttagcttatgactattataaacaacatgaattacatctttgcttacattattattatttatgaaccataaatgagacttaacttgcttactttttttttattttttgagacagagtctcactctattgcccaggctggaatgcagtggccagatctcggctcactgcaaccttcacctcccaggttcaagcgattctcctgcctcagtctcctgagtagctgggattacaggcatgtgccaccatgcccggctaatttttgtatttttagtagagatggggttcaaccatgttgctcaggctggtctcgaactcctgacctcgtaatccgcccgcctgtgcctcccaaagtgctgggattacaggcgtgagccaccgcgcctggccaacttgcttacattttaaagtgctttgggttgttgggtcagagtatgctattattattattattattattattattattattattatttatttttttttgagacagagtcttgctctgtcgcccaggctggagtgcaatggtgtgatctcggctcactgcaacctctgcctctgggttcaagtgattcttctgcctcagcctcccgagtagctgggactacaggcgcccgccaccacgcccgactaatttttgtatttttagtagagcaagggtttcaaccatgttggccaggctggtctcaaactcctgacctcaagtgatccgctggcctcggcctcctaaagtattgggattacaggcgtgagccaccgtgcccggccagagtatgctattattaacataataaagtcaatggaaagtttctctatttcaggaatacaactatattttagaaggttgatgcttttgcaaatcgtattaacagagccgggcgcggtggctcacgcttgtaatcccagcactttgggaggccgaggcgggaggatcacgaggtcaggagatcgagatcacggtgaaaccccgtctctactaaaaataacaaaaaaattagccgggcgtggtggcaggcgcctgtagtcccagctacccggagaggctgaggcaggagaatggcgtgaacccgggaggcggagcttgcagtgagccgagatcgcgccactgcaccccagcctgggcgacagggcgagactccgtctcagaaaacaaacgaacaaaaaaaacagaacaaaggctgaagaaaggaactaaagactctagaactagttatttaaaaagccaaagctatcactattttacattcctaaatttaaatgattaaacttaagagaaaacagataatctcttaatgtttctttccggcaaatttgaagtttgcttacagaggaaaaataatagtttagtaaaaaatttaaggagctgactctaaagccacaatgattgggtttgaatgccagctccagctgtgtgacctcaggtaaattaaggtgtgcttccgtttcctcatctgtaagatgggggaaacaacatacttaccgcataggattttagtgatgaacacatcttgtatcttagtagtttgtttgattgtgtaacagttccctttatataaaggggacaggacatacatttatattttaaatgaaaaataatgaaaatattcacttttaaaatctttcctttggggtatatttcctctgagataacctgggataccaaccttaatatgcaatctgccggcaaataatccaagcagctaaattataacttgccccactgcttccttcaagagagcagctatatgtcttaaataggtcaaatactgctacagtgaaagtttccataatactgccaccataccagtgaacaatctattgcaagtaatatctataatgagattctggtaccataaggccgggcgcagtggctcacgcctgtaatcccagcactttgggaggccgaggcaggtggatcacctgaggttgggagttcgaaactagcctgaccaatatggaggaaccccatctctactaaaaatacaaaattagctgggcatggtggcgcatgtctgtaataccagctactctggagcctggggcaggagaatcacttgaacctgggaggtggaggttgcggtgagccgagattgtgccattgcactccagcctgggcaacaagagggaaacttcgtctcaaaaaaaaaaaaaaaaaaaagattctggtaccataaaatagttgagaatttttggagttctttttgttttctgagacagagtttctgctcttgtcgccaaggctggagtgcaatggcgcgatcttggctcaccgcaacctctgcctcccaggttcaagtgattctcctgcctcagcctcctgagtagctggggttacagatgcctgccaccacacccagctaattttttgtatttttgtagagacagtgtttcaccatgttggccaggctggtctcgaactcctgacctcaggtgatccgcatcggcctcccaaagtgctgggattacaggtgtgagccactgtgctgggcttgaagttcattttaacgtaagaatttacaaaatttgggctgggcgcggtggcttactatgggaggccgaggcgggtggatcactcaaggttcaggagttcaagaccagcctggccaacatggtgaaaccccgtctctactaacaatacaaaaattagccaagcgtggtggcacttgcctgtagtctcagctacttggcaggctcaggcacgagaatcacttgaacctgggaagtggaggttgcagtgggctgagatcctgccactgcactctagtctgggcaacagagtgagactctgtctccccccaccaaaaaaaaagaaaaaaagtatactttttcatagtaaagtataataagtactttatacatattcataaatattactgagatgaatttctgaaaatgttcaccaattgccaggaagaaaccagaatttatttcaaatttatttcaatttggattaaaaaaactaatctaaattcctatgacagccagatctgtttcctctggtttcactgaatgccatatcttactgaattatcaaatgaagcatattcgttttcctatgtgtataaatgagatttaaaaatcactgactttttgaccgggcacggtggctcatgcctgtaatcctggcactttgggaggctgaggcgggtggatcacgaggtcaggagatcgagatcatcctggccaacatggtgaaaccccgtgtctactaaaatacaaaaaattatcccggggggtgttggcaggcgcctgtaatcccagctactcaggaggatgaggcaggggaatcgcttgaacccaggaggcggaggttgcaatgcgccgagattgcgccactgcactccagcctggcgacagagcaagactctgtcccaaaagaaagaaagaaagaaaaaaaaatcactgacttttcaagccagtaatggcatgttggggaaaaagaaattgactttgttataacttttatatcaaataatcttaataaataaggttaagatcaggttactagttttagaaacctttccaaaagttctgttgaaaaacaacaataggctgggcatggtggctcacgcctgtaatcccagcactttgggaggccgaggtgggcagatcacctgaggtcaggagttcgagaccagcctggccaacatggagaaacatcatctctactaaaaatacaaaattatccgggcatggtggtgcatgcctgtaatcacagctactcaggaggctgaggcaggagaatcgcttgaacccaggaggtggaggttgcggtgagctgagatcatgccattgcactccagcctgggctacagagtgagactccgtctcaaaaaaaaaaaaaaaaagaatataattttaggccatgcgcattggctcatgcctgtaatcccagcactttgggaggccgaggtggccagatcatctgaggtcaagggtttgatctcagctcactgcaacctctgccttccaggttcaagcgattctcttgcctcagcctcccgagtagctgggactacaagcgcctgccaccacgcctggctaatttttgtatttttagtagaggcggggttttaccatgttggccaggctggtctggaactcctgacctcaaatgatccacccaccttggcctcccaaagtgttgggattacaggtgtgagccaccccgcccagcctatattcttaatagagaatatatacactcctcctccaggtatcatgtttttttcattgtattgtgatgtctaaatataagtgattttaaattcctgacatttaagtatattattggtaacagattcacactttggccaggtgtggtgacccacacctgtaattcccacactttgggaggtgaaggcaagaggatcacttgagtctaggagtttaagactagctgcagcaatagagtgagaccctgtctctacaaaaaaataaaaaaaattatctgggtgtagttgcacacacctgcagtcccagctactcaggaggctgagaggggagatgatcgcttgagtctgggaggttgaggctgcagggagttgtggttgcaacactgtactccagcctgggcaacagagggagactctgtctcaacaaacaaacaaacaaagaaaaaaccccacagctatctagggaaaaagtaaagcaaccagcatatagaagtgacatattgttatattttcaccataggtttgctttaagaaatagtgctcccttcagaatggaagaatttatctgcctcttatttgatgtggatcagagctaagatggctgactaaataaacatgggggactggaatctccttggagatactctggaggaagttcacatccactccaccatgattggaaagatctggctcaccatcctgttcatatttcgaatgcttgttctgggtgtagcagctgaagatgtctggaatgatgagcagtctggcttcatctgcaatacagaacaaccaggctgcagaaatgtatgctacgaccaggcctttcctatctccctcattagatactgggttctgcaggtgatatttgtgtcttcaccatccctggtctacatgggccatgcattgtaccgactgagagttcttgaggaagagaggcaaaggatgaaagctcagttaagagtagaactggaggaggtagagtttgaaatgcctagggatcggaggagattggagcaagagctttgtcagctggagaaaaggaaactaaataaagctccactcagaggaaccttgctttgcacttatgtgatacacattttcactcgctctgtggttgaagttggattcatgattggacagtaccttttatatggatttcacttagagccgctatttaagtgccatggccacccgtgtccaaatataatcgactgttttgtctcaagaccaacagaaaagacaatattcctattatttatgcaatctatagccactatttcacttttcttaaacattcttgaaattttccacctaggttttaaaaagattaaaagagggctttggggaaaatacaagttgaagaaggaacataatgaattccatgcaaacaaggcaaaacaaaatgtagccaaataccagagcacatctgcaaattcactgaagcgactcccttctgcccctgattataatctgttagtggaaaagcaaacacacactgcagtgtaccctagtttaaattcatcttctgtattccagccaaatcctgacaatcatagtgtaaatgatgagaaatgcattttggatgaacaggaaactgtactttctaatgagatttccacacttagtactagttgtagtcattttcaacacatcagttcaaacaataacaaagacactcataaaatatttggaaaagaacttaatggtaaccagttaatggaaaaaagagaaactgaaggcaaagacagcaaaaggaactactactctagaggtcaccgttctattccaggtgttgctatagatggagagaacaacatgaggcagtcaccccaaacagttttctccttgccagctaactgcgattggaaaccgcggtggcttagagctacatggggttcctctacagaacatgaaaaccgggggtcacctcctaaaggtaacctcaagggccagttcagaaagggcacagtcagaacccttcctccttcacaaggagattctcaatcacttgacattccaaacactgctgattctttgggagggctgtcctttgagccagggttggtcagaacctgtaataatcctgtttgtcctccaaatcacgtagtgtccctaacgaacaatctcattggtaggcgggttcccacagatcttcagatctaaacagcggttggcttttagacattatatatattatcagagaagtagcctagtggtcgtggggcacagaaaaaatagataggggcagctctaaagaccagctgttaagacagacaactgcaaactcatttaagcaagagaaaaacagctctaattcgagattgtgaagcaacacttctaaattcaaagacatagagttgtcaaatcaggatttttttttttttaaatgatatcctttcgaatgtaactgattttgggaaaatcacatgttcagaattgaggctaaatggtttgatcaggttttctctttgaagagaccacagccttaggaaatggttcttgatctatacaattccaccttggacactgggttaattctgtttgcccctggaacacaatcacgtaagtttccttctagactggcatcctgatgtgtcttgagtataatcacatgttgctacctagtaaataaaatcttaagaagatccgtggctttccttcaccagttcatagcatcgtgattcattgcccggattggactcgactctactcactggacatctaaccactccacttaattaacaatacccaccctacaggggtgttgtaaggattaaaatttaaaatacccgtgttttctacagtgcctggctcaaaagctactgcaagctcgttactgctcatcctccagaggcccacatcaagtcagccacgactcaaggagactccaaagataaaagctgaagccaaaatatatgattctaaacaccctcctcggctactgcaaagcactgtgagcactttctcaggacgagagccaagaagcccagcacctatgggtcaccacagtttccgaggtcccagatgaaaaagatgcgctcgctaccaccgtgcggcggtcctttctctcgcaatagtctcaatgctcccgggccctgcctccggacgccaggacagaggtaccaaaatctcacctcctgcaaagaaacctaattgctacgggggccggaagaggaagaggtgcggctccgacagccagaggggcgggcatacgcagcctccctcggctcagcctgctactggggatgcagagcgtcctggtcgccatgaaaacaggccacacctcggcgatcccggccggtggtttgcaagtgcgcaggcgcgcgcccccttccgcgcatgagcagtgctgctcccaacccgccagtcgcggtctccggcgccagctacgccgctgccgctgtcactatggcccattacaaagtgaggggggcgcggcgtggctgggggcatgcgggcggtagcaagccgctggtcggctctgggtgggagtggggtcgcgcgcgcaggtttgggcgggagggccccgaggtagtgaggcggaggcggggttgccggactcccagcgccttcttcctgctcggctcccgggctctggccactgacccccggtgtctcttcaggccgccgactcgaagcgtgagcagttccggaggtacttggagaagtcgggggtgctggacacgctgaccaagggtgagcctgggctaggagagggtacctcgtgccctcgtcgtgctccccggcgctgccccgttccccagcgggccgtagcgtggggaaggaggggaaacagatggggcccgtccggggtccagcgaggtgggcctcggggttcagcagggacctggctgctggacgccgcccgggtggggtagcctagctccgctacccttctccgcaccgggagtgaaactcttgcagctgttgcaaagtctcttcaacttccgttgctttgcctccagcagccgcagtggacatgtttgccaaggaccttcagatcccaattcctcccaccttacggtttttatggagtcctcagaatcttgttaagaaagtttccctccaacaaagagcaactggaaaaatgaccgaatttccaagtgggctatgaagtagctgagtgagcctaatccccaaagtaggagattcatagcgaatttggctgtggcttttcagcccccattccttagtctgtctgtgtcaattcttattttgtgtatatttcataaagtagaattacagcttaaagagctcgagggcatatcaaggtggttacattgttttcactttttaaaatgaaagcttactgttaacgctgtatctcttcattcgtggcttcaagatctaagttaagtagatgagtaaagtgttggaaacaggaggatttcaaggggtagggtacagtttactttattggcttagcactaatttgaatgcctgctatgtgtcactcaactcactgggatattcaagggtgtagaatggaattgttcgcagggatgaggacttgggtcatatgaaactaggaagtttgggaagtgggaaataaattggtaactgccctttggacagaagcaaagtttagaggaaaattctaggagcataactcctgggtcttagaagaaagaaggctagtaattttgaattgctacctatttggggttcagataatagtttacctctttgcaaataaacttcagcaagtcttaagggactactctgtgaaagtactgtgctatgttgtctctgaaagtgtcacagatgctttgaatgtcattccgtctaaaaactccttacgttcatttctttcatttaataattttactcaggtgtctgttctgcacactggagataagcaggggaggataaaagtctcggctctcataagcttatatcctagttgagggagagaaatacataaataaatatgtagtgtcagctagtggtaagtggtacagataaaaatacagcaaagttagggataaagagtaacaggtgaggccaggcacgtggctcatgcctgtaatctcagcactttgggaggctgaggtgggtggactgctagaggccaggagctcaagaccagcctgggcaacatggcaaaactcccatctcttaaaaaaaaaaaaaaattgctgggcatggtgtgtgcctgtaatctagctactgtggaggctgaggtgagagaatcacctgagcccaggaggtcaaggctgcagtgagttgtgattgtgccactgggcaacagtgacactctgtctccaaaaaaaaaaaaaaaaaaaagtgacaggtgggatgtgtgtgtcattttatatagggtgatggggggaaggcctttcttaagaagtaatttttgaccagaaacctgaaagaaacagagtttcaggaagtctaaggaggccagagtggttggatggagcaagtgaaagactgaatggtaaaaggcagaaaaatgacagttgtaggcggtaactgactacacagaagatgttgcccaggctggagtgcagcggcatgatctcggctcactgcaacctccacctccgggttcaagcgattgtgttgcctcagccttccaagtagctgggattacaggcatgtgccaccatgcttagctaattttttgtatttttagtagagaggcggtttcaccacatgggccaggctggtcttgaactccttacctcaggtgatccgctcacctcagccccgcagagtgctgggattacaggtgtgagccaccgccctccactagaatttaacctctcaatctccttagatttccaggctcctaaataacatcagccaacacagtattgatgtgatttattaaaaatttgattttcagctccaaacataggtgctttacacaattctatttgtttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctctatttgtttttactttttattttttttgagacagagtctcactctgtcacccaggaatgcctggcctcaagtgatccttctgccttagcttccccaagtgttgacgttacaggcgtgacccactgtgcccagcctcacaaatttaatttacatatatatattttttcgagacaaggtctctgtcgcccagactggagtgcagtggtgcagtcatgtctcagtgcagtcttaatctcccaggttcaagcaattctcccacctcaggcacccaagtagctgagactacaggcacgcaccaccatgtccggctgatttttaatttttttttttttttttttttgagacggagtcttgctctgtcacccaggctggagtgcagtggtgcgatctctgctcactgcaagctccgcctcccgggttcacaccattctcctgcctcagcctcccaagtagctgggactacaggtgcctgccaccatgcccggctaattttttttgtatttttagtagagacggggtttcaccatgttagccaggatggtctcaatctcttgacctcatgatctgcctgcctcggcctaccaaagtgctgggattataggcgtgagccatcatgcctggccaatttttttttttttttgtagagttggggtgttgcccaggttgatctcaaactcctgggctcaagcaatcctcctgtcttggcctctcaaagtgctggaatttcaggaatgagccactttggcctaaatttttacagcttatttccaagatgatttgaaatagtttataacattaaaacactatgaaaggatggctaaagatgataaatcatttggaagctgaagcattttagctattttgagcgctatatcaacctctaaaaatcctggctgcgaaggcaaaaaggggagcatgattgggtatagagttcttgtctgattacaaggaagtgcatttcatctatagaacagcacaggaaactttgtatttacagtatcttctgcaactatcaacctttcaagtaccagtgacaaatgagaagctgaaagaaatggggtgggggaataagaggaggagagagtagagtattaatattcatgtcttataaaatgaggatttggccaggtgtggtggctcacacctgtaatcccagaactttgggaggctgaggtgggtggatcacctgaggctgggagttcgagactagcctgaccaacacagagaaaccccgtctctactaaaaatacaaaattagccgggcatggtggcacatgcctgttatcccagctactagagaggctgaggcaggagaatcgcttgaacctgggaggcgggggttgtggtgagccaagattatgccattgcactccagcctgggcaacaagagcaaaactctatctcaaaaaaaaaaacaaaaaaaaaaaaccaaatgaatttctcaaaaaatagtgattttttcatactgtatattattttggtaagttattaaaactctaaaagaacaaaagggaagtatgtaagttggtttacaacaggacttaacttggggtctagatatctatcactgtttttttgtttgtttgttttgtttttttgtttttgagacagagtcttgctccatcgcccaggctggagtgcagtggcacgatctcggctcactgcaagctccgcctcctgggttgacgccattctcctgcctcagcctcctgagtagctgggactacagccgcccgccaccacgcctggctcattttttgtattttttagtagagacggggtttcactgtgttagccaggatggtcttgatctcctgacttcgtgatctgcccgccttggcctcccaaagtgctgggattacaggtgtgagccactgcgcccagccacattttttttgtgtgtgtttactttttttgcttttattagatttttcaaagggttccatgcacaaaaaggccaaccactgatttagagttttttatctaagtagtaaattctaggaggaatttgttccatagatgaagagcaaggcagtgctcatatgagtgattagatatgaaaccactcaagtatatcttattttaatgttgatttgagcatgttgactactggtaaagtttttggttggtggttatttagcaaaacaaacttaatttttaagaccatttttgaattcagagcttcttccggtaattaccatagtcctgttgattctttcctaaattctcgaatttctttcttctcactgttctctcactcccatcactctactgcaggttgctgtctttttaaactggattaccacatcagccttttaactgttcttcctgtctttatccttgtcccactccagctggtccacatagcagttaagagtggatcctgtcactcccttcctttaaactgtttaattatgtgccaaccaaatttgcatgactctccctaatctggccatgaccacctttccagcttcctttcctgccaaattacatctccagccatacttgaattttcagttcctcaatacattgttttcttgctcctgggccttcccattttatctgaaacactcaacccctaggtatcaggtctttgccttcctttaggaagccttccctgatgtcctaggtttgcttaggtgttcttccagtgtgctactgcaacccattatccagtattcctgcttgataccctctgtctagttccttgcatatcttttatgcttgactgtaaatttgttgagaacagggaccttgtctgtcttgttcagcattgtatagtctttgcaatgtgctcagcgtatagttggcacctaatatttactgggtaatggaacataatttcagccattcaaatttaatacgtcaattgttgctttttctgctttttgatttgcagtgttggtagccttatatgaagaaccagagaaacctaacagtgctttggagtatcctttcaagtcagaaaaaggctttattttgaaactcttatttttttagatagataataacctttaaaatacttctgaatattgagaaagttacttttttttttttttttttgagacggagtcttgtactgtcacctggtggggaatgcagtggcgcaatcttggcttactgcaacctccgcctcctggcttcaagcgattctcctgcctcacgtctcccaagtagctgggattacaggtgcccaccatcacacccagctaattttttttatttttagtagagacggggtttcactatgttcatcacgttggtctcaaactcctgacctcgtgatgtgcccacctcagcctcccaaagtgctgggattacaggcgtgagcaaccgcacctggccaagaaagttagtttcacttgagtttttggatggtgatctctgggtagatattggtggtaaagtgggtgactctggtcagggatattgatactactctgtgctatttcattagtttcattcatgtctaagaagtaagttcttaacattgataatagttttttaaagcatcacttaggagctgctactccagaaaatccagaaatagagctgcttcgcctagaactggccgaaatgaaagagaagtatgaagctattgtagaagaaaataaaaaactgaaagcaaaggtaaatttttaaaaagaattcatattcaaataattttacctgtaataattgtatgatgaaaacctcactgaaatggacaggaggggagggaggtgggtgaatatcaatttgaattaattacaatgtaaggccaaagttatgccctgtcaagaaaaccacaagacgggcctggcacggtggcttacgcctgtaatcccagcactttgggaggccgaggtgggtagatcacgaggtcaagagttcgagaccagcctggtcaacatggtgaaaccctgtctctactaagaatacaaaaattagccgggcatggtggcatgtgcccataatcccagctactcgggaggctgaggcaggagaatcgcttgaacccggcagatggaagttccagtgagccaagatcgtgccactgtgctccagcctgggtgacagaacaagacttcatctaggggggttaaaaaaaaaaaaagaaaaccgcaagacatactggaaataggacaagcaaagaagcaaagtgtggtcaagaagaggttctggctgggtgcggtggctcacgcctataatcccagcactttgggaggctgaggtgggcagatcacctgcggtcaggtgttccagatcagcctggccagcatggagaaaccccgtctctactgaaaatacaaaattagccgggcttggtggtgcatgcctgtaatctcagctacttgggaggctgaggcaggagaattgcttgaacccgggaggtggaagttgcagtgagccgagactgtgccactgcactccagcctgggcaacaagaatgaaactctgtctcaaaaaaaaaaaaaaaaaaaaagaggttcttaggaacctgtattactaaaaggatgagaatattggttaatgttctttataagtaaatggtcagttctgaggttcttaagcagttgattttaagtaggccaatatggggcgactgctttgtaaatggcacttcttagaatttgtatggttcatagtttgcaaggccatatgtagcggccctctgtaaatttgttaggacttaattttatctagtgctaaagttttttctttctttttttgagacaggttctctgttacccaggcttgtgtgcagtggtgcagtcatgtctcactgcagccttgacttcccaggctcaagtaatccccccacctctgcctcctgagtagctgggactgcaggcatttgccaccatgctcggctaatttttaaactttttgtagaaatggggtcccattatgttgccctggctggtctcaaactcatgactcaaacgttcctcctggcctggcctcccgaagtgttgggattataggcatgagccacctcacccagccagttttttcttttttcaaagtcctgtgagaattttcatgaacttcaaattagtcaactcttaagtctttcaggtcttaccacattcttaatcacataatgtattttacattactctaagtatttctcataatatattttatcttctcaacaactttgtgagataagtgaaacaagtacacaagccactttataggtgaggaaacgaaagcacagtgaagtctaataagcttctcaactccaacaggtagttggcagaaccctaatgttagcctagtgttcttgcaaggaaccacacttagcataaaagaaaatgcagttattttaaattatccaagattccacaatgtgtagtgctagttaactctttggaaccttttaactcaaagacattagtagttgtttattggctggttaagttaagacatgtcacttaactctttatctacttttcagtgggtattttcagtaaacttttgctggagaggaagaaagttccttataagcaaatgaatctttgggaagatatagtttattgcatatcaagtatttgaacagtgcagtcatgaactggaatgaaattttagtttcaaagcaattttaaaggtttatataaaaagggctttcattagatttgattgtattaaatcttaaatcactgaatgatttaaaatggatagttatagaaactgatattaatacaatttactgacagtaactaagttgaatataacagttaccttgttttactattttttactcaatttagaataaaattcacctaaattcctctgtctttgccccatagcttgctcagtatgaaccacctcaggaggagaagcgtgctgaataggattcttctcagtttgaaagacaatgaaaaatggttttgtatgacttgaatagtttgtatagtatataatcttttctgaacagatgctatagaactcttttaatatgtttaattcacctatcacactctgttaaaaacacatagaatcatcaataaaaactcaatataactttctttgggtcttaaagcaggagaatccaaagtaaatcctgaacaaaacctaaacacagccatctaactcattaccttaaaagacattctgtttattagtctgattaggaatgatggcactggttgtattttagccaagacagtttagcatggagctattccttggtgcagttcaggatatgaacacaggtacagtcattctttgaaggtgacactgttctgtatattccctataggcagctggagagatctgtgtgacacaagatgcttttgtacgggttcccatgaatcttctgctcttgtttgtgtgacatggaacaaataacttctttgccaccactttgccttagataactgtgtgtgtgtgtgccagtttgaactctgacaccacattttccttctatgcaatcatgcctgtctgataatcttgcattgctttcctctgagctttagtgggtcctagttgcacactggcctttctgtgctgtttttcaatttgcctaataatagcagttaccctgattgtaatttatgtaactttaaacaggatcacactgtaccccctgcctgccttatttgcttactgagcacaggacagaggcaatatacaactctgggttcacacacaagctgagatgagaagaggaatgagccatatattggggaaaatcatagtttgtaggtataattatatagtgcttttctccctcaaagtatttttctagccttgaattcattttatcttcattatccctgtgaagtaggtgggacaagtataaggggaagaggggtgctgaatttttaggccaaagactgatattaatacaaatcactcactaactgtagagccttgggcattatcagtgaactactctgagatttactgtcttcatctgtttaatgagtagaatgtccgtgatgcctacctcacagggttgttgtgagggtcaaatgagaatgtatgtgaaagatttgtaaatggtaaagcactatattcttgtttgttagtcctttttcctttctttgggtagacctacagtcagatgttttgttttatggatcacttattttccttactggtagactgtcgttttatagacatattcctatttcatatattctctccctgttgttagagaacctatctttgtttttggtcaaaacacacatagaaaacaaaatgatccaatgaaaactggtttaactagcaaaagccttggcacctgttggagactatgaccaagccaataaaaagggcatttaaatcagccctgttagtaggaatgtggctatggctggtgcctcttctagtcacaagtttgtttttggagggggtccagaagatcattcccttgcatagatttctcttttaccaatttgagtgcctcctacatgggcagcagtggactaagtgctgggtgtgataaagaggaatgacttaattatgagactgtatataatcaaatacagtgtgggttaggacctgtggcagaccattataataaagcatggccccgtgagggttttgaaagag

SEQ ID NO: 36396 - DNA, 14208 bp, Homo sapiens
agaacactggcggccgatcccaacgaggctccctggagcccgacgcagagcagcgccctggccgggccaagcaggtatcgacgaccgcgcggggcgtcttgggctgcaccaggcgggcgcccggggcctgctgaggaccacaaagggcactgggggtcgtggtccaggctgtgcttcctcccgctggccctggcccctgcctccgcccccgcccccgccttcctgccgctaagccggctgcggcggggccgattggcgcctgcgccgcttcctgcggccggggccagtctaatgcatggggcccgggcgggggactaaggggaaactgagtcacgtcggtgtgggagcagttctgtgtgggaggcaccaccccccactgggctcggggaaggatccccctccaagctatgcttgagggtcccagcccccatctgtctccacaggggccgcaccccactcccgccttccccttcttcagcacccaggggtcccgccctggctcccagcagcctcgactggtcccggaatggctaggaggatccgctgcagccgcctccctcccctcccctcccctcccctcccctcccccccccctcgcgtcccaagcccccgtgtgctccctccgctggctctccgcacagtgtcagcttacacgccttatatagtccgagcaggctccagccgcggcctgcctgccgggacctgggggcgggggagaggagagccggcccctgactcacccggccgcccgaggctccaggctggcttggggggaggccgcgccagtttagtccctcggcccacccctggttgcaaagaacctcaagcctggattcaggcacccctcaccgttccagtcccaaggggaggggggctgctcctgtctttccaaagtgaggtccgccagccagcagcccaggccagcctgacaaaatacctgcctcctatggcttgggcgtgctcaggggctgcccgtgcctgcctggcccctgtccaaggctggtatcctgagctggcccggcctgcctgcctgcccgcccaccatgctggccactcaccttctcttctctcctctcaggagccggcatcatggattccttcaaagtagtgctggaggggccagcaccttggggcttccggctgcaagggggcaaggacttcaatgtgcccctctccatttcccgggtgagcctaggtttggggagggggctcccccagcggtctttcggtgcttaggtctccagagggtgatggggggagtcctaacaggagctggtcaggggccagcaggccaggagatgtctaggtccggagatgtagtggtacctgcctgccacaaggactcccaatgaggtggatactgggagggagcacccaggcttctccagccctgcactgtacccgatgctgttctcccaagctcctgtggccacctctgagggctggagggaggctcattgtgcaggatgggagcctaacatttcaggaggtatctaaacttgaggtggcaatgcttggagccaggccccaggcaggacactgtgactataggatttcacttcagcctcactgccgcccagggaatagcaatcctcatcccgtttttccagatgagagaagaactcatggagaggtggcggggctcgctcatcgagtccatggtgaagcagggattggaattgaggcacagcatggcgtacattttttgtgggtagaaggggtctctccccagcctatgtaaggacccacatccactgttcccattcaggatgtggtggcctttgaccccaagcagaagtgtaggacagggctccattctaggggcttaacttcagcttccaagagcctgccctggtgtgggtggagctggaggctggctcctccctgtagcagggggattgccttataagcccaagaatgcagccccacgctgggatggccaacagtggctgcggtctgcagagctgaaaagggctggcctaggcctggccccctgaaccccactggtgggcctctcagctggtcaccaggctgcagctccagctatatggtccagttgtgagacacaacaaattgcctgcccagagtgggtgaggccagcctgtcggctggcatctctgactggcctgggggtcaggagggggtggggacttcctgcccctatatccgcctgccccaagagacccacccaggcgccgggtgggcaggcagctgttgtcaggaagcccaaggcaagcccagcctggaggggcccagagggtcgtggcctgaggaggggctcaagctggagtctgtctgtaggagctgggcgtgggggttagggtgggcaggccagcagtgctcttctcaggggtcctttgatggcattctcctggaacctgccccgccagcagggtagtgaggcagtggttgccctatgacacacgtcccactacatagccctcacacagccctgaaacctacctgacgtcctgctccctgggaaagtgctggcccagtgtgtctggggagcctgaacctcagtttcttccctgatggagatgactttcagatatggcctgttgggggcactccgggctccagctccctggtcagcatccctggcatgtgggcggggccactagctgatcccagccctggagttggacctgggcccacatgggtgggtgaggtgggcttttctgagttaggccagccccctccccctcccctgaccccagaatggagggaggtgggaggggcaagggctggctgtgggcccaggcctgggagatgaggtaacgtctgggactggggggctgggctgctcaggctgactcacccccacctcatgcagggtccagccccctggctttttccctccttggttcctctggccttaccctgcccctggcttgagcccctccctgcctctctccagccacccgcccagcgctgtcttctgctctcctgctgccctccccacgctctgaacacccctcatcctctgtgcttcctgccctcctcactctgggaagggaagccgtccccgccccccaccccctctccaggagccagctagctgcaccccaagacccccacctcgggctcagcccacagctcccaggagccagccctgtgggcagggagtggctgggccaggtttcccttctactgactcaccatgaccttgagtaagtcacttcccctctggggtgtcacttccccatacacagtataaggggttgatttagttggattgaactaaaggtgagggagtggctcagggtgtctccaggtgggctgacccctcagttgggcccccatgctcagcagaggtggcccacagtggtggagccttagggtcagagacacttcctggctctgcctcttactagctgggtgacttgaggcaagttgtttaacctctctgtgtacatttgcaagtgcaaaatgggtaaaatcccagattactccacaaggttgttggaagattcagtgtcaatatgtagcatagttggtgctcaataaactgaagcaagtcttcttatctagcgagtgaggaaggggccgccgagctctcttagccttctgacctcctacgcaagcaagaggtcatgttgagcccagctcgcctttcttttcccagtgctgtcaagctctgtgcctggctgccctgccctctgacatctctctgaaacctcttgcctcccctctccctgcctcagctcagtctgtgcactgacccacctgaggagcctcctggggccactggcagcctggacccccccagatcccccccacccagtgaaattgtcttccagcactgcctcacaaaagcctacttgatgcagtgccaggcctcttgccagatggctgggtggtcccttaggcttggacccagtcaagctgccctgcctgtgttgctggggctgggctagaggcctggaaggggtttatcagggtcaccctctcagggcctgggagatacccaatcccagacattaaaactgccagtagcccctctaccttcaaagccaagtcctggtcccttcccctggcattcaaagccatcgtaagtgaactctcacccgctaggcagcacacgccattctcctttaccgaggcccaccgcttcctcaaagtcattcctgatggtctcagctcatgctggtggcagccatttctcccagcctactgtctctactcattgccacaggaaccagggactcccagctcaagagcctgaaggattggggtcaggggaaattggcagtcgagggcttgggagtgacagccatgtatggcctacgaagtcccagctgtcaacttaggtcccattcaggcagtgttcacagggaaccgggagataacagggcctgttcctggctctcaaagggtcccagcagacccctatagatggcccccgacagggtgctggggggtgagaggtccataagagcccccggtggtttcggggaggaagctgccccctgcatgggccagagggcatatctggtaggtggagtggcctgggcaggaggccagcaggagcctcaaaaggcaatggtcctcctgaaacacttgggctttagcctgagcgtggctgtttgtggacatcatagcaatttctggactgtgggggagggtggtggcggtgaatagataagcatcgtgactggggaagctcaggtgagcaccacctgagggagagggtctggcagtgaataaataagcagtgtgactgggaaattgtgaagctcaggtgagcgccaccacctcctgggttgctttagtgtccagcagctgcctagaactatgttgaatgaagagctctctgggttctggaagtgggacagctttgggtggggcagtgttaccaccgtcagcctggcttgggtctgcagggtccagggcctcggtcactttgcttctctctccacagctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcaggtatgcgggtggacatggatgggtgcgcccgcgctggcagtggggatccctgcgggcccggcccgctgtcacgctttccttctcctccagggcccagccggttcagagcaaaccgcagaaggtacgaggctggccgggacatccgggcggtgggcggtgtgggcttggacggccaggcctgctcgccctcctggcacattctcggtaccccaatccctggccgggagtggagggcagaaaccggagctaaggcgggtctagggccctggagttgagccaggggctgctgcacggtcctggcaccacgcatgtccgcctgtctgtccgcctgtctgtccgcctgctgcctcccgccgccggcgctgcgtgctcgcccgcactcggtcagccctcggtcctgcgtggactgagatcgccactcccaaatgggccccttgaaacctgagtcgtcctctccccgtagcctccaaatagatgtagggggtggggtgggggtggggggctggagctgccgctgtcctctgctgcaggcgccccacttccacccaggcccccaccttaccctgcccgcccgccctgcccggctgtgtctctgcccaggcctccgcccccgccgcggaccctccgcggtacacctttgcacccagcgtctccctcaacaagacggcccggccctttggggcgcccccgcccgctgacagcgccccgcagcagaatgggtacgtcggcccctgcccgcccgcgcccacgccatcaggcccactgtggccccacgcccgctgcccgctgctgctcagtctgtgctgcgccccagcccggcggaaccgtgcggcagcgccccctggcggccggggtggggctgcaggcacagggcccctcccgaggctgtggcgccttgcagggcaccgccctggggaggggtctctgaatgacgccgcgccccctgctggcggctgggggttgggttgtggtgtcgggccagctgagccccagacactcagtgccgccttgtccccggctgttctgacccctccccgtctttcttcctctcctgtgtctgtccctttgtccctttatctgtctgtctgtcttatttccttcacaggtgcagacccctgacaagtcagtgagcccccctctgcctgtgcctttcttcttccttttggcactctgggtggcggcccctccccaccctggctgccctcctctccacttcgccctcctgtcctctcacctacccgcccagcagggctcctggcctcacccttacccactccctcccatcactgtaacccaaacccacatgcaccaaatcctgggaggggctgcccccaccgcccacccccagtgtggggttctgagccacaccctccccacagacagccgctccgaccgctggtcccagatgccagcaagcagcggctgatggagaacacagaggactggcggccgcggccggggacaggccagtcgcgttccttccgcatccttgcccacctcacaggcaccgagttcagtaagtgccagcccagggcagggggtactttcctcgcccccagcccaggcgtgatccctgaccctgtgtcttttttggtcaatgcctgcctctgccctctcagtgcaagacccggatgaggagcacctgaagaaatcaaggtacagggacgggcaccagcccctctcccacctcctgcctcttccattccagctactgccctgtgtctactcctgaggctcccagctggggctctcaattctcccttccttccttccttccttccttccttccttccttccttccttccttccttcccttcctccttccttccttctttcatttcttccctccctccttccttccctcctccctccctgcctcccttccatctctccttccttccacttcttcctccctctctctctgcccctcagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctgcttgctctgcctgtcttctatctttgtggacctggtttgcatttggggtgtgggggtgtttcgtggttcggactgtttgggccctgccgtcctcgttttcagtgggagggggtacctggcaaaggggccctgccctgccatcacagatggcttcctggcatgaggggaaccccaggagctgcctcagaagcgggagccctgcctcgtctcccagctagagaccgcacaccagctaactggacattgctaggagaagctgcccttcccatccctaccccagtgggacctggaatccaactcggcagtttccacgcccccagtcatctcccgtggggccagcaggacccaggttggggggtggggccatgtcaggaagctcagccatgcagggccttgaatggcagatcttgcagccaggtgcccaggacagaagccccagccccagcctcatctacaccccaggagccctggcctggtgagagggagtgggctcgggcctgggcaagggtgggcagcctccaggggcatgggggtggtgggcttctctcagctgcctggggctccacccccgtcctttggggtccctgggcacccctttagagtcactttccccggcaggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggtgggtggcctgttcctgtccgaccctggctttcccatcctgcagcccagccccacctgtctgcccacctgtcttgcctcagctgcgactggggggaataaggattcagttctcagctggagtaggagtagggacctgggctgggtcctcccattcttaatcccacgctacctaccccagcccacccacaacaactgctagcagcatctgccgtggcgaaatagccgaagggccaaccataggctgaagctgcacccctacctttgctgctctctgggcaaagaggggcctgccccctcccagcgcgtctgcccctccctcctgctctctgtctccctctgctctcagagcatacaggcctggagccactccctctgtgcactgccccgtggggccaagcagcatcaaacaccccccagcatcagcgtgccggattctagagccttcctaattcgcaggcctggcctgctctcatctctgtcagctcttttttttttttttttgaaacagagtctcactgtgttgcccacgttggcgtgcagtggcgcgatctcggctcactgcaacctctgcctcctgggttcaagagattctcctgcctcagcctcctgagtagctgggattacaggcacccgccaccatgcctggctaattttgtatttttagtagagacggggttttaccatgttggccaggctggtctcaaactcctcacctcaggtgatctcaggcctgccttggcctcccaaagtgctgggactacaggtgtgagccactgtgcccagccgactctatcagctcttgccaggtagaacaggcaggccagcaggacagggcagctccagggtttgcccaggggcggctcagcttttatgaggctccagtcgtcagcccttcctcccggggtcctccctgctctaaagctgcctctcctgtcaccagcagttcagtgtggcggactggctctgtaagcttcacggctgccacggtcacttcccaagcctgtcttctatcctatgtggaaaatggggagaatgaactgtccctcccaaggcctcctggtgggtggtcagtcaacctgaagggggccaagacccccacctctctgcgtgtgctccctctgaccgctctcgcctccctgcaggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgtgagtagggctggctggcggggaggtggtcccaagcctgtcagtgggaacgagggctgctgggaaacccacagtccaggtctctccccgagtgagccctccgggtccttaccagcgtaataaatgggctgctgtactggcctcaccctgcattagtcaggatgctcttaacaaatgaccatgttcctgctcagaaaccgcccaaggctgcaaagagcaggaggaccaagccaggagaagccctgggccctcctgactcccactttgggctctccctgccctggtgaaatgacagaacggccaacttgacacgctgaagctgctctgtctcatgcgtcctcctcatttctggatccagagccagggctgccaggagtagccagagagctctgtgtggtgatgttcatattagtgaggtttaccttgaccacgagcagtgggaaactcaaaataatggtggcttatttctcatctaaaaacatcccggggtgggtggtctgggactgatctggtggacccaggctccgccttgttgcttgactgttggcagcacctgcttacttaccactcatggtgcaagatgacacttcagcctccgccaaaatgctcaccttccagccagcaggaagtcggaaggagaagaaaggggacagagccccatggcgtccatccttagaggatgctgccacctgaacctctgctttcatcctgttggtcagaacccagtcacatgaccacacccagtggcaacggaggctgggaaatatagtctttattttgggcacccatgtgtccagcaaaactgggggttccatcagtcggcaagaatgggagagtggccgatgcagtggctgatgcttgtatcccagcactttgggaggtcgaggtgggcagatcacctgaggtcaggagttcaagaccagcctggccaatatggtgaaaccctgtctctactaaaaataaaaaaattagctgggtgtgctggcgcacctgtagtcccagctacttgggaggctgaggcaggagaatcgcttgatcttgagaggtggaggttgcagtgagccaagattgtgccactgccttccagcctgggagacagcaaaaaaaaaaaaaaaaaaaaaaaaaaaaaaaaaaaagggccaggcacggtggctcacacctgtaatcccagcactttgggaggccgagatgggcggatcacgaggtcaggagattgagaccatcctggctaacacggtgaaaccccatctctactaaaaatacaaaaaaattggccgggcatggtggagtagtcccagctactcgggaggctgaggcaggagaatggcgtgaacctgggaggcagagcttgcagtgagccgagatcgcgccactgcactccagcctgggcgacagagcgagactcttgtctcaaaaagaaaaaaagaaagagaaatctgcctcccagccttgggctcctgccctaccagcccacacccctggtagagccccctctcccaccagctcaaagcccaagttccttcactgtgaccttgtctgctcctctaaaacaggcaacaccagacagtgagaagagccagccagacatgggcagaaaacctatttctgtgatctactggctgtgtgagcaggggctagttgctctctctgggcctcactgaagagaagggtggcactatgctagggccggcacggttgcaaggtagatgtaagatggggtacaggtgttgtggagggcagaaatgcaccatccgaaggctacatgtcccccacacttatgtcttgcttggcccacactgtttcattttaaaatcagtagcaaacaatttaaaaaatcagaagatttgcctgcatgatgcagtggctcatgcctgtaatcccagcactttgggaggccaaggtgggaggattgcttgagcccaggagttcaagaccagcatgggcaccatagcaagacccctgtttctacaaaaaaaaaaaaattagaaaattagccaagtgtggtggcatgcacctgtggtcccagctacttgggaggcagagggaaagtgagatctcctgctttttatttctttatgtataatgatagggtcttgctctgttgcccaggctggagtgcagtggcatgatcactgctcactgcagccttgatctcctgggctcagaggatcctcccacctcagcctcccaaatagctaggactagaggtgcccaccagcatgctcagcagatttttaaatctttttgtagagatgaggttttgctatgttgcccaggctggtctcgaactcctggcctcgagcgatcctcccaccttggcctcccaaagcactgggattacagacgtgagccactgcgcccagcagatttctctttaacacctagatttcagcctgagccaggcaggcattcctgaatgaaccagtagtactgctcccagaagaagaggtcctcctccgtgtgacacagtccccacttggcccttgcagggattggatctgggatccctggatttaaactcagggccatcctcataacagcctcacaaggctgggattagcttcccagttcacaagggaagaaaccaagacttgagaaggtcaaggtctggccagacccacacatcttggaccctcataccgcctcgaggccccatgctgccctctgcctgctccagatgtgaatactgctggccctggctggccccggctggccccgagggtcctagggatgaacagcccagcccagggagagctcagccccttgtgcctctgccccttcccacctcctgcggaggccagtcgactcacccacaaagggccaggcactgtggggatagatcagctaacaaaacagttgatgcttcctgcccttctgggccttacattttggctggaagaagaggggagaggcagactgtaagcaataagcgcaataagtaggttgcctggaagtaatgttagatcacgttacggaaaacaggaaagagcagagcgacaagtgctggggtgcgtggtgcagggaaggcagctggctgctgctggtgtggtcagagtgggccctcatggagaagactgcattcgagcagaaacttgaagggggtgaggggtgagcctagagatatctggggcagagcagtccaggcagaggggacagccggtgtcaagcccaggacaggagtgtgcctggtgtgccagtttcaggcaagaggccagtgtgcagaggcaaggtgagaacgcaagggagagcagtggcggagacggttgggaacgaggtcagacctgctggcctccagcctctgcatggggcttggctcttgctgggagcaatgggaagcagtacacagtttcatgcagggggagaaggcctgtcttgggttgcaggggcacgctgtggcagctgggatcagagagaggagcttgtaggccagttgttatgtggtcccacgggccagatggccatggcttacctcacttcagggaggctgtgagaagcactcagaatctggatgtgccttgggggtgggccccactggatttcctggtggacctggtgtggggtgtgagaggagggtgtgtttggctgcagcagacaggagaatggagttgccatccgcgtgatggggatggctgtgggaggagaggtttggggtgagggaatcaggaactgagtgctggacatggcaagtctgaaggcgcagtggtcgtccactcagagaccttggagttggagatggaggtgtgggagtcctgaacagttagatgtagtgtttaccgcgagaaggaacagggcttgcggccagccctcctgtgttcccgtgacccagggcagggcaggaggggcctgagcctgccgagtgactgggacctccttccaggagatcatgcacgccctgaagatgacctggcacgtgcactgctttacctgtgctgcctgcaagacgcccatccggaacagggccttctacatggaggagggcgtgccctattgcgagcgaggtacccactggccagtgagggtgaggagggatggtgcatggggcaggcatgaatccaggtcctctttctctctgcccccattctcagactatgagaagatgtttggcacgaaatgccatggctgtgacttcaagatcgacgctggggaccgcttcctggaggccctgggcttcagctggcatgacacctgcttcgtctgtgcggtgagagccccgcccctcgaactgagccccaagcccaccggccctctgttcattccccaggagatgcaggagaagttgggaaggggcctctcctgctgcccccaaccccatgtgactgggcctttgctgtccttagatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 36397 - DNA, 14208 bp, Homo sapiens; identical to SEQ ID NO: 36396

SEQ ID NO: 36398 - DNA, 6381 bp, Homo sapiens
agccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttct

SEQ ID NO: 36399 - DNA, 6381 bp, Homo sapiens; identical to SEQ ID NO: 36398

SEQ ID NO: 36400 - DNA, 3611 bp, Homo sapiens
gggatccttgagtcctactcagccccagcggaggtgaaggacgtccttccccaggagccggtgagaagcgcagtcgggggcacggggatgagctcaggggcctctagaaagagctgggaccctgggaacccctggcctccaggtagtctcaggagagctactcggggtcgggcttggggagaggaggagcgggggtgaggcaagcagcaggggactggacctgggaagggctgggcagcagagacgacccgacccgctagaaggtggggtggggagagcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatgaggactgaattagctcataaatggaacacggcgcttaactgtgaggttggagcttagaatgtgaagggagaatgaggaatgcgagactgggactgagatggaaccggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcgttgctggtcacattcctggcaggtatgggggcggggcttgctcggttccccccgctcctccccctctcatcctcacctcaacctcctggccccattcaggcagaccctgggccccctcttctgaggcttctgtgctgcttcctggctctgaacagcgatttgacgctctctgggcctcggtttcccccatccttgagataggagttagaagttgttttgttgttgttgtttgttgttgttgttttgtttttttgagatgaagtctcgctctgtcgcccaggctggagtgcagtggcgggatctcggctcactgcaagctccgcctcccaggtccacgccattctcctgcctcagcctcccaagtagctgggactacaggcacatgccaccacacccgactaacttttttgtattttcagtagagacggggtttcaccatgttggccaggctggtctggaactcctgacctcaggtgatctgcccgtttcgatctcccaaagtgctgggattacaggcgtgagccaccgcacctggctgggagttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcagtgaaccatgttcaggccgctgcactccagcctgggtgacagagcaagaccctgtttataaatacataatgctttccaagtgattaaaccgactcccccctcaccctgcccaccatggctccaaagaagcatttgtggagcaccttctgtgtgcccctaggtactagatgcctggacggggtcagaaggaccctgacccaccttgaacttgttccacacaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctatacctccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 36401 - DNA, 3611 bp, Homo sapiens; identical to SEQ ID NO: 36400

SEQ ID NO: 36402 - DNA, 47385 bp, Homo sapiens
aggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgccaccctgccctgcccacccgccaggtaagccggcggcaggcggagggagacgcggtacccctgggctgcgttagagcaggcgggaggacggccgcaggggttcacgtgttggggacagggctacggtccaggtggccggttggagacggtctcgagagcagtgtgtcggttgcccctggagagatcccgaaaggggcgccctgggccaaggggcaggtggcgcctcgggggggagcccggtcacaccctctcgcccacggtgcccccgccagtccctatggggcggcccctgaggagctggacggagaccaaagacctggtggccccggacttgcccttgggagggtcgcagcgtggggaccctgagagggagggcccggcgggaggcgggcgcgcttccactccggctagcaggttgcctgtctcctccagcctctctgcccgagaggacatcccgcgacagcgaaagacatggctttgccaggcaactttcctagccggggaccccaaacagttctaggctgcaaaccgcggccgccgagccatttaaatggtttccgagtggtttggaaagggctctgtggccgggacgcggacacccctctctctctgtttcgactctgcacttttccgggtgcgctctccaggccagagttgggcccactttcctgatcaatggagaagagttcttttcttccgtggcgggaagaaatccaactgccacgcaccaaccactcaccatctcgttagaggacctgttgacttaaggacctgcatatcgcggctatggtttgcctgtggcatatgactcaaaggttcaaaaaaacattgtttcaggatcctgccacgtctaagcttgggtgtgccaggcccagattcctttccctgcctaattaggcttttctgaagcctaagaattgagggtgaaactggcgcttaccttagacttttatttccttctctttccaactcatcaaagaaactatttctgttttaagaaccccatcgagttaccaatatttccgattcttgaaaacgttaacataacttgctatagaagttacactacataatgaagacatttacagtcaaattctatagctaaaaaatattaaagtgacagcattttaattagaaaatctctgcttgtgggaaaatctgttgcttcttttattgtatatatttttctttgcgtttgtggctaaaatccatgaggttaaagtcacacgctgccattagattcttttttttaatttaacttttaatatctgaaatctagtgcacatgttaaactttccaagcaatttgtaccgagaatcaatctttatatattgctttaaccaacatttttacgtagaagtttctgataataataacaattccattgttttgttctatctccacacattttaaaaatattttttaaattgcacgttttacttaaaatgcctgatgcaacatgtagtggggttatttttcttcttctttttaagattagatggaaatctaaaagccaaccacagcataacatgatgtaattattaattcaatcaccacttttctacatttcttaaaaggatctcacctgacctcttaatcttgtctccatacagagaaacaaatgtgctaaatactgtttaaatatgagatataggagttgttccctgaattttgaatattagtcttcattacttactaggcagatgttaccagactgtctttcctcttaacctctagtgagaaatgtaacatgttttcattagctagagtaacagtgtaacttaatctatctgttaaataggaaaaataatactttcctagattaagataacaaaaccttaaaaacaatcaggagtatcttccagccctagcattctcgagatccctttctcactttggagattcaatactcaaaccatccatttatgaaaaattgaagccaagagaggtattctaacttcatttcactcagagatggcatgatcattccagtggcttgactcatgactcctgtatcttacttttcaccacccacatcctcacttaccataagatgtttatcttttttctttcatataatttgtaaggcctttgtaattacagaattgtccattgctctttcttcactctgatttaccctcatttctacttgtccaaatattgcctgacttcgtggaaactacccagtgaaggcatcatgctcctctcattgtggaatagcatgcatattgatgatgccatgtcagttgagacttttagttccttcttggtatttccaagccacagttaattttttaagtcaatgtggataacattatttagtcttctgatctttttattatattggcttaaaatatattttatgaggcagctacccagtgcctttcatccatttgcaacactccagattttttatttcaagcacacttccttaacactaagtttctttaaacttttttttccttttactgcaatcctcaataactaatttattctctgcctcaactctgtaaactccaatgtgagtgtatataaatgaaacaagttttattaatataaaacagtgcttaaccttacaacatgtatgttctttattattttatttttaaaaacgttggtctaaacaattagactgctttatgaccacgaaagtgctggagccctcaatgtgaaaatagcactattctgttgaatttttgttcttttaaaggctgatttttctaccagctttctttttctctgtctcatacatgcgtatacacacacacacacacacacacacaggcacacacccactcacatgaaagaaaataaattatttcttaaaaactttactgtaatcctaattaaacatgtattgtagggcttgaggctccaggaccttggtgctagattaaatctttcaaatattaagaactacatgaaaccttgttcattatacatattttgtgttaaatgggttctcatcatgctgtagtgtatttgggaacaggaaaaactagaaatatttttttctgaggggattttgatgataagaattcagtgaaattttgagggagaaaccttctgtccagctctattctgaactcttaaagttttatgactgagttagagttctgggtggagtctgaaaatttattagagaaaacatagccagtttattatttggtttatattctgttaatatttaatgcttttcttttttactatgaaacaagtatgagacaaattgtaggaattacactccccctctccacaaaaagactacattgagagattaaaatagatccctcaatgatttgtaggaatgtagtcttggaagctctgattggataattaagccttccgtagacactttcaattttaacctgcctttacattcttggtgggtgaaatatttctcctaaggaaaatattatcatatttaggattttagaaatgatcagtgcctgaatcatcttcacatgtattcagttctttagtccatcaagtgcaaaaatacatttggaatgatagatactttatagatataaaatcctattgaaaaggaaggtgttttcagttagctgttcaattatgcatttagttagtatcaaaataattcatactatgtaatttgggtgaaatttaacacaactcatgtacactaagggggaaaactgaattcaaatcaattccagcagtggcaagagacaaaagtacattcacttattgcaaagcaaagacaagtaggactctgaattctaggtcattagagactactgacaattatatgacacttccttgggtcattctcagagttgggctcttatttttggcactaaagagagaatattcccccaagtacaccttttccctataattgtttcagtttcaaactgtccaaactaattttcttttctatatgattgcctattggacatctttaacatttgttcatcactggagattatatatgttcaaaccagaaccttcatctcatcaaaaaacaaatgaacaaacaacctgctcactctctgtattctatttatagatagtagtacattgtaccatttcttatctataattcaaaaatcatcctctgaaaacaaagcaaaacaaaatttaactcatttgttagcaaaacttgaactcagttggagcaaagcctgagtgaactgtcaggaggctattgtgattgtgtattcaacttagtggattatgtccagctgcagaaatagtgctgtttgattacataatactgcccaggccctgctggggtacacttttacattgattatgtaaaccatatcacctttctaacatccaaaaaaatcagatttttttttttttttatgagacaaggtctcactatgttgcccaggctgatcttgaactcctggactcaagtgatccttccatgtcagccttccaagtagctgagactacaggctgtcaaatcctgaattttgaaatatattttgctgcagagatttgggagagtgaatcataaatgtgtactaccatccaggtgccataccagaaatccagaggtaattttaaactctttttcttagcctctacaactgctatggtctgaatgtttgtgtttttccaaaattcatatgttgaaatcaaatccaatgtattggtattaggagtagggtctttgggaggtcatcaggtcacgagggccttggcctcgtgtgtttttgtaaaagataatgtccttataaaagaggactgagaaagcttgttagccttttgcccttcctccatgtgaggatacctaggaggccatctatgagggatgtgccctcgccagacattgaatctgccagcagcttgatattggacttcccagctttctggctgtgagtggtatatttgtgttgtttaaattacccagtctaaggtattttgttatagcatgaactaagacaacaaccattagaacactgaatccacttaacattttatacctttctcccagccataaattctttcacttctactgatctagtttaaggtcttaacatctctcaaccaaggtatcatagctgcctcctacctggtatctcagcagatagtgttgtcaacctcaagtccaccatctggaggatgaggatgatctttttagaaatgcaaattctctctctcacttaaaatccttcaacaattttctgttgcttaccggatagaacccacagcccttaaaatggtcccatgggatctgagacttgcttaactctggagtgatactccataagccgaaattttatttcccagcaatagacttcttattgttttttttttcttgtgtgcttttcttttgcacttcccactgcagagagtgcctttccttctatctttacatctatctatagctcttaatggctcttaaaactcaaagaaggtcttgcttcatttgggaaactgtgtcccctcacccacacctccacatatacctgagcagggtgaggtgtcctgtgtatacttctattatttgcttgatacgatataaatatagtctgcttttgctcttgtctgtatacacacacacacacacacacacacacacacacacacacacccttttggattatttgcaaaacatgcaaaatttctctttccattaagccttttgtggaataaaaattttggggtagaaatgtcacagaaaggggagaggcatcggcaggcaatataagtcaatctgccttttttttttttttttttttttgaggtgatgtcttgctctatcgcccaggctggagtgcagtggcgtgatcttggctcactgcaagctctgcctcctaggttcatgccattctcctgcctcagcctcccaagtagccgggactacaggtgcctggctaatttttttgtatttttaatagagacggggtttcaccgtgttagccaggttggtcttgatctcctgaccttgtgaatctcccgcctcggcctcccaaagtgctgggattataggtgtgagccaccgcgcctggcccaatctgcctttttaatgggaagtaaccaaagaaactggggagtagcgaacttgtttcactgacttaattagtctatttaatttggattgctgttacttctatctttttactttgaattctattttattttgggaccttttggttctgttccaagatcttggggttttatcatttaaaagtgaaaagttaactttgtaattgaaatgtcttgcagcttttgcttatacatattccacaattgagtatattattattgttgaggagcttaaagggagcagcctttacttaaaaaatataattgagttagactagaccaaacaaagaaaaacaaaaataaaatgaggcaaaagatttcttggaattagcagtcctttcatctctttttggctagtcctatgccaagttctgtaagttttaccttctaaatattcctcaaatccatctacttttattcattcctatctctatcatcatctcttgcctggacttttgccatggcctcgctgtttgtctatctgagctcattctggcttcttgcttgttagttcctcaccctgcacccagagtgatcttttcaaaatatgtggttatgttataccctgcataaagcccttcatggcccttaagataaggcaaactccttaacatgcccaaaggcctggcatgatttggctcccatcaaacatatagcacactcatcattgctccagctccaccaatctttttatattgctctgttccttctgcctctaggtctttgcaagtgggcttcctggcctggaaggctcttccctcccattttggcataactacttaacatgcagtcttcaaattccagtttgagctcccactttttcatcactaactgtaacttggaatttttcaacagtctcaccacatccttccccctaactatgggttagagtgaaggctgtaggctaaagaaataaagtcctatttagtacctgggagcattaacttataaaaacaaaagtttccccacgaaggaggcagacattaatatatggcccatatttttaaaaatagattttagttattaatgcctttatatttttatcaagtaataatagtttatatttattctcataataagtactggtccttatttactattgaacacttacatggcaggcatattttaagcaatttacatgagtttacttatttagtcttcaaagcaaccctatgaggtgcatactattttcctccctattttaaagataggaaaattgagagattaagtattttgcctctatttacaaggttagtgaaagattagagccaagactcaagtcgaagcagtacaattccaaatcctgcacagttcgccttctgtttccatgagttctgtgtccatagattcaaacaaccttagattgaaaatattcaggaaaaaagtaacacaacaataaaaaataatataaaaaagcacagtataacaactatttacacaatatttacattgaattaggcattaaaagtaatctagagatgatttaaagtaattgggatgatgtgcataggttaaatccaagtactgcatcattttataaaagcgacatgaacatctgcagatgctggtgtccacaggggttgtggaaccaatctcctgcagataccaggacatgactgtacatttatcctacttacatgtaaataaagtaaaatagggttattaaaagacttccaacaacaataaaaatccagtcaactctgcccctcctttctcgtctccccagtcctgttgcctaaaagcaactactttcatttatttaaatgtttcttctagcccttaccttttcaaataatatgcttatactgctgtttcttaatgtatcaatatttggcaatatctactgacttcctattatggtagataaatatttagctctttcatacacagccacctctactctccctccttgacctcccaacataattctcacattgtttgtttgcattttagtatttatttactgtgattacatagatattgtttactacagagtcaagcaagcatattacgagtaggattccttacttgtagaatttttttttaatcctagaagtaataatgaactcatttaagaaaacacttggcttagtgtttccatatatctattggagtacaatttctatgtactctaacatcttttcagcttggttttccatgtagtctaacataacagatttatttgtcccttactggagcaatctgtcctcttgcccctgttcggactgttgctctctaggcctgttccgtggtggttgttcggaatttctttttgctgacatctctgatagagcctctgttccttagatactatgacttttgttttttattcaccccctcatttggatgaaacacatatccaccactagcttgctggaaaatggtgcatggaatgaagaaatgtgagatattgaatgtctaaaactctttattctaccttcatacattttcctttctgttttatttaattcttaaaaatgtgttagtagttgcagttgtttgtgaactccagttgtttgaagttcacaattttcaaaagttaggagaggtatatgataaatcttcctttcactgttgccctctgacaccagttttcttccccagaggtaaccgatgctattttttaaaaatataaaaacaatatgtatgttttttccctctttttaaaatacaaataattcttgctttttttgttcccatttaactatattgggatcatttcatatcagcatataaattggccttgttttttactttgcataatatttaatcatattactccatcataatttatctctttccctattggtagagttctcggttgtttcaaccctttgatattagaacaatgctttaatgtgcaagttacaggtgtgccatttcactagtgcattagcgtatctatgggatttctagaagtcatccccacatctgattgatgcttttatagagactacagtagtaagcagccctgcaagtttgataattctgagtcaaatgagataaggagaaagggggaaaaacacctgatagtaaatacttaatggcagagggggctcatttctagaggacaattaataaagcagacagggtttctcatagaaattattgttttctttgagctttttgaacatgacctttgttttttcagatgtgacccatcattttgaactggataaaacttgtttctgttgttacctcagtctccttcttgtactctaccctctatcattgcctctgttagtttcactggcctcttgtctcatatttttgagttctaggtctaccactgaagataatgcagaagagagagcattccatctgctagcacctttctttttcaggatggggtcttgatgtgtttcctaggctggtcttgaactcctgggctcaagcaatcctcttgcctcagcctcccgagtagctgggattacaagcacctagctagctagcacctttcaacaagtccagaacacatccttaacacccgtcacaacttaacaacctctgtagcctccacattgactcatttgctgagttcagctaactctacttccaaaatctgtttctaagcttccatgccccttatatttatctcttgcctggactacttttaagggtatcctaattgcctttagcctcctatcaggtttttctacctccccaaaaattccatattcagcacaacttcaacgacaatcattctaaacttccgttctcattaggtcatcaccttgctgaaaactcatcagggcctctccctttgcctaaagaattaaatataaatcccactgaattaagcaccccaccctcccctatttggagcttggcatccagtgtgtgtttagtaggcctcactgtgtatggtaattgactatgcatggttctgggtaaaattaccctacttgaggccagctgttgatagaagaattaaagtttaggctgagaccggtttatttccaacccaaattttacattaaaggagcttttcttgtgccttaaccatgaagagtggataatgcaggaatttcagatggtagttggagaagtggagggatattgttcgcttcaaattaggcacatatatagcctaatcttaaaggtagacacagattttatgtataataaaaaatgatgttatggaagacttgaaaaaaattctgttttatatctggggaggtggcagctaatggggaaggggtaaatatggggagacttacaaatattgagattgaagtcttttagaatttctagagcaggggttagtaaactatagttcttagaccaaatttgatccactacctgtttttgaaaacaaagtttaattggaatgcagctatgattattcatttacaaattgtcttttttgtactacaacagaattgaatagttgcagtagagaccatatggccagcaaagcaaaaaaaaatttgttatctagtcctttataaaaagtttgttgacactttttctagagggtaatggaagctgagagatggaggaggagtgtctatcacatcagcattggtaaacctgtagaaaggtgaatgcaaaatgataacaattgagcaagcaatcttctttattccttcaccccctattccttaatatttttggggcctcaaaggaagaatgaatggagagaaattgcctactgcttgtgtgtgtttggactccttcaaaaaaggaatggttggttgaattaattgaatgcaacctgcccatcctccaaatacatgccatgaaaaggcccagtagacactcctttcactaaagtattaagaagtacattagtgaagggattccctgcatccatgaaaaaatctgtgcctgctctcctttgtagaccattgaaattggctctctgattttactggagatgatgaaattccatagtagcaaaagccaagtggcagtaagcccttatacaccaaatacaaagtatatacatctcccacaatgaaaagctgggccatagaggtatcagaaaacattggcttgcagatgtttctgacagctgagataatgtctttggtatatgcctagtggtagctaatgaatgaaatacgtaagcagtactatagcatcccttcatctatataataggaaaatctctagctctggtagcaaaaaagttaactttagttgctgcaatcaagagtcacagcatctcactcagttttcagacctaagtcaattcacactcccagagcttttccccaaagggacctgtagccatttaccagagactatgctttggggaaaaggaaataatcagacctttcatactaattcctagggggacccaaaaatactgtggccaactgttcaaagtggagacttaaaagtgctcaggtaacaaatggagtcttagctccagttgtactcatagtgggtccagggggtcagcagatctagcctgtgcttatttccccagttctttaatgaataattggaatagacatactgggtaactggcagaatctctatattgactctctaaaccaagcttgtttaacctgtggcccatgggccacatgcgaccctggatggctttgaatgtggcccaacgcaaatttgtaaactgtcttaaaacattatgagattttttttttttttgtaattcttttttttcccccagctcatcagctatcgtgttagtgtgttttatgtgtggcccaagacaatccttcttcttctaatgtggcccagggaaacccaaagattggacacccctgctaacccatagagagaggaccatgtgataggagagctgagtagaaggctttagaatttcccctttcttcaaagatagtaaatcagaagtaataacatatccctgaggaaactctcaagattgatgtcactatcaaagatttgaaataagacttgtgatatctatcacatccccacttagctcacttattttgcctcggcagaagttaaatggatcttagagaatggctgtagactcccctaaacttaattattgggtgactccaaatgtagttgctgacccagatgtaatatctttatcaaaccacatggcccctggcatttggtatgtagctattgacttagttaatatctttttctgccaatttacaaggaccaccaaaaacaatttgtttttatctagcagagccaacaatatggcttcacagtcttgcctcagggctagatcaattcttaatcttaatcatcgtaacatttcacaagtcatcacactgatccactacattgatgataatatgctgattgtctctgatgagaagaaagtagcaaatactttagatatccttgtagagcatataagaattagaaggtgataaatcagccccacaaaaattcagcaaaacttctgggcattcagtagccactatgctcgataggctttttttttttttcttttttgagagggagtatcattctgttgcccaggatggaacgcagtggtgggatctgggggtcactgcaacctctgcctcctgggctcaagcaatgttcttacctcagcctcttgagtaactgggaccataggtgagctccaccacacccggctaatttatgtattttttttgtggagatggggttttgccatattacccaggctggtcttgcactcctgggctcaagcaattcgcctacctcagtagtgctgtaattacaggcatgagccactgcacccagcctcaatagtcatttttgaatttgggggcaacatttacaacatttgaatatgctacctcaacctgtttacagagtaactcataaggctgccagtttttaatgatgatcaaagtagaagaaggctctgcagcaagcccagcagtacaggctatgctaccacttcagctttatgatctagcaaactcaacgactctcttggtatctgtgccaaagaggaatgctctatggagcctctggaaagtgccaatagcagaatcacaatacagacatctagggttttgaaataaatattttcttcagataactgtttactttttgataaacaccttctgacttgctactaggtagatattgaatgcataattatggagtgtcaggttatcatgtggaccaagtttcccatcattatctgggtaaaatctgacctatctttccataaggttagcgatgtacaacagcaatatatcattgagtggaaatagtacatgagacagaactagagcagatctggataggacaaataagttgcatgaaccagggactcagacttctttggtagcaactctaatggcattgccttgtctctttcaactcatgcctgtggcttcttggcgattcccttagtccatttgttagaagaaaaaacaacaacaacaacaacaacaacaacaacaaaaaaacccctcaaacctgatttgcagatgaatctgaacaaaacactagtactacccaagattaatgactgtgtagcactatagccctactcgtgagtaactgtgaataatactggataaggaaaacttttctgtaggcagagatttgaacagtaaatatggttgtccaccatgttgggaatgagacatgcctagaaatacagatctatattggtcatcgatgggtagttgttaatggtttttatggtcagagttggaaggaacaggattggaagattggtgacaaggtagttagtttgaggaagaggtatgtgaatgaacctttcaaaatgaaaagaccctgaaagaatttgtatcccctctgagtgcccacaaaagcacatccattgcagaggaggctcttaataatcaagtggacaaaatgacacattctgcatgtcagtcagcctatctctccagctgtctcagtgggcccataaacaggagtcttggtggcaagactggagctgtgtatgcatgggctcagcaacatggcttcccctttgtaaagttgactgggatagcgctgctgctgagttcctaatctgcagaatccagcattgagcccctgcggggatcagccagcctctgggtggcaggttcattatactggatttcttccttcattgagggggcagagacttctcctcactagaatagacaagtattctacatatggatttgcccttccttgacatcaccaacatctgtggactcctagaatgcttaagggcatggtgaatacagagtagtagttagtgtaagaaagaagccatagatattcattatggcctcgcagccaattatgtaagtgaggattattgtaggtttgcgtattttttctttaaaaattttttttcaatcagctttctcaggttcaatgcacattttttctttgcctcttatatctaggttttttttgtatatgttaacaattttcttctctcattttcattttaaaaatgttaaatagaagccgttggagatcaactttccaatttaggtaacagaatatttagtgggactgtgacagaatttaaggagtaactcagagtcacagcaatgactacaatagctgttaggactctatgtctctcgtttttgaggagatagaacttcttcacttataaagaaggacagttagactttgttaggtgaaatatagaattgtgttgttattgtacaggagtttcagtgtgtgggagagggtgcatgtggaagctgagtagtgaaaagtgtagactttgctgcttatcagtttactgtctcttagttccaaatttactgtattagcctgctctgtaataatggagctgggccttgtaaatttcttttttgctggctcgtacaatgttaagccttgtcagtagagggcactggagggacactgaagtggctgaggcttctctttctggtttctgtgatgctcactggctaagctccttttgagcatagttttcctccactgctcactccccagtatgattttctccagtactaggtatctgcagaacacagctttttctagagttggtgttccccacacactgcactttctttagagcttgatttaggcagcagtggtgtacccttgagacacagacaccatggacctgctctgtcacctaagtcactgctccccaaactctctcctcagatccacacatgccaaactcggggccccacaagactgggtgtctagggagccagctgcccaacctttgtcccaggcagccagcccagagccgttgttacctgtgtggcacatgaaagttcactaaactcctgcaggggacaacctctgtgattccagattccctcagcagccagcagttttcctcagcacctagctagttctagggttctgtcccccggctgtgaatggcctcttctggaacttcaggggcagatttctggtaagtcccatgaatgaagtacttctatgactttttaccaggtagtcaaagctagggcatctccatagacatctctggatctcagccctggtgagaggagagcccttccttgaacacttatttcagccatagggggagtggttgccccttatactgtatttacaactcctgtattctttagaattctccttaactcccactaggcaatttcctgttactccaatcctcttttaataccagattgtattaaactttctctgttcaaattagcatgtggtttctatctccttactaatccaaaagccaacaactatgtttacaaggtaaatagatggacaaatgttttaaaatgcagtgcctctacctggggggcagggaataccagttacatgaataatctctggatccacctaaatcactcctcagaattcctctactctgtagtatgccataagtaatcaatgcatatctttcatatgtaatgtaaaagtcattcacaggtgtagatgtggcaggaaagagcatgtgagcccctgagtttgtgactcccttgacagataatgtagtatcataattacttgtttgtgtcaaactgtcaagatagagttggctagctcacaaatcaagattctatcagcaacctttcacattcagagatgacgatgagggagatgtctacctgaccaggggtagctgagaagttggatgtctgaccctgtccttctcagtattgaaacctgtgcctcacggttgctgatggttaactctgtcactgagctttttgtctcacagcctgcagatatcttggttcagaaagctgttcttagtttataacaattgcaagtagtttagtcatccactggtggcattgcccagccacccagagtaactctactttgcctttagctgagatctttgaggtatgtctactgctgccccctctgagacagaatgtggctgtcttcatgcagtttgctttgcatcagtgtttgtctcttgtcatacatccacatgccacttcctgctcagaagaaatgctgccaagaatgtaaacatgaacttaaacataatcaaaactaacaaactacagcagcaaaacaccatgagatttgacccaccaataaatgcaagcagaaatgactttctgccactcctctgttccctaacactttaaccagtagatgaggggcacataataaaacttctacccaagcacttaaaggtttattatcagggcaaggtctttaaattttgtttttctttgttttgttttgaattcaattaggaaatacagatgatagataatgtgtggcaaagatccaatgagttttataataattcacaatagtgtacttttcttaatctataatctatattaggatattgggatgtaattttgttttttttctgcttagtgtggttacccctaactctttacagcatgccttaactcagtagtaaggaagttttgtataccaaattagacatcacagcaattaaattcatcaggaaccagactttaaacttctggagttgtaatggtttattgtcacaaacatggaaacaagaagtgagaggaaccactatcttcttatttcattaaatgttactttcatgtaaaattataatgttctgctttccactacttcagaaaattgctacagttggaatttttaggttaaatgaacaactaatatttctgcaacctatgcttcttcacctagagggacaatcatgatggatcttaccttgatattttcccttctcaatttgtgtttaaacaagatccccaggtgattcatagtcactttaaagtttgagaagctgtagtctagataactggaagctaccacttgttagttagattattttaaatttgtaagatttcagatggaagcatatttttacccctgagaataatccattgattttaacatagcgagtgtcacaaccagttaaaattgtgtatattgctttagcttttcactttatgaatatttttattaatgactttttgcaatggctacatatataccaggttacagattaataactttttaaaaccaggtctctgaatttcactcttaggaattcataagaatttagaatttagaagatctctgaatttttcttttcttttttttctttttttttagtttttaaaaactatttcatgatttttgacttctcttcctctgtgaatctgatctttggtaattagcaaatagccatcttggataggtgtgtttaaaggttttagaaagagtacaagaagaacaaaccctttatctgctaatcatttctaatgtgcaaatatgacatgttatatcctgagtttgctgttgtgctgatttttttcttatcaattctcaaacttctgagtccaactggaagttgactgtaggagagatttgttttgtttcacgagctgtttttacgtagggcttccaatttggcaggtagtactgacaaggaacatggcattattcccggaaaaaggcattaaaaatcctggtttcattttactcatttatttattgtgtatcttttggcttatgtcttttattgttcaggtatcaattttcccatttttatgattggaataaaatatttataaaattattttacagaaacataatttgcagtaaaacctcagtgcctcatttatatcagcgtaaatccctgagtctttttggaaaactgtgggtcattcttgccttggattttatcgtgtatctccatgtctaaataacttctattcatttacatcaagaatctattttgaaacacccatctttggcttattagaaattagtaatgtggttgcctttggacagatacaacccttatcagatgctagttttgatttgcccaaaatattgtgatctagacaagtaattcttaacccttgctgcttgttagaattatctggagagcttaaagtaacaacaaaagcagagtatatgccctgcccccacatcaattaaatcagaggtgaagcctaaggcactttatttttttaagagcttttcactaatgtatatccagaattgaagacagctgatggagatgcttagtgttgagtgtcattcagcattaatggaagcctaatattgcacattaacagcaaagtacagaaaagtcataatgaaaatcccatcaatgttggaatctttaagtgatcagggttgataagagaagattaatcccttcagaaatagtctgaaaagatcaaaacatcatcttcctacttctaggctctgcctctgtaaggttctcaacctcttaatcttccattttaagatctacaatcttattttcaatctttattactgaaatggtgctttgaaaagtttttaaaaatcatttatttgtaaaatattacccaatgataggaagctatttgtagtttttatggtttttcctcagttttttttcttatcgccttttatttaggatatcagttcttgactcttaaacattttattttagataatttcagttaaaagctcaggattttacattgaacttgagtttgaacagagttagaaaaatgctggtcttaaactgaactggcatggccaagccacttaatctctttgactctccctgtctgtcagtaaaattggaattacaaaggctaggcgcagtagctcatggctgtaatcccagcacgttgggaggctgagacaggaggatcccttgagtttgggagttcaagatcagcctggctgggcagcatagtgagacctcatctctacaaaaaaaaaaaaaaaaaaaaaagagagaagaagaagaatacttcacaatattgctgggagaatgagaacttatgtattaaatgttatttaataccagagacctagtcaacatttaacacaagttaagttttgtttttgttgttgtttctgatgaaatcttggtcctctttcttcctttttccagtcaataaatttttctgggtgcctactatgttatcaacattgtggtaagggccagaaaaacagccatgaataagatgctatccatgtctctcatgagctttccttgactcctttatcagaagcatcccaaactaaaacctactaattgaatgggtctttacatagatacacatgcactcacaatgataggattactgtcattctgatgaacaattcctctagtttatgatttattctaaaaagaactatcttctatctgcgtcattaattctatccttcttttcaattcccaccctatccacaagtatgatttctgacataaaatgttttgggaaaactatcactactgtagaagaatctagttctgtcatatcttcctattctgtgctttctctgaactctttttccatgttctgtcaaaatagggagtccagctcaattcttctcaaattcctaatttagcctacttctagctgcagaaaaattgactgtcactcgatagccctggggaaggggatttttggtagtcccctcaggaacagaaaggaggtgaacacaggttgatgaatatctaccttttgtcaagatacagttagaggggatgaggttgtagttcatcaactgggaaccactttcctgtgagaccccaacattttgaccattcttatcttccggaaccccataggtgaggttgctgccctattattctggaagtgccctgaatcctaagccttaggatcttgaaggcatgactacaactactctctctgccaaggttctcttctcatttttcactaaagcccattaggccaggtctaatgaagttcagttttaaaggtcaaccaactgttgcacatttaacatctctcaagagtgagataagattgtaaaattacttccacttgacgtggataatttatctgtgttttcatttgtcttttttttttttttaccacccctccttcataggattggaaaaattggactttccagtcagtctctttttttctactcttaaatgtaggtatttctctatcctctttgttttacatttaccccaagactgactcaaattttcatctctactgcagaactttttcctaatttccagtcccatatatctttttgctcttggaaactcactttggaagttccattagcatattacatttgctatgtccaaaactgaacaaattatctccttaattcctaccctgaatctatccttcctgtgtttcttgcctttgttaatgttatcactttactcatttgtattagtttgttctcatgctgctaataaagacttaccagagactggataatttataaagaaaaagaggtttaatggactcacaatttaacatggctggggagacctcacaataatggcagaaggtgaaagaagagcaaaggcacgtcttacatgatggcaggcaagagaacatgtgcaggggaactcccatttataaaaccatcaggtctcgtgagacttatccatgaccatgaaaaatagtatgggggaaaccacccccatgattcattatctccatctgcccctgcccttgacacatggggattattacaatttaaggtgagagttgggtggggacacagccaaaccatatcaccattcatctcccattcttccctttctctcaccaagtcctgttgtttgattccacttcctggactctcttgaaatcattccactccatcctttgacccacctcatctcattaatatctatcacctttactggggctgaaaaacttgtgatttttctaaaacataaatttgattgtggtcttttcttaaaaacagtcctctccattccatctattttggaaaaaattggtaatttccaaattcactgaaagatgcacaagggtttttatgaactgatctttaactgaccttcaagccacatcagttgtcattctctccctgtgccttccacttatgctgtactcaaggactgaccatgccttttcttgcttttatggttttgcatctgacattccctattttccctcctgtctaactgcctaaaatgtacttgtatttcaagattttgctcaacagtgtcatctctaggaaactttccttaacatttctcctgaccttctacattgttttccctttttttttttttttttttttttttgagacagagtcttgtcctgctacccaggctggagtgcagtggcacaatcatagcccaatgcagccttaacctcttgagctcaagccatcctcccacctcagccacctgagtagctgggactacaggcgtgcaccaccacatttgactaatttttgtatttttttgtaggatggggtcttgctatgttgcccaggctggtctcgaactcctggtctcaagtgatcctctggcctcagcttcctaaagtgttgggattataggcatgagccactgttccaagcctgtgtagctttcttagtctcctgtcgtagcacatatcacactgctttgtgactgtcctctggcttcctatatttcaattctgcttcttgaaggtaagggctatctttaatttcttaaccatagcctaccacaacatttgacacataattaattacacaactgtcatagtgtggttctataacttcttatattcttttcaaaagcttaagaggtcatttcattttttacctgaagttcttaaagcaaccaaacctcagaaagattggaatctcacttttatgagcaatatatgtcagaattggggttatcttttggagcagaagtatccactccatactgaaaagaatatagagcactccaattagaaatagtatatagaactaagttctgcctattttgtttattcagcttaaaatttcctgccaaaagccagagaatccatcttagaacctggttttcttattttaaatttagggagaactttggaagagaagttaaagaaggtgtcaaaagttaattttcattgctataaatgatattttctttaaaatatgtttagaccttaggaagaacaggcattttccctccccttcgtccctgcaaatttcttgactggctatcgcggctcatagtatgtaatcgtttcctaaaaagtcctatttttcttttcctttgctcctgttgtcccatattagggtttaataaacttgctgtcctgttcttagggtcaattgcaagcaatattttatcaaaccaaattctgcttttttaactttatgacttctataggctccctacagacacttcaagtaaagctaatgaattctctttttactattagatcttgtatttctgtgagctattaaaactagctgttatataacaacaaattaaatgctgttgattttcttgtttttaggggttccttcaggagtcacaagtactattgggttggaaaatctgggagaataatagtttacttactgatgaaactgctgtattatcattcattaagctggagcagatcacagtttgagggtaaactacataaaatgaaggccactattttagatggatgcctaatagtacttatcagtatacccttacttccttatggagctctcttttttgtaatttatttaatgaggtcctttgattccttggttatcaagtgaagatattcttttttaactcaaaatatatttataaaattaattttatacatagtatatagtggatattagagtttaaaaagaatgtattttttaatggagaggaatatcaatatttttgcaaccccaataaattgtagtaaattgtaacaattattttcttccaaaagtgtaattttcttgaggacaagatatctttgtattctcattaaccataagagtacattggtagcttatgttcagttgttggttaaatgaatgaattgagccatgcctgtaggactgaatagctactaataccatcgatcatttctgtttataggtactaccattaaagataccttcttctcagcaaatctatgataaaaaatataagtaacagaagaagaaataactgttatttgtcaagtgacaagcttttaatgtcagaatggctcacctaaagcgactagtaaaattacacattaaaagacattaccataaaaagttctggaagcttggtgcagtaatttttttctttataatagttttggttttaatgcaaagagaagtaagtgttcaatattccaaagaggaatcaaggatggaaaggaacatgaaaaacaaaaacaagatgttggatttaatgctagaagctgtaaacaatattaaggatgccatgccaaaaatgcaaataggagcacctgtcaggcaaaacattgatgctggtgagagaccttgtttgcaaggatattatacagcagcagaattgaagcctgtccttgaccgtccacctcaggattcaaatgcacctggtgcttctggtaaagcattcaagacaaccaatttaagtgttgaagagcaaaaggaaaaggaacgtggggaagctaaacactgctttaatgctttcgcaagtgacaggatttctttgcaccgagatcttggaccagacactcgacctcctgagtatgttgaagaatatttattgtttattctttatcaccaggctttgcaggggagagaggggtgagctaaggaagttatctgttttttagctactctaaggcagaaaatcagcaaatactgtttatttaacctgttgtatttattttttgcttataatgattgaggctacatatccctatttatgcttggtgaggcagtgcagatatgaaaagttattagcttggaaattagaaaactgaattctagatctgactgctatccacaaggaaattctttattcctaaatactgtggttttctcatctatttagggggaattattggacaatttgtataggaagtagaaggtagaggaattgtttccatttctctgtatttctttagaataaaaatgtttaaaaacatgccaagattttggaactgttggataatattttatatatgtgtaaagcaattcacagactttgtgattactttgactcaaagtttttgagtacctaattatatttcagaatgccctattttttgtaaacaatcccaagtagctgggattacaggcgcccgccaccacagctggctaattttgtgtatttttagtagaaacggggtttcaccatgttgcccaggctggtcttgaactcctgacctcaggtgatccatctgccttggcctcccaaagtgctgggagtacaggcatgagccattgcacctggcccaccctcaacagattatttatttatttatttattattattattattattattattattattattttgagatggagtctttctctttcactgaggctggagtgcagtagtgtgatctcggctcactgcaacctctgcctcctgggttcaagcgattctccagtgtcaggctcccgagcagctgggactacaggcatgtggcaccacgtccggctaatttttgtatttttaatagagacagggtttcaccatgttggccaggctggtctcgaactcctgacctcaagtgatccgcccacctcagcctcccaaagtgctgggattacaggcgtgagccactgcacccagcccctcagtaagtttttaagtgtacaagataggccaggtttggtggctcacacctgtaatcccagcactttgggaggccgaggagggcagatcagctgaggtcaggagtttgagagcagcctggccaacatggtgaaaccccgtctctattaaaaatacaaaaattagccggacagggtgccgtgtgcctgtagtcccagctactggggagcctgacgctggagaattgcttgaacctgggggcagaggttgaagtgagcggagatctgtgccgttgcactccagcctgggcgacaagaacgaaactccatctccaaaaaaaaaaaaaaaaaagagtacaagataagcaaactggaagcaaacaatgcctgtgtattttgctttgctttctggatattagagaattacatttggcagtgaacttgaagataacttttggtctattgtttcactcaggtttttctagatttaggattatcaatactggatccaagtatatgagtcccttaacattgaaactgtgtagcttagatttctgttgagctattctaatctgattgattcaagtttaggttgctcataatttttaaatgaatgtgtaaagaaactaatatctataaaatattctagctgatataacaaggcacattatagttcctttcatacagtaatagattagaatgcagtattgcactttactgacttgaagagaggttttgattgaaaagtaatctacattaaaaatcaataatcatgatttttattcttttgacatgacaatcagtgacagctcaaaatgagcttttttctcccaatatagcattaagaagctgcaataattttcaataatgttaatcgctaagtaagtgaaaaacaagtaagcacattaacaacattttttggttggagtgaagatttaattatttcttactttggacagggttttgtacaggtggtaaagatttgttttttgacttcgtgatctgcccgccttggcctcccaaagtgctgggattaaaggcatgagctactgtgcctggcctggccaacatggtgaaacctcatttctactaaaaatacataaattaggtgggcatggtgatgtgcgcctgtagtcccagctacttgggaggctgaggcaggagaatcacttgaacccgggaagcggaggttgcagtgagccgagattgcaccattgcactccagcctggtgacagagcaagactctgtctcaaaaaaaaaaaaaaaaaaaaaaagatttgttttttactttgaatgtaaccagtatcagcaaataacacattttctgaagaactgctaatgttttccatgctcattagaaatatagacctagtttctcccaaagccagatggtcatgtgactgataatttaagcatgtttctatgtgccaggtttttcaaatggtttgactggaatgatacagtcactttggcaagttattttaattgcactattttaaatatgtaaaacaattttcaaagcatacatttaacatgttgtttcaaaatgaatggggtttatgaaattatattgtgaaattttattacttgtattgatatgacatttgtacttgatattggtaattatcagttaagcaaataaatcctagtttaaactgacggaaaatcttgcaagattaaagtgataacattttactagtatgaatttttgtgaaattttatactttaaatcttcaaaaccattttataattatcgattaatactatattaattaaccacatagcaaataaaggtaggaaaaaaatcttatactcagaatttcactttctcctcaaaatgcttataacaaatcataggtttcctcttttttttttctttaaaaataaaataccacaatatggaatttttcataatttttacttctagtttatgttggttataaacttttatgggttcaaaatataagcttatatttagtcatttatttctgtgtagttgtggttcaagtgtgtatattaatagtttgtgtttgagcttttttattaattggtagtttatccaaaattcaatttagaataaataatttgtttttatttatgaatgatgaagaaggtgcttattttttccgcccatgcacctgtatcatgctttgaaatcatgaagaaactgaagagcaatgccactttcactcagaatccatcctctcctttttctaatctgttgttgacatcttctcttgatattttaccccaatccaactcctttttttaatcactacaaataatccattctaaagacttgctgttaaaaaagggtatcagagacattcctattgaggtatgactatgaaagtaattaatgggataatttgtgtatctttttttagggcagttttctcaggcccctaatatcacactggaggctacagtttccccattggccctggcagaggaactgaagggtgatgggcttttatctccaatttatggtttttaagtgaccttaaagatatagttgctttatttgcttatctttcccataaacctcacacagttttattttatgtcccagtgacttgaagccctctcctatatgttctttcatttaatcctcacctccattcagcaggcttggcactgtggttatctctacatctctagcctcaaaggctggagactatgcagactctcctgcaccccagtggcttaatatgaagatatttttcattgaggaaagacattcctatacaaatgaatttgagatcaatttataagtaatgtttttaactaatggatagtagtaccactaatcagtcaagggcacttagggtctctctccctgtgcccaatcaatgttttagatggtgacatgagcacaggacttttaacatggatttaggtctttatttagatctttatttctacgtatttttaaagggtttttttaaacgctagtcttatttgatagtagatcaaattattggagcaaaatctttaacacatggcaaatggcagtacttaataagtatttgctgaatgatgaacatcataaaaagataggtttaggctggacatgatggctcacccctataatcccaccactatgggaggcttaggcaggaagattgcttgaggtcaggagttcaagaccagcctgggcaacatcacagactgtctctattttaaataaaaataagaagaacataggttttacaataaagctattttttcccttttgattctgtgtatagattaagtaaattgattcaataaacctaggaaatacttaagaaacctatattacatacttaggtaaatatctaattaaagataatctttataaaaatgatttaatattgtgggcgcagtggcacacgtgtgtaatcccagcactttgggaggcctaggcgggtggatcacaaggtcaggtgatcgagaccatcctggctaacatggtaaaaccccgtctctactaaaaataccaaaaattagccgggtgtggtggtgggcgcctgtagtcccagctactcgggagctgaggcaggagaaatgcgtgaacctgggaggtgaagcttgcagtgagccgagatcgtgccactgcactccagcctgggcgacagagagagactccataaaaaaaaaaaaattaataaagtggtacaatttttaaagttgcaaatatgaaaaatgaatgatttctgcatgaaataagaaaaatttggtttttatttgagcaattataagggtttgtcatttttacatgctgcctcattgtaggttattttcattatttaaaatgttatttgcatttaaaattacattgttgagaaagctataataacatgttgtaatccttgatatgttgtcatctctgttggtagacatcatctctgggtgagtgatttgcttgtaaaaaaattgttttgatttatttacattttatatagcattgagattatatcacatacaagaaaactatcctttttcagtgataaagattcaataatgataatgttagcaatggtatagctgtgaaataaaataataaaatttgtaattgtttttctacttctctgacttcttctagatgtattgaacaaaaatttaagcgctgccctcccctgcccaccaccagtgtcataatagtttttcataatgaagcgtggtccacgttgcttagaactgtccacagtgtgctctattcttcacctgcaatactgctgaaggaaatcattttggtggatgatgctagtgtagatggtaagaaagcacatgcaaattagattgtttcccaaatccatattgtggtatctacagtctacttggttatgtggtactctctgtatgccatctcagagcttgaatataatagtttggatagtgggtatggtgaatgaaattagaatccaaggatggacatattcaaatattttcaaatgcagaaatgtatgaaacaccattattcataactatgtagtcctcaatgtgagactgttacagtaaggcatagaggttaagagcacagacttgagcctttgagtcaggctgccttgatttgaatcccagctcttttcctaaccaactatatgacttgggcaagttactcaacctctctgctgtgatttatcagcaaaatgggaataatgccatatttcattaaatatattatgtgttgttaatttataaatcactagagaaaacccacagctaattaaacttaacatgccattgattataagaaattgattataagaagaatccaattgtgtagcttaaaattgaggaaatacagaactagtacataatttctagagttgttttaaagactgaatgagttaatataaatatcaataaataatataaatgaatagttaaaaagagtcaccatgttctattttatttcggtgttcttaaatattccaatattacttacaatgttagtcaaattctttagtacatttccacttaaaattggaagtcaaatactaaattacacattttaaattggaatcacaaggctaatttaacaaatactctaacttgtaaattttcaaacatcataagtattttaaatattgtgtcaaacagatacatattatttcaatgattacaaaatttattccttaataaatccaagtttggagttagattcctgaaggtcagatatctcattttatcctcccagcaatgtcttgtgatggtgagtccgattatcctcatcttaaagaaactgaggcgcagaaaaggtaaaattccttgcccaaggtcacacagctaaaagtaattgtgccataaagtgaaatcagggcatctgatttcatgtagctttctgttcttaacctcccaaataaagggtgtgcatgggagctaaatttagggtgcagatataaatttacgggaagttcatatgttgtgggtaagtaaatttttttttaacaaattccaacagtgagagggtatattgaagcaatctgtagtaactccatttaaaataattctaaccaagaatgttgaaatttttacaagcctcttaaaacagaaaatgtttatgattatatatttaagatgagttacaattctgcttgtctttctgagaattatttctgaggtagttagaaggtgttaaaagcttaatctgagaattattttgaggtagttagaaggtgttaaaaagttaatctattactctgagacaacagtgtttagatagatttatttttctacaagggttgttcctgcactttcctctcttatgaatgtttaagctttaaataagcagctctcttaactgaaccactggagaattgaaaaaaaggttatattatcacagataaagtcaaagtcatctgcatttccttctaaaatctggcagaagcaaacttttgccccaggacatttattgattttcttaacattcccaaatttttttgaggctatgttttgggcccaagaaggctgcttgaagaactgcattttgtactcaataagaaatcaaaaatttaattgagaaaaacaggcttaagaagttgtttcagaatatgaacagctgggcgcagtggctcaacctgtaatcccagcattttgggaggctgaggcctgcaaatagcttgagttcaggagttccagaccagcctgggcaacatgatgaaaccccgtctctaaaaaaaaaaaaaaagaaaagaaaagaaaaattagctgggcctgttggagcatgcctgtggtcccagctacttgggaagctgaggaaaactgcttgcagcccagaggcggaggttgcagtgagttgtgccactgcactccaccctgggcgacagagcaagaccttgtctcaaaacaaaaccagacaaaaaaacaacactggattgacatttgttaataacttttttaaaacctatgatctcaaattttgcttattacaaaccttatccaatttggtatattgaatatcttaaagtatatacccaatactaaaatttgcctgtttcatattttactaaataaaactgtcaggagactccaaagctttcgcaaatttttctgctgactctgtgtaggaatcgtcccaaactgctatagctgtggactttctgacgtggctcaacattttggtgttaaattattttgatccttgcttaaatatcagaggtctttagatatttgacatttttctttaagatttccagatttaaataccaatttcaaagcattgaatatctttttggccaaattccatatctttcactcttgtagtcagtcttctcagacctctaaatgagtcttttgaacggctagggttgactccatttgaagtttctcacttccctccaaacacattatatttattgataggaagtgtacagaataagtatgcattacagtgttttgtgttacagtagtgataatttgcatagctagcctttttccccagtaaggagttaaagataaaattttcattttgctggaaggacacatgcaactgttaagattatgaatttggaaggatcattgctctgtggtttcattagctttcataagctatatatgaaaatgcatttagaaagaattaaccctgattttttttccttacagagtacttacatgataaactagatgaatatgtaaaacaattttctatagtaaaaatagtcagacaaagagaaagaaaaggtctgatcactgctcggttgctaggagcaacagtcgcaacagctgaaacgctcacatttttagatgctcactgtaagtatatatgtatggatatggttgtaacattttccctccctctccctctaatttaaaaggtaaggaagtcttttcttttctaaatgcctaattgcattttctttaacagcgttttcaactggcgattatagcaatgacagcccaagcaggtaacagctctgtggagaaaattcctttcacttatgcagaattcttatctccttttgtgtttaagtttcctcaacttcagtgttctccagttactagctgttccagccagttatccttgcctcttttttttttttccatgtttcttttctgttaaaaaaaaaagtgtttgtttgtttgtttgtttgttttcttgattcccacactttaaagtgaatgaaagcttatttactatttaaatgtagccgggcgtggtggctcattcctgtaatcccagcactttgggaggccggcgttggtgaatcatttgaggtcaggagttcaagatcagcctggccaacaaggtgaaaccctgtctctactaaaaatacaaaaattagccaggcatggtgacatgtgcctataattccagctactagggagactgaggaatgggaatcgcttgaacctgggaggcagaggttgcagtgagctgagattgtgccactgcactctagcctgggcagcagagtgacactccgtttcaaaatgaatgaatgaatgaatgagtgagtgaatataatccaccctatcattaaacttcgtcctagtactgctgctttttttatattttagtttgtgtgtgtgtttttttttttaaatttgcagactccttggcataaaaaggagtctgcgaattttcaataaaaaccacaaaaccaaaatatgtttatatatatactttttatgccaggttaggggtgccccatcccatcttctttggtatcccttacataaacattgtcaatttttgtttgactttgctgctgttggtttttctttgtactttaattattttcagagtcaaagtttttgaagtatttagaaagcatttttagagtcaatgtgtcatatgcatgctagttattactaaactgtcattttgtcccttgagctctgagtttagtgggctatactttgtatgagtgtctagctttgaattggccagtgcttaggttatgtttcacccaattactagttttgagcacacaccgattattacagaagggcttttggatgtgcttgtgttgcttagagccatcacattcagttctcttttaataccagacatttagaaaatgaagagaacactaaaggtaatgctagagaggtgctttaaaaaggaaaataccatcctctggtatttcttctcgttgttcaaaattacaataagatcatactggacattcttacccactacccactgggtggatatgtctgacggtcctcccggaccatgactgccaaatactgctttgtggggagcccagaataggacagcacatgcattggctgaacttgctgtgtgttacataaaacagcctggcctgtgaccagggcttagacctatcatgacatgaaactccttggccctccctttatattaggtctggggcagctttgaatggtccttcttctccagttgctaaaatcggaatttatactgactccttattttctcctaagacccagtcagataaatgaaaatttcaattactgtaccttattcagggagatacgagtttaaataaatcagaacacttttagggccaggtaatgtggaacagcaaaaagctacctttgactcataggccattttaacacatcatctaaactttaaatacactggtgttattttgcatcttttgtagaagaaagaaggtcatcatctgtaggggaatttttctaactgtagtgaatcttttttcacctttttcatcctaccctcatctcatcacaataaacctttaaaaaatctccccttctggagatctattgtacaacgtggtgactgtaattaataataatatattgtctactcaaaaattgctaagagtagatcttagatgttcttaccacccgctccataagccgataaggtgatggatatgttaattagcttgattgcaataatcattttacaatgtatacatatataaacactatgatatacactgcaaatgtatagaatttttatttgttatatctcaataaatctgaggaagaaagaaatctccattatatacatgttcaaaacacaaattgactctgttattctcatttctctgtaaaccttcacctaaataactaaagaaaaaaacttcaatgtttttattgaattaattaaaattctgttccctccaggtgagtgtttctatggttggctagaacctctgttggccagaatagctgagaactacacggctgtcgtaagtccagatattgcatccatagatctgaacacgtttgaattcaacaaaccttctccttatggaagtaaccataaccgtggaaattttgactggagtctttcatttggctgggagtcgcttcctgatcatgagaagcaaagaaggaaagatgaaacctacccaattaagtaagatgattgctctcagagtcttatatttacaccctataccatacattgaatatgtacacactgtttgctttatagcaattgcctctgaggtaattgataaagaacacacatattctatataaagagaatctaaaagtcattcatttgtgtacttgcttatacatgatgttgctgagtaagaggtagcagtgagtgagctcttatgtcttcctcatcaatcattacttaaaaatcgtaaagcatggttaggagaagacatttaagtttactccaatgggagaggacacgaagtactccccccgaccccaaaaatcttgactttgaagatagcatttctagtttttattaatctgaataaaagctttgaaaatgtgatatggctttaattttttaacttcagttcttaaaatatgctgttttatcttgtttagtttttataacaaaatttgacaatggattatttttcagaacacccacttttgcaggaggacttttttccatatcaaaagaatattttgagtatattggaagctatgatgaagaaatggaaatctggggaggtgaaaatatagaaatgtctttcagagtaagtttatggaaattaaatatagcagatatattaaacaatgaaatatattgtgttctaatcggctggtacatatgattacagatgtgtgcactctactttttgtgctttctgaaacttaattgctggaaattttggaataagaatattttcttttaatatgtaacttaatatatttattcattgtcgccagtgtaacaagaggaatcagttaaactcctgtgtccaggcagtaacaccaattaatgcacttgtagctactgaattccagccaagataaatataattaaatctagtgcttcaggaaatgagttgatcatcaagggagttagaatggaaaaacatttatgaataattttaaaggacattggacttaactgtttggaatgaatgagcttgattttttctatacatattataagttaatataaaaaaaggctttgggtagactccgtatgtaccttatgtatttgatttcatgagtttcattttctgcagtaactttatcattcatttttcatctcttaggctggaatgtagtggaaaaagaactgaactaggagttagaagatttaagttttggctctggctccatcacatactggcagtgatgatcttagccaagtttgaactgcttatggcggggtcttgtttattcatttcagtatttccaacccctagcacgtgttgggtcacaagcacagtttgttgaattgaacatatcactgagtcttctcatttgttcaagaaagaaaggagagaaagagatttgtaatcacttgctctactacaagcacatagtattaaatatgacttattttctgattctttgcttggtaactatggcagagtcaattattaagatatttaagtgaaaaggcattgatttcatgatttgccattttatttagcattaatgccaataaggattttttttgacgttttctctctaaattggcatgaatttttaaataatcatcctctactttgcaagttcagtagaatgatcattggtaataatagccatctggaattgttttcttggttacaaaattgaatatacaagagataaatagggtctgagtccacttatatccaaactttgaagagaaactctagtttaagtgaagtgactatgtcagtagttcagacagaagtcaaatgcataagagcctttagttttctgtgcatattagagaacttacataattatttgcaaaaacaaaagcctggaattcatttttatgaaaaatctgaaatcaccattttgttaacttactgaaaatgcacttctgttgtctttagtgtctatgccatttaataaaataattccttacacttaagaacttaagttgaaatggcaggggacagagactatttgtaatattgtaatctcttctctaattttgtttttcataataccttaaaggtgaacttaaaagcaacactttgatttttctaaaatactgtaaatttaaacaaatatcattaattatcaggtatggcaatgtggtgggcagttggagattatgccttgctctgttgttggacatgtttttcgcagcaaaagccctcatagctttccaaaaggcactcaggtgattgctagaaaccaagttcgccttgcagaagtctggatggatgaatacaaggaaatattttataggagaaatacagatgcagcaaaaattgttaaacaagtaagttaaagctaagtagttaaattgcaataaaatctataacaagttcacacgtccttttgcgtcgattcatctcaagtacaaaacatcaaaaaatttgaaagtaggtttttaactcttaaagtacatgacttatgaatccaagtttccttttttaagaaaaaaactaagtaaactgctttttaaaaatcaggaattctacttgatgtttttaatatgaaagatagttcatttttgttgctgccctggttcaatattttactcgaagaaaattaagtagaactgtttttactggttttaggagatataacacctaaataaaggttctaagtgactttttgcactggagatagagacagtgtcttaatgtggcatgagaataaaccaggagtgccaagcctttttttttcaagctctagtttcactacttactggagatgttactttggcaaagcctttgagaatgtaaaatagggaagacacttcatagagtggctgcaaggtggctggacatggagtgcatgcttaacatatttcttttctctccttccctgttttaagagatgaaatacgcatgctgtctctctcccagagtagctgtgaaataagaaagtgataagtgctaacaaatatatggtactcttgttattaacctgccataaatagattctgctctgcagaatcatgaaacctaatatattagaagtgagttccaatagtcttaataatattagataaggtaaattaactagatagtttaagaccatgcttcagtgtatagtactcatctctttgtaggaaatagatagtgctaatttgcagggtgagggaaggtggagtatttattgggagtcaagggtatcaatattttggctgttgcggtgaagaacgatttggttacctctttccctttttctctggtctccagtatctccctgttaggatgcaaattaagagcactactgagttagattgctatctttttacccaaggccatgaagacaaattgggcagattgtgtactgtacaatagtacttggctaagcaggcaagtgggcactaaatgaagcttatgctctgcttgtcccccacaaaggggcacataaatcagcaaatacctgttggttaccacaggacacatagatctacatggtaaatgtaataagctagccagaagtcctaaagactcatactttttgctaaaacgcctgggttcaagacatcaaagttggcataagaaaatattttctttagttgaactgataagattgagtatttacttttgcatacatttagatattacatgtactttttctctaatattttgcctgtaggtcaaataccttgaagtttaataatggttttttaaaaaagttattttcttagtacgttaaaatgaaggaaagcaaaattcatttaacttgaaaattgcctttttctactaaaggttcagttggggatattgttaagaacaagcaacatcctgaaactagaaaaattactcccagtgggttatttcttgctggtggttttctgtgatcttgatggagaagagatagaagttgcattgtgtattggcactgtttgtctatacctgatttctgacacctcactttgcagatcatttttaggtataaagttgggaccaattttggatgctcctaccaccattcctttgcccacagcattttactagaaatctttgtcttgtagggaatgtttgtggcacaaatgaagaataaaatagcatcattttagtattttaatcagcactgaagtggtgttgactctcttttaaagccagaaatgaacaggcaggcatggtttttacttgaatgaatgatgaaggctgttgaattgcctcttgaatttttagcatggatttttaaaaatacctaaatagaaatacaaataagagtattttaagtgctttatcaatgttgttttaattaagcattcccttcatttctcatgtttctacagaaagcatttggtgatctttcaaaaagatttgaaataaaacaccgccttcagtgtaaaaattttacatggtatctgaacaacatttatccagaggtgtatgtgccagaccttaatcctgttatatctggatacgtgagtattttcctgttccttttttaattaatatactccttgccaccaacctttatgtggttctaagaaaattgctgaaatactttctttattgcttttgagattttacattataatcattaacattactttctaaattattttaaaaatatataaatcacatggattaaaaaacttttcataacttgaaaattttcctttagattaaaagcgttggtcagcctctatgtctggatgttggagaaaacaatcaaggaggcaaaccattaattatgtatacatgtcatggacttgggggaaaccaggtgagcactgcattaaaaatccttcacttgtaaagcatttacaagcacaagtgagatgttgcctatttttcagaagtcccacagcagctttatacttgggtaagctgtgtgtgaaatgttttcagactgagtttggcaattgatattgatgagtatttttttttggtttttactctggctctgaaaacaatttgagtagcttaaccattaaaaaaaaaaaaaaaaaaaaaaaaaggaggccgagctgagtggctcacgcctgtaatcccagcactttgggaggctgaggtgggtggatcacttgaggccgggagttcaaggccagcctggcgaatatggtgaaacctcatctctactaaaaatacaaaaatttgtcgggcgtggtggtgcatgcctgtgttcccagctacttgggaggctgaggctggagaattgcttgaaccacggaggtggaggttgcagtgagccgagatcacacaattgcggtccagcctgggtgacagagtgagactctgtctcaaaaacaaacaaacaaattaaaaaaaaaaaaaggaaaatgagaaaataatagaataatgccatttgaaattttttttaaaaagaaacttctatgtagctctttgatgctttaacttttgcatgactattggcatggtgattttgcaagtttacacataaaggccacatataactggattgaatcacaaattacatcaagtgttaataacaaaatagagcattataaattaattttgtgggccacaatattatttcaatatgttcctccttctccaacaaaagaggaagattctccttgattagtgacatacctgctttactaccttttgactattttactgattaagattcacatgtcaaatattactatttacttgcctatgggtagagaacatgttatatacaaagtttctgtttttttaagcttcctttccttaccttttgcagcttaactcctggaaagattagactatttccctcatttgttcattcaacaaattcattgagtgagccctgcatgccagatactctgatgagttcaagctatttagactctaactcctttaggaaatctataaactagcagttccttaggataaagcattcagagtgttctgggggtatagaaaagggcattgaatgagactgggtgtccacacattttcctgagaaagatgatatttgaaaacattaaaaaaaaaaaaagtaggtaggagctagtgaggtggctgtggggaatggcaacagaataagaagagtgtgaaggaaagtgaaatgaagagaagagcctggagtatctcttctgggcattgcaggtattttggtgtagagtccaagatgtgtgtggaggatttttgcaataattaatatccatgatgtcctattttaatgggacgaaactttgagatgtcagttttaggaaaaaagagccagtttatctcctggtccatcctcttctatatttcttcctacccattaggctcagcttaatctagttctaatccttattaacctaaaccaatcaatctactgagggcagatgatacagatgcccagaagccagagctggtgaactggatctattgctggatggttaaggtgtaattctgaaataggatggagatatatatggatgcatatagacagacatacatctatacctatatctatatacatatatatctgtacatatatgtgtatgtgcataaatctatatgcatctttttaagaattttcttaccctccatatattagaagaaaaatagttacataaataattgcattctttggaaataacactgatctatgcttgtaaaaattaagattttgagcaaagggaaatatttctgcatttgttaaaatcttactagtaaatgtaaatccctataaatttctcttaggcttcttctagcattacatttattttatcttaaaagctgaagatatattgtacacattgcttttttccatttttctgttatcattttcataaagataataacagctttatgatagctctgtatcaaaaatatgtttacattttaaatagaatatagctatcttttagaaattgggggatgggaaaacattcacatattctttcaataagtgtttgtttagaacctataaagtagcttgtactgactgttaccgtagtaaaaagacaaagctcctgatcttgtggagcttatgttccacaggaacaaagaaaaaaatatgtagttttgggcatgaagaaaaatatagcaggtaagggaatagtgtgtttcggggtagggtggttattttaagaggtgagggaagacctttttggaaaagcgatcttagagggaggcctgaatactgtgagagagtgttccaggagaagatgctcatcttggaggaaggatttccaagagtggaggcccagaggcagatacatggagaaagcagatagccagtgtacctagagcagagtggtctagcaaagaggactaggaaatgaggtcggggcattgatagggacctgatcatgtagggcttaactggccccattaagaaacttggacttaattctgactttgacagaaacaattgaagagttttgagcagaagaataaatattatctggtgtatatactaaatagaaacttcagcttttgttaccctaacacagctattgattttattttgctttatttccttgacattttatttttaatcaagcattgcacttaaaccgttttgcaaattttagttccctgagtgctaaaatttttagatattatataacttgatcattttttcatgtttccttctacttttgatcagataatatttttatagcataaaacttcatgtatgccaaataaaaataaatattttggttatgtgactaagctggccaatattactagtgtaatgcagtttgagtcattataacttgattatatttactgctttgcctcttctctactcgttctaagtaatgggtctctccaacattcacagttatccaattatgtgctcttttttgttaccaaagtactttcaatattttccattttttgtaatttttattttaatgactttttaataatgggtaaaatactcgacagcctttgttaccatttttgagatcttaaggcttatctttcttagccaagtatagctagaatgctattttcatcatctaaactcagtttcttcctgtgtttccatctgaagaactactagttctaaaaatgactgatgttttgcttgtgggcggagataaattaagcatgagactaagagtagggaaactcaagatatatggctctgtgaattcagcgaatgtttgtagagtgcctactgtaatacacataaagagtttaacacagtgcctgcctaacatgtaataaggacttaacaaatattagtgctcctactaattatttcattattgaaaatcaattatgttaacttattttatctttataatgtcaatattatgaaatattggatttgtgatgggtgttatgactcgataaattgcctgacttcagtctatggggaagccaggtctacacaccacacacaattctaatagagtgctagaaaagttatctctgatgtactatgggaaccttgaaaagattgtaattttgtgcagcagggcaaattcaggcaaagccaaagaaggaaggtagtatttgagttggctcttgaaggattaaaaaggagttagccaggcagaaaagggtcaaaagtgtattccaggcagaggacagactgtaaagcaaagtcttagagttatagatacatatgttctgattggtagaattgtgtgaaagaagcataatatataactggggcaatgattgatgcaagatcaaaaagaaagatttcatgtaccaattaaggagtgtggactttatcttagcaacagtagtgattcacttaagcaagggcagtcagggatcaaaccaatgctttaaaagactatctggcagcagattggattgctggatgataggaacagaaattggaagtagctgtaggtgtttcagtaaaaattctgagagtctgagtaacagaagtgagtacacggaagtgagaatggatgggatgttaacatctgagaggaatagtgcagctaagggacgaattacttggatatgtggagaaagagaagcatcagtagtaacaatagctaaaatgtatgaaaactcaccgtgtgccagtcattgttctaaatgtattatgcgtattaacccacttatcttcataaccctgtggggtaggaactattaaattacccattttctagtgagaaaactgaggcatggtgaacaccctgaagtccctagtttagtgaaaacacctttgattgagatgaagaagagagatggaacacttgtgggagagaggcaattaatgttcttgttataactcttcattcccttttctgaggaatgcctgggatagcctccactctccttgataacttccaacttctggtatggggaggaagacagcaccttgttaatgaagtaaccacctgttgatgaaggaaggctattgtatcgtctatcacaaaaactcagcttatgtttctaataactatttttattgtattattttgttgaaatagaaatgactttattatttaacgagttgctgatttatttatttattttgcaactgagcacatgggttgcttttgtcagtaacagtgctattccttccatagtactttgaatactctgctcaacatgaaattcggcacaacatccagaaggaattatgtcttcatgctgctcaaggtctcgttcagctgaaggcatgtacctacaaaggtcacaagacagttgtcactggagagcagatatgggagatccagaaggtacctcagtgcaattaattcatctatttaactatttttcttagctctacttgcttatctgggaaaatgagtggaacatggtacattaatattatctatcagaatttctctccctttattaactttgttattatgtgtttctacccatgtgataagagaatatatctatgaattaagtactcttagtaacaaaaaattaagttgcttggttgaaccgtgatatatgcagatgagcacttctgtgaattattaatattagtcgcttgttttttactatttagggtttcttataatgcttttagcaacagtcatattttttttctgtcagagagaagaaaaattattatatcttctcacttgaagtgattaatttttttctaccctgttttagcactttttcacaaacctagaattgagagaatacataacaggtctcttctgtttttaaacatgtttaaggcttagctgtatcatagcaattcttacctgaacattgttttgtgcagtactagaaaacgttaacactggcttttataatttatgatgtttttaagagtttgtcacttatggatatatcaagggaatacttcttgtttgaaaatgtgattcaaaccttgttctgtctgcctctcttcattatgtaatatcttactaattgaagagtagtagcttaaaaggtggcatttacactagaagccaaaaagagtttatcagacatggctcaccttagaaagatttgctattaggtttgcttcaatgaaaccataaaatctttttcatatttgtcacttaactatgagtcttggaatttaatgtctgttgtttccttttattctaggatcaacttctatacaatccattcttaaaaatgtgcctttcagcaaatggagagcatccaagtttagtgtcatgcaacccatcagatccactccaaaaatggatacttagccaaaatgattaagtgttccttaaaattaagttgaaaaaggaaatattctttctcataaaactgtgactaggcatacactgtagtttttgaaaattatgcaaaagcagctaaatgtaacttattccaagtgcatttttcttatttatatctttatgtagcactactacagaaattctgcaagtttctgtttcaaagcacaataactagtaataccaaagactatttcaaaatgtccagatgtaggggaagagatgtttacagtatgatgaaaataattttccaagtaaagtgatgtttgtgtgttttgtacacttagggatatatatatatagctacattcacacactcacaatttaaaatatttcccctagttttttggggggataggaagaaagatttgttactgtatttttttaactacataaaaatagatcaataaatgtcagcattggcctctgtgtacaaaccaagagcttttacagatccagaatttattagtttaaaatgcaggtgaacttttttttgcgtttggtttacttgtctgtcaaatgtttccttaaacatgaaactgaataaggagaagagtatttttaacacttaaatttcttggcaaattttaaaacattttttagtctgtaatacactccacttgaagcacttaagtcttccttaaatgacttttcttaagtaatgatactgtgtgttttcccaaagcacttttaaaaaaatttttataaattactatctgttgaaaaggtgtccttttcctttcttctagtatttttttcttaccaaaattcactaatcttgaatgtttgtgatattaaatttcaaatgcagaatacttgactcatttaaagctaaattttgttactgattcaattataattgtaatggatttttgactttgtaatggattcttttcatcaaaaagccttatttttttatctatgtggaaaacacaataaaaaatcctcaacactattgtaatcatttggttaagtttttttcctcttttgggtaaaatctgtaattgataataggtgggggaaaatgaattttgtatgctgaatttctaagcgcctattgtttgtaaaaccatcagatatttcttatggcacaaaaaatgaggaatagcaaaattcctgtgttcaatatttagaaaattttgtattaatttctgataaagttccttaagcatctgatagaatgatgttttaaaaaaatttgacgcttgcttaggagatttaccactttttttttttgtttttcgtcattttatatttagatctcctgtattcttgttcccgaagtaaaatacgatcggtttcatattttaaatctggcagagcctcagctgtacgaaaaagagcatatactggttattgaccctatcttctcattgtttgtttgtaagtttgaatttgtattaaaaagcctgcattctgagctggacatggtggctcagcttctaatcccagcactttggtaggcaaaggtgggaggatcatttgagctcaggagttccagaccagcctgggcaacatagcaaaatctcatctctacaaaaagtaaaaattaaaaaatgaaattaaaaataaaattacctaggtgtggtggcacgcatctgtagttccagctatacaggaaggtgaggcagaagcattgcttgagcttgggagatcgaggctacagtgagctatgattacaccactgcacttcagtctgtgtgactgagcaagactctttcaaaaaaaaaaaaaaaagcctacattctccagttgattatttcaactaatgtgtattatgtgcctaattttctatcagaagttgtattagcccgttttcacactgctgttaaagacatacctgagactgggtaatttataaagaaaaataggttcgatggactcacaggtccgcgtggctggggaggcttcacaatcatggcggaaggtgaaaggcatgtcttacgtggagg

SEQ ID NO: 36403 - DNA, 4565 bp, Homo sapiens
ctcctctgggtaccaactctattgcgcagctcgctgccgtgcgtttaacccaggcgaggaggaggaggagaaaattcccccagattcgggcaggtgggtgtgagggtgggcacagtctgggacccctgaatagggtaatctagggatgcgggagtcggaggccgcgggtgcctcggtctcccccactcctggccggctttccagacctgaggtgctcaaacgcggctcattttggtgggcggtggggaaagggggagggggaaacgaaaagacttttgatagactttacgaagaatccgcttacttcctttccagccagtgttttttggttttgtttataatattcaggcccgcaccccacattccgtcctgttttgagaggaggagggaagagaaataaacgtggcagcgcatagaaggccagcagggaggttgggaaagggtaaccaggaggcgggggtggggcatgcaatttggtaacaatctgggcggcacactcccaccctgactttccccaccaccgccccggcaccctcccatcccccagccgaccctctgtgatttgggagtgctgggaaatgggtgtaccagctgctgttggagaggtggcgggtttggcgctgtctgggcttcacgggaggtgggggggaaggggcggaccctgagagaatctggtattaaaccgccttgttaactcgcagactgctttccagacacctccggcccacacagccgttcaccccccgtcttttcagtcctggaaaaggaattcgggtatgcaggcgggagaaatggcggttgttggggggatttgtgggaagtgggaggtagagcccatagcagagaaatcgtggaaaatctcgaccctgaacccgaaaaggcagacgttgaggcccctcttctgcaggctaacgctaggcctaggggctggggagcgaaagatgggtgatcctgggaggggaacactgaattgtttggcaggagtcccccataccgcgtcccatccagcttttgctgcaccctcgccccgctcccctcccgcttcgttgcaggagaaggggtgtggcggtgtgtcctggagaaatggcggacgggggcggggcaaagcggaaggagggattgagtgcctggggagcctgcgcaggaggaggattgaggtgggaggggtggggtgagaagagttgaaggaattgagaggtagaatcatttgacattctgatgtgcaaacacgaaaaggcagttactgagacccttgtcctggatgctgatccatccaccaggctttcattgtctaacgtcgacagtctatatttctgctcttcagtctgtccttaggatgaagctctaactgaactgaagtaaggagaaacagccttgaatctttggagggtcagtgctggggttggaattgtctggggccccctggtgtgggtgtggcagagacaagagtagagtatgggaccagaggctcctcctgcatcttctctcttttaatttcaaagacacccttgccccaggccctttctttttggtgcagagaaaggggcgtggcatctgccttagttaatatttgggggaggagaggctgaagaggaaaagaggatccctgaggggggaaaacctttgacccacaggggcccaaatcaggaaaagaaccagaattcgtccaccaatggctcaaaaacgccctttctgatctgtcctcaggtctgtcttccttttgggctctgtgcaactgcagctacagtggaaaaaagcaaactgctcttgatcccaggttggtatgtgcatgagcaccatgtaggggccttgggggtagggggtggggcatcatagcagaatctgagatctctactgtttttccagctctctaccagctttacccatgtctgtactgcctctcgtccttccatttagatgctggaagttgtaggcattggcagagcaggctaaggttgaagatgtagaaaacgttaaactaggtctgtgaatcagcaaacacaggccttgacacctgtgtctgggtgctagcccgccaacgaagcattgtgtccctaaactcttctctaagtagaactggttagacacgaagtgagccagagccctaagcctcatttttatcctttacccctaggccctgcctaagcctcagcagaacttgtaagcctaaactgaagagcctcacccggacgagcaggcatcccttaaccttaagcaatccagttccacgccctggatcagtgaataaccccagctgcaccatgagccgcgttcgggatgctggctgtgtagcggcggggatagtgataggggctggtgcctggtactgtgtctacaaatacaccagggggagagaccagaccaagaagagaatggccaagcccaaaaaccgggctgtggctgggactggagccagggctagagctgggctaagagccggattcacaatcgaccttgggtcaggattcagtcccccaaccccagtccgtgctgaagcagaggacagggcccaggatgaagcctctgctctggacacagttggagctgaggcagtggccccagctgcatccagcgctgaggctcagagtggggcaggcagtcaggcccaagaggcagatggagccggggttgggcctaaggccgaatcagtagttggggctgcaatggcttctgcaatagcaccacctcccggggtgacagaggcccttggggctgcagaagcccctgcaatggcaggggctcccaaagtggcagaagctcccagagaagcggagacttccagggcagcggtgcctcctgggacagtggtgcctaccgaagcggcagcacccactgaggtgaccgagggtcctggggtagcagcacctaccaaggtagctgaagctcccggggtggcatcgcctaccgaggcagctgaggctcctgtgcccgcaacgcctactggggctgcagcacctactggggctgcagagtctcctggaacttctggttcccctagaacagcggtggttcctggaacatcagctgccaagaaagcaacccctggggctcacactggggctataccgaaagccacatcagcgactggagcggtacccaaaggtggaggcaagggtgtaaccaggtcccggaatgggggcaagggcaagggcaagaaaagcaaagttgaagtagacgaactggggatgggcttccgtcctggagatggggctgcagcagctgctgcagcctctgctaatggcggacaggctttcctggcagaggtccctgattctgaggaaggggagtccgggtggactgacacagagtcagattcagactctgagcccgagacccagcgcagagggaggggaagaagacccgttgccatgcagaagcgcccctttccttatgaaattgatgagattctgggtgtccgcgatctcaggaaggtccttgccttgcttcagaaatctgatgatcctttcatccaacaggtagctttgctcactctgagcaacaatgccaattattcatgcaatcaagagacaatccgcaaattgggaggcctcccaattattgcaaacatgatcaacaaaactgatccacacattaaggaaaaagccttaatggccatgaataacctgagtgagaattatgaaaatcagggccggcttcaggtgtacatgaataaagtgatggatgatatcatggcctctaacctgaactcagcagttcaagtagttggactaaaatttctaacaaacatgactattactaatgactaccagcacctgcttgtcaattccattgcaaactttttccgtttgctatctcagggaggtggaaaaatcaaggttgagattttgaaaatcctttcgaattttgctgaaaatccagatatgttgaagaaacttctcagtacccaagtgccagcatcatttagttccctctataattcttacgtggaatcagaaatccttattaatgcccttactctatttgagattatctatgacaatctcagagcagaagtgtttaactatagagaattcaataaaggttcccttttttacttatgcactacatctggagtgtgtgttaagaaaattagagccttagcaaatcaccatgacctcttagtgaaagtgaaagttataaaactagtgaacaaattctgattggttatgtaccgtcaaaagacttgaagaaatttcatgattttgcagtgtggaagcgttgaaaattgaaagttactgcttttccacttgctcatatagtaaagggatcctttcagctgccagtgttgaataatgtatcatccagagtgatgttatctgtgacagtcaccagctttaagctgaaccattttatgaataccaaataaatagacctcttgtactgaaaacatatttgtgactttaatcgtgctgcttggatagaaatatttttactggttcttctgaattgacagtaaacctgtccattatgaatggcctactgttctattatttgttttgacttgaatttatccaccaaagacttcatttgtgtatcatcaataaagttgtatgtttcaactgaca
